United States Patent 8,299,318 (NUCLEOTIDE SEQUENCES AND CORRESPONDING POLYPEPTIDES CONFERRING MODULATED PLANT CHARACTERISTICS) - sequence listing, part 12

SEQ ID NO: 33193 - protein, 289 aa, Panicum virgatum
  misc_feature: Ceres CLONE 1949498
  misc_feature (60)..(258): Pfam Name: Chloroa_b-bind Pfam Description: Chlorophyll A-B binding protein
  misc_feature: Functional homolog of the protein sequence given in SEQ ID NO 50114
  misc_feature: Useful for making plants with modulated water use efficiency
  misc_feature: Functional homolog of the protein sequence given in SEQ ID NO 50115
  misc_feature: Useful for making plants with modulated biomass
  misc_feature: Useful for making plants with modulated drought sensitivity
  misc_feature: Useful for making plants with modulated phosphate use efficiency
MASSVAAAASTFLGTRLADPAPQNGRIVARFPFGKKPAAPKKAAKTSTSSDRPLWFPGAVAPDYLDGSLVGDYGFDPFGLGKPVEYLQFDLDSLDQNLAKNEAGGIIGTRFESSEVKSTPFQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLAADPEKKERLQLAEIKHARLAMVAFLGFAVQAAATGKGPLNNWATHLSDPLHTTIFDTFGAGSS

SEQ ID NO: 33194 - DNA, 1678 bp, Panicum virgatum
  misc_feature: Ceres CLONE 1949510
  misc_feature: Encodes the peptide sequence at SEQ ID NO. 33195
actcggccttcttctccatcggccagctcgaaatcgtccgcccgtcctccggctatccgcctcaccattctcggccgcctcgtaaaccctccgctctccgccccgcacgaaccggggcggaaccaatccaaaaccctacctacgtgaccccgcatcccgtacccctcgcgcaagccgcgccatgttccgcgtcgcgaggtcgcgcctcctccccaggatctccgcgctctccttctgcactgcctcccctgcagccgccgccgcctcctcctcctccactcctccggtggctgctgctgccgccgccgccgcctccgcctccgaggcttcgtccacctctggagacccatcatcccagcagcccccggtggcccgaaagccatggggcacgctcaaggtcgcagccttcgcggccgtgttcgccgcggtcggtgccacaggctacgccagctacgcttattctctagaggaattggatcagatgacacgggagttccggaagaaatcgaagcatcccattcctgaagactcgtccggcttcgagaagtttcaggctatggcttattcagcagctatgaaagctcctgttgccgctattgagctatacctggatgtcaggagccaaattgaagatcaaattcgggtcagtaataaatgtgaaccagtatcagacaaactccttccagatcgtcctcctcaagaacagcatgtattgaccctagttctggatctcaacgagactcttgtatactcagattggaagcgtgagagaggatggaggacttttaagaggccaggagtggacgcctttttggaacatcttgggaagttttatgaaattgttgtgtattctgatcagcttagtatgtatgttgatcctgtcgttgataggctggatccgaagggaaatattcggcacaggctatcaagagttgcaactaaatacgaaaatggaaaacattatcgggatttatcgaagctgaacagaaatcctgctcaagttatttatgtcagtgctcatgctttggagtcaagtctgcagcctgaaaattctgtgcaaattaaaccttggaagcttgaaaatgatgacactcaactgcttgatctcattccatttctagaatatgttgctatggcaagacctcctgacatcagggctgttcttgcatcctatcaaggtagtgacattgctgctgagtttattgagcgctctaaggaacaccaaaggcgcatgcaagaacaaaagcattcaggacgcatatggcggcgatgatgactaaatagtctacatacttctatagacacatcaaacttttggcgcttcaatccaaatgaagagaatgaatccatcgtccatggattaatatttgtcaacttttggagatatcacccttgaacatttttaataaatgtttacattttgatgggtgtcttacagagatcaaacgttaccttttcagttttttttttggctagaacctttccagaattcttggccaacgttttgaaagtatctttatggcagattcacttggattagttttagattagtagaagctagtattatctgttcaacaaatctactgcacgcattctatgctggccttctttgactggtgagattgcaaatattcctgtggattgttgcaatcttgtgaaacgtactagctgaactgcg

SEQ ID NO: 33195 - protein, 363 aa, Panicum virgatum
  misc_feature: Ceres CLONE 1949510
  misc_feature (169)..(330): Pfam Name: NIF Pfam Description: NLI interacting factor-like phosphatase
  misc_feature: SWISSPROT Homolog: EC 3.1.3.16 Phosphoprotein phosphatase
MFRVARSRLLPRISALSFCTASPAAAAASSSSTPPVAAAAAAAASASEASSTSGDPSSQQPPVARKPWGTLKVAAFAAVFAAVGATGYASYAYSLEELDQMTREFRKKSKHPIPEDSSGFEKFQAMAYSAAMKAPVAAIELYLDVRSQIEDQIRVSNKCEPVSDKLLPDRPPQEQHVLTLVLDLNETLVYSDWKRERGWRTFKRPGVDAFLEHLGKFYEIVVYSDQLSMYVDPVVDRLDPKGNIRHRLSRVATKYENGKHYRDLSKLNRNPAQVIYVSAHALESSLQPENSVQIKPWKLENDDTQLLDLIPFLEYVAMARPPDIRAVLASYQGSDIAAEFIERSKEHQRRMQEQKHSGRIWRR

SEQ ID NO: 33196 - DNA, 940 bp, Panicum virgatum
  misc_feature: Ceres CLONE 1949514
  misc_feature: Encodes the peptide sequence at SEQ ID NO. 33197
aaaaccgacagccaagcgaggtagctcccagctcccagctccgcggttcccgttccactcggcatggctccgcaggcgtggattgtgggggagaagggcgaggacctccaagggcccaaggagttccttcccctctccaagcttgaagatattggtgtgctttattggcagttggatcctaagaagtctgaaagcgaagaagagcttgcaaaaatccgcaaagaaagaggatacagttacatggaccttattgagatatgtcctgacaaactggaaaactatgaggagaagctgaagaacttcttcactgagcacatgcacgctgacgaagagatccgctactgcttggaaggtagtgggtactttgatgtccgtgacagggatgacaagtggattaggatttggataaaggaaggagacatgatcatcctgcctgctggaatttatcatcggttcaccctggacagcacaaattatgtgaagctcatgaggcttttcatcggggaaccagtctggactgcgctgaacaggcctcaggagggccacccctcaaggcaagagtacgtgaagaatgtgatggggaacaatggatttgctctagcagcacactgaacctgtcgttgctgttcgttctgcaagatacaaacatacgcaaggtatatatggtcagtcagatgcgaaactttgctgtgttgttatggaacatcattctgcactagtttgtacacgtagaagatacacactgcatctgcatcgtgtgggaacgtacgatgtagtattttctcttgtgcctgcttgatacagatacccttggatgtttatgattgcagcagcagcagcagctgccagcaattctgtatatgtatgatgtatcttacctgaccttgtgtgtggtactaatgtctgtcaggcaatggaaatctcatggcatcgaggaccc

SEQ ID NO: 33197 - protein, 182 aa, Panicum virgatum
  misc_feature: Ceres CLONE 1949514
  misc_feature (4)..(153): Pfam Name: ARD Pfam Description: ARD/ARD' family
MAPQAWIVGEKGEDLQGPKEFLPLSKLEDIGVLYWQLDPKKSESEEELAKIRKERGYSYMDLIEICPDKLENYEEKLKNFFTEHMHADEEIRYCLEGSGYFDVRDRDDKWIRIWIKEGDMIILPAGIYHRFTLDSTNYVKLMRLFIGEPVWTALNRPQEGHPSRQEYVKNVMGNNGFALAAH

SEQ ID NO: 33198 - DNA, 460 bp, Panicum virgatum
  misc_feature: Ceres CLONE 1949543
  misc_feature: Encodes the peptide sequence at SEQ ID NO. 33199
actaaacaatctctcatacccacacttgggcgtccttggccgctgcatctctcggtttctcaatggcgccctccgctatgatccgctgcgccgccgccgtcgcgacgctcgccctcctcgacgctggcggcgaggccgcggtgttcgccgcggtgaaccagtgccccttcacggtgtgggcggcctccgcgccggggggcggcgggcgccagctgaaccgcggcgagacgtggcgcatcggcgtgcccgccggcacgacggcggcgcgcatcggggcgcgcacggggtgccaggtcgacgcggccgggcgcgagagctgccacgcgcgggaccgcagccgggtgctgcgctgctgcgtgtaccggcacacgccccccgcgctggcgcagtacacgctgacgcagttcgccatgctctacttcttcatcatctccctcatccacggcttcagcgagcccat

SEQ ID NO: 33199 - protein, 132 aa, Panicum virgatum
  misc_feature: Ceres CLONE 1949543
  misc_feature (32)..(132): Pfam Name: Thaumatin Pfam Description: Thaumatin family
MAPSAMIRCAAAVATLALLDAGGEAAVFAAVNQCPFTVWAASAPGGGGRQLNRGETWRIGVPAGTTAARIGARTGCQVDAAGRESCHARDRSRVLRCCVYRHTPPALAQYTLTQFAMLYFFIISLIHGFSEP

SEQ ID NO: 33200 - DNA, 237 bp, Panicum virgatum
  misc_feature: Ceres CLONE 1949543-R
tttttgccctaaaatagggttatgaggatggcgacaggactgcatactactagcacgaagaaataagaactggccggcttgtgcagcagccgacacagccccgggcttgtagaatccagtgtcctcaactggagaagctaatcaataaggacgtgtgatttctatatcaccataataaagtcattcagaacctttgcttaatttaaacaacggtccttactaataaagttgatttcc

SEQ ID NO: 33201 - DNA, 870 bp, Panicum virgatum
  misc_feature: Ceres CLONE 1949544
  misc_feature: Encodes the peptide sequence at SEQ ID NO. 33202
aaaaccataagcgccccccactgtttcccctatctccatttccaagagcaagacctgaggaagcagccatggcggtgtcgatcgagctcaccaaggagtacgggtacgtcgtgctggtgctggtggcctacgccttcctcaacttctggatgagcttccaggtcggcaaggcccgcaaaaagtacaaggtgttctaccccaccatgtacgccgtcgagtcggagaacaaggacgccaagctcttcaactgcgtgcagagggggcatcagaactcgctggagatgatgcccatgttcttcgtcatgctgctgctcggcggtctgcagcaccagaccatcgccgccggactgggcgccttctacacggtcgcgaggttcttctacttcaagggatacgccaccggcgtcccggagaaccgtctcaagattggggggctcaacttcctggctgtgtttgggctgatcatctgcacggcatctttcggcatcaacctggtcatcagggagacgctctgaagttcaggcttacacgtgatctgcagactgtattaacgggacaaattacttcttgtggcctgggtagtgaaactttgtgaggcagtcatctaggtttgtattagtcgtatactcgcatctttttttttcgtgttgataagcaaagtagcggatgtgtgcgtgtgcatgtgtttcacttttgttaatgccggaataagagatggaggagatggcttgaagcatgaaccttacagttcgtgctgcttgttagttgttactctgttttcgctgtaaaggattgtcgatggattgtgcctcattgtttgctgtaattttttatggaggtaaaatcggctggtaacagctctgcttttac

SEQ ID NO: 33202 - protein, 148 aa, Panicum virgatum
  misc_feature: Ceres CLONE 1949544
  misc_feature (9)..(140): Pfam Name: MAPEG Pfam Description: MAPEG family
  misc_feature: SWISSPROT Homolog: EC 2.5.1.18 Glutathione transferase
MAVSIELTKEYGYVVLVLVAYAFLNFWMSFQVGKARKKYKVFYPTMYAVESENKDAKLFNCVQRGHQNSLEMMPMFFVMLLLGGLQHQTIAAGLGAFYTVARFFYFKGYATGVPENRLKIGGLNFLAVFGLIICTASFGINLVIRETL

SEQ ID NO: 33203 - DNA, 685 bp, Panicum virgatum
  misc_feature: Ceres CLONE 1949551
  misc_feature: Encodes the peptide sequence at SEQ ID NO. 33204
cttctcgatcggattgggttgggggttctgggtaggtgtggtgtgctcgggagttggggcttcttcgttgctttgcttcgctcgtgcgcaagggagagagaagagggaggagaagtaggcggggaggcagatggcatcgaagcggatcctcaaggagctcaaggacctgcagaaggatcctcccacctcctgcagcgcaggcccagtcgcggaagatatgttccactggcaagcgaccataatgggtccatcagatagcccatacttcggcggcgtctttttggtcacaattcacttccctccagactacccattcaaaccgcctaaggtacacagttttgtagtagtggagtacataagaataagattactgcccatttcagtttgaattcgttttcttctgtttatgaccgtcaactcttatgagttaccggacgcccatttccgtaccacaacttgtccatattggtcctagattcccattagaattagtgacaaggaattgtgtgtaccagtttggaactggccccatttatgttctgcttgtgaacaaacactgaaactagccataacacattacagttttgtccacatcaatgctttatctgagaattggttgtttttagtttttactttgtcattctgctctatgctgtcatttagccttgtctaatgtgttgaggga

SEQ ID NO: 33204 - protein, 85 aa, Panicum virgatum
  misc_feature: Ceres CLONE 1949551
  misc_feature (5)..(85): Pfam Name: UQ_con Pfam Description: Ubiquitin-conjugating enzyme
  misc_feature: SWISSPROT Homolog: EC 6.3.2.19 Ubiquitin--protein ligase
  misc_feature: Functional homolog of the protein sequence given in SEQ ID NO 50118
  misc_feature: Useful for biocontainment applications
  misc_feature: Functional homolog of the protein sequence given in SEQ ID NO 50120
  misc_feature: Useful for making plants with modulated light quality sensitivity
  misc_feature: Functional homolog of the protein sequence given in SEQ ID NO 50119
  misc_feature: Useful for making plants with modulated low light sensitivity
MASKRILKELKDLQKDPPTSCSAGPVAEDMFHWQATIMGPSDSPYFGGVFLVTIHFPPDYPFKPPKVHSFVVVEYIRIRLLPISV

SEQ ID NO: 33205 - DNA, 279 bp, Panicum virgatum
  misc_feature: Ceres CLONE 1949551-R
tgacctagcaatttgctcgtgttatgtgcctttgttccagttctaatgtattgcattctgtcgttcgtgcatcgaacaatctctataatggaaggtgaaacattgattgtgttctccccgggtgtgatgcaatttgttgttggcaacttgcttgatggttatgtcactgatgattcacgtgaccgatgcattaggatcttctgctgctggtggcgccggacatggtccgaaattgtcattttcaattccaaattcaatgatttggatttctgctgctgc

SEQ ID NO: 33206 - DNA, 638 bp, Panicum virgatum
  misc_feature: Ceres CLONE 1949559
  misc_feature: Encodes the peptide sequence at SEQ ID NO. 33207
cgatgcgaccgccctcgctgctctccctcaccctcgactcggcgctcctccgcatcgcccacatcgccgacatctcccacctccccgaccacctcgtcatcgacctcttccgtggtgttccgagaggttctaggcctgttggtgcttagatcattttgattaccttacctgagaagatgtcttcggtaattcaagacagtgaggttgacattgtgattgcagcactccagcccaatctgaccaccttctttgaagcatggcggccatttttctctcgtttccacgtcattgttgtcaaagatccagacatgacacagaatcttcaaatccccactggctttgatctcaaggtttacacaaagtcagatattgatggagtgcttggcgccacgtccatcaacttctctggtcactcatgccgttactttgggtatcttgtctcacggaagaagtatgtgatttcaatcgatgacaattgcctcccagcgaaggacactgttgggtccactgttgatgctgttgcacagcacatggccaatatgaagacacctgccacacctttctttttcaacacgctttatgatccataccggaaaggtgctgattttgtccgtggttacccattcagcctgcgtgag

SEQ ID NO: 33207 - protein, 153 aa, Panicum virgatum
  misc_feature: Ceres CLONE 1949559
  misc_feature (1)..(153): Pfam Name: RGP Pfam Description: Reversibly glycosylated polypeptide
MSSVIQDSEVDIVIAALQPNLTTFFEAWRPFFSRFHVIVVKDPDMTQNLQIPTGFDLKVYTKSDIDGVLGATSINFSGHSCRYFGYLVSRKKYVISIDDNCLPAKDTVGSTVDAVAQHMANMKTPATPFFFNTLYDPYRKGADFVRGYPFSLR

SEQ ID NO: 33208 - DNA, 180 bp, Panicum virgatum
  misc_feature: Ceres CLONE 1949559-R
tcttacaaagcataattgtttggaatacttttttttcagttttaatctttgcttgtggaactcatgaagctgaataaacgacgttccagtatgcagggaatttggcagagtaattgaatatttgattgtatacgcttaagaacactaatgtactatcaaaagaacctttcatgttcttac

SEQ ID NO: 33209 - DNA, 679 bp, Panicum virgatum
  misc_feature: Ceres CLONE 1949567
  misc_feature: Encodes the peptide sequence at SEQ ID NO. 33210
acgtctccttctctaccgagcactaaactccattcgaattctagggttttgctgctctcccgagctctgaaggccgcatcaccgcattaggtgcggttcctcgcgtgcgaccgtaatggcgctgccgaaccaggggactgtccattaccccaccttcaagctcgtcatcgatggagatggcggaacgagtaaaaccacattcgtgaagaggcatctcactggagagtttgagaagaaatatgagccaaccattggtgtggaagttcatccgttggatttcactactaactgtggtaagatccgtttctactgctgggatacagctgggcaagagaagtttggtggcctcagggatggatactatatccatggccagtgtgcgatcattatgtttgatgttacctcaaggctgacttacaagaatgttcctacatggcataaggacctgtgcagggtgtgtgagaacatccccatcatcctgtgtggaaacaaggttgatgtgaagaacaggcacgtgaaggccaagcacgtcaccttccacaggaagaagaatctgcagtaatatgaaatatctgctaagagcaactacaactttgagaagccgttccttaaccttgcaatgaagctggctggggattccaacattaacattattgaagccgtatctctaaagcctcct

SEQ ID NO: 33210 - protein, 148 aa, Panicum virgatum
  misc_feature: Ceres CLONE 1949567
  misc_feature (15)..(148): Pfam Name: Ras Pfam Description: Ras family
MALPNQGTVHYPTFKLVIDGDGGTSKTTFVKRHLTGEFEKKYEPTIGVEVHPLDFTTNCGKIRFYCWDTAGQEKFGGLRDGYYIHGQCAIIMFDVTSRLTYKNVPTWHKDLCRVCENIPIILCGNKVDVKNRHVKAKHVTFHRKKNLQ

SEQ ID NO: 33211 - DNA, 149 bp, Panicum virgatum
  misc_feature: Ceres CLONE 1949567-R
atatttgcatcgtgtcaaggacatgggtttatttccgaatgcaggaaatctcgaaagacatgacaacatgaatttcaaggacccttaaaacatttcgatgtaagtttggaataatgaagataagagttaataatgtacagatcagcgtg

SEQ ID NO: 33212 - DNA, 959 bp, Panicum virgatum
  misc_feature: Ceres CLONE 1949571
  misc_feature: Encodes the peptide sequence at SEQ ID NO. 33213
atccctgatttcatttcacagcttgagcaagagatcaagcaaatcaaaaggaagcatggcagcgggcttgcaagtgtttggccagccagcatctactgatgttgccagggttctgacttgcctttttgagaagaaattggaatttgagcttgtccgcattgatacatttaaaacacatcacaagcttcctgaattcattaggctgcgggatccgaatgggcaggtgaccttcaagcatggtgacaaaactctcgttgattcaagagatatatgccggtacgtctgtaaccattttccaaatgatggaaacaagaccctttatggatctggggctctagaacaggcatcaatagaacagtggcttcaggcagaagctcagaactttggccctcccagctctgcactagtctttcagctggcattcgttcctcatctcagccatctaggtgttcgtcaggaccatgctgttattgctgaaaatgaggataagctgaagcagatcctcgatgtttatgatgaaatactctcgaagaatgaatacctggctggcgatgaattcaccttggccgacgtttctcaccttccaaactcgcattatatcgtaaatactgagagaggaaggaagctcttcwctaacaagaagaatgtggcaaagtggtatgacaaaatctcgaagcgtgagacatgggcgcaggttgtcaagatgcagaaggagcatccaggtgcattcgagtgatggcttaatttggcgagcagtgaaggtatcttgaatggcttcattatttgtgtcagtctggcttgtacagtgcagtgttcccatcagtgttttcgtgtcaaccaaaataatgtgaagccctattgtgatgtatgaatcttttgttttgaaacacgtttacctccatgtgtcgactgatctttgattaataaaattgcccgtttggcctacattttgttttgcg

SEQ ID NO: 33213 - protein, 226 aa, Panicum virgatum
  misc_feature: Ceres CLONE 1949571
  misc_feature (110)..(209): Pfam Name: GST_C Pfam Description: Glutathione S-transferase, C-terminal domain
  misc_feature (3)..(78): Pfam Name: GST_N Pfam Description: Glutathione S-transferase, N-terminal domain
  misc_feature: SWISSPROT Homolog: EC 2.5.1.18 Glutathione transferase
  misc_feature (193)..(193): Xaa is any aa, unknown, or other
MAAGLQVFGQPASTDVARVLTCLFEKKLEFELVRIDTFKTHHKLPEFIRLRDPNGQVTFKHGDKTLVDSRDICRYVCNHFPNDGNKTLYGSGALEQASIEQWLQAEAQNFGPPSSALVFQLAFVPHLSHLGVRQDHAVIAENEDKLKQILDVYDEILSKNEYLAGDEFTLADVSHLPNSHYIVNTERGRKLFXNKKNVAKWYDKISKRETWAQVVKMQKEHPGAFE

SEQ ID NO: 33214 - DNA, 1242 bp, Panicum virgatum
  misc_feature: Ceres CLONE 1949581
  misc_feature: Encodes the peptide sequence at SEQ ID NO. 33215
acctaactgaagaacatggtgagggttccaagtgcccatcccttgggcttactagtgaacaagcaaagatgataattggtaagaaagcctttatatgcaagaactgtaagtataagcaacatcagtgttctgcttgtggattattggggtcttcagacttaccatcaggagctgaggtattcaaatgtaaggactatgcctgtggtcatttttaccaccctaagtgtatttctgaactgcgacatcctgatagcaaagtccgggcctcccttttcgaacagcatgttgctgctggactgaaattcctgtgccatgtgcataaatgtagtgtgtgtcatggagaagagaataaggatgataaggatatgcagtttgcagtatgcaggctctgcccaacaacatatcaccggaagtgtttgcccagtgatatcccctttgcagcgaaggaaggccccaatggctacatttttcaaagggcgtgggatggcattcttcgtgatcaaattctgatatactgcatgaagcatgagatcataaaagagctagggattcccaggaggaaacttatcatctttcctgaggccaaaaatttttttgcacccaaagatccagaaagtacaccgaaagaacaagatattttgttcgaacaagagctacttggccacccagcatctgaaccatctcagactccaccgccacctgcaaccgtccagaatcagtgcttccgctccaatcctatggactcatttgcaccaagttccttgtataccgatccatacccagggtcatgtggttgggtcgatgactgaccatcctatcccgccccttgtagatgataccaatagtgacagatccttcgcaatgcgccaagacattggtagcttgggtttgttagatatcagaaaacgcaatttgtagaaagctgatagcctatccgagtccaagtggccggcccccatctacaatgatggtggataaacatgtgttcttgtttatgtgacatggtagacagcccctgcagtatagagtgatgctgtgggttgcatatgacataaaccccatccagagaattttggagattaaagtcaaatgtgattttggatttacctagaaccgacggctctcttattagatgcagattaaccatgaatgggaaaactgctagcatatggagagttattactgaattgtttataatatttcttttcttggattgatagtattcagtaaattgtcattggt

SEQ ID NO: 33215 - protein, 268 aa, Panicum virgatum
  misc_feature: Ceres CLONE 1949581
  misc_feature: SWISSPROT Homolog: EC 2.1.1.43 Histone-lysine N-methyltransferase
LTEEHGEGSKCPSLGLTSEQAKMIIGKKAFICKNCKYKQHQCSACGLLGSSDLPSGAEVFKCKDYACGHFYHPKCISELRHPDSKVRASLFEQHVAAGLKFLCHVHKCSVCHGEENKDDKDMQFAVCRLCPTTYHRKCLPSDIPFAAKEGPNGYIFQRAWDGILRDQILIYCMKHEIIKELGIPRRKLIIFPEAKNFFAPKDPESTPKEQDILFEQELLGHPASEPSQTPPPPATVQNQCFRSNPMDSFAPSSLYTDPYPGSCGWVDD

SEQ ID NO: 33216 - DNA, 1275 bp, Panicum virgatum
  misc_feature: Ceres CLONE 1949601
  misc_feature: Encodes the peptide sequence at SEQ ID NO. 33217
tttatcaagtaaatagggaacacagttttcctattgagaacagagttcagtatcttccattcaagatgctcccccaaggtcacccccatgatgcacaacttcaggaatttcaatattttgtggttattgactttgaagcaacctgtgacaaggtgaacaatccatttccacaagagatcattgagtttccatctgtcttggttaacagtgcaactgggaaactggaagaatgctttcaaacgtacgttcgtccaacatatcatcaatttttgactgacttctgcaaggagcttactggtatacaacagattcaggtggacagaggtgtgccactaggtgaagccttactcatgcatgataagtggctagaggacaagggcattaagaacacaaactttgctattgtcacctggtctaattgggactgccgaacaatgctggagtcagaatgcagatttaagagaatcaggaagcccccttatttcaacaggtggatcaacttgaaggtacctttccatgaagtgtatggggatgtccgttgcaacttaaaggaggcagttcagttggctggccttacatgggagggtcgtgctcactgtggactcgatgatgctcgcaacactgctcgcctcctggcacttatgatgcatcggggcttcaagttctctatcaccaactcacttgtttggcaaccggccccacagtcagcaacctgccttctatcccctgatcgctctccagatcctgtccaaccgcagcttaagccgaatgagatgctgggatctcctgtgcaggttaatccatatgccgcctccgcagggaaggacagagcaatgtactgctactgcggtgtgctgagcaggtggagcgttgtgcgcaagccaggacccatgcagggacgttacttctatggatgcggcaactggaccgccacgaggcgggcgatctgcccatactttgcatgggcatcgtagaggcatactgtgcttccgtccaagcagatctgaagggcaaaggacttggttctttaactaagggaggcgctatgttgcggttgcctcgcctctgctgcgcctcccgatccgtatatattatgatataactttgctcataagacaatggaagttcactaggtagtgtctaacctgtcatgctgacttctgttgatagaagagaatgggctcagatgctgcttaggtgtgatttatccatgaataatctaagtttgtggacactgtttttaacttaatggaactattgtaggtgtggcttgtg

SEQ ID NO: 33217 - protein, 323 aa, Panicum virgatum
  misc_feature: Ceres CLONE 1949601
  misc_feature (39)..(211): Pfam Name: Exonuc_X-T Pfam Description: Exonuclease
  misc_feature (278)..(323): Pfam Name: zf-GRF Pfam Description: GRF zinc finger
  misc_feature: SWISSPROT Homolog: EC 2.7.7.7 DNA-directed DNA polymerase
YQVNREHSFPIENRVQYLPFKMLPQGHPHDAQLQEFQYFVVIDFEATCDKVNNPFPQEIIEFPSVLVNSATGKLEECFQTYVRPTYHQFLTDFCKELTGIQQIQVDRGVPLGEALLMHDKWLEDKGIKNTNFAIVTWSNWDCRTMLESECRFKRIRKPPYFNRWINLKVPFHEVYGDVRCNLKEAVQLAGLTWEGRAHCGLDDARNTARLLALMMHRGFKFSITNSLVWQPAPQSATCLLSPDRSPDPVQPQLKPNEMLGSPVQVNPYAASAGKDRAMYCYCGVLSRWSVVRKPGPMQGRYFYGCGNWTATRRAICPYFAWAS

SEQ ID NO: 33218 - DNA, 835 bp, Panicum virgatum
  misc_feature: Ceres CLONE 1949603
  misc_feature: Encodes the peptide sequence at SEQ ID NO. 33219
acccctcgaaaagccgcggaaaagggcaggaaaaaggagggagggcgggatggacgcgttcatagactcggtgggctccatcttccgcggcggcgacgtccttccctggtgcgaccgcgacatcatcgccggttttgagagggagattgctgaggcagcaaatgaacaacagaaaaatgacagccttatgaggctttcctgggcgctggttcactctagacagcctgaagatgtcaaccggggcatcgggatgcttcaagcttcattggacaggcctagtagcccgctgcaaacaagggagaagctctatttgttggctgttggacactacagaactggggattatacaagaagccggcagcttttggaaagatgcttagagattcaacctgactggaggcaagccctgactttgcaaaggctcgttgaagaaaaaaccagaagagatggtatgattggcatggctatcatcactggcgcctttggacttgtgggacttgttgctggtggtataattgctgctgcctcgtcgtcatcctcatccaggaagaaatgaggatgttttgtgaagttaataagaaatcaagatgggcaaaaacttgatgacaagcagacatcatttttgtgcttcatgtgaagttttttttttgggtactctttacgtgtgacaccagccttctgttcatacgagagagatgtattgttaacatgatagtagtcagtagaggatgaggccctgtgaatcggtgatcgtgttgttccaacatttggactgttgtactctgtcgccgcagaacatgctgtcaccatataataagagaatacagtcatacac

SEQ ID NO: 33219 - protein, 168 aa, Panicum virgatum
  misc_feature: Ceres CLONE 1949603
  misc_feature (83)..(116): Pfam Name: TPR_2 Pfam Description: Tetratricopeptide repeat
MDAFIDSVGSIFRGGDVLPWCDRDIIAGFEREIAEAANEQQKNDSLMRLSWALVHSRQPEDVNRGIGMLQASLDRPSSPLQTREKLYLLAVGHYRTGDYTRSRQLLERCLEIQPDWRQALTLQRLVEEKTRRDGMIGMAIITGAFGLVGLVAGGIIAAASSSSSSRKK

SEQ ID NO: 33220 - DNA, 977 bp, Panicum virgatum
  misc_feature: Ceres CLONE 1949608
  misc_feature: Encodes the peptide sequence at SEQ ID NO. 33221
caggagatcactcacaagcttaaacacttcctcctcattgcttcggccctcttgcagcagctactccgtgcccagtgccaagcagcagcatccggtttgcctggatgtgccaaggttacacagcagcaagaagaagagcatcctgaggtgttcctccagccttgctgatggtccatccaccgttggttcttcagtaagatgggttcttgatcctgcaggttcattgattcccccattcttctagtagctctgcctctacatcgtgtccatctgcaatttagcactagttgcggtcctgaacatccatctcgtatcctttgattacccactctgtcatattattgttcttccccagcgttgtcagtattcaatggatggaattatgctcagatgcactttgcactgtcgatttcaggcgacggcgattggcgccacatcggctacaaagttgcacgccccggcgcgttcgagatagcctccgatgcggtgaccgttggtcgggtcgctgacaaagctgacatcgtcctccccattgccacagtttctggcacgcacgctcggctggagaagaaagacgggaggctgctggtgacggacctgggcagcaccaacggcacctacatcaacgagcgacgcctcaaccctggcttcgcaattcccattgaccccggcagcctactcatctttggtgacatccacctggcgatgtttcgtgtgaggaagatgatagttgaggtgcccagcgagacggataaaacccaacaagaaaccaagaccgaggtagtatcagctgcagttgaagatactacaagctagcaagttctgatgcgttcctagtgccccactagctactagtagaatgttcggaataaaaacctacacggtcatggactcatggtggccgcgttatgacggtttcagcaggaaccaggaattatgaagtaacaaaggcaccaattgtccatagtcagagtttc

SEQ ID NO: 33221 - protein, 141 aa, Panicum virgatum
  misc_feature: Ceres CLONE 1949608
  misc_feature (33)..(100): Pfam Name: FHA Pfam Description: FHA domain
  misc_feature: SWISSPROT Homolog: EC 1.14.13.90 Zeaxanthin epoxidase
MHFALSISGDGDWRHIGYKVARPGAFEIASDAVTVGRVADKADIVLPIATVSGTHARLEKKDGRLLVTDLGSTNGTYINERRLNPGFAIPIDPGSLLIFGDIHLAMFRVRKMIVEVPSETDKTQQETKTEVVSAAVEDTTS

SEQ ID NO: 33222 - DNA, 790 bp, Panicum virgatum
  misc_feature: Ceres CLONE 1949621
  misc_feature: Encodes the peptide sequence at SEQ ID NO. 33223
acttcctccattcgcgcttctcctctctctctctctctctctctctctctctctctctctctctctgtcgatgcccgtctccactccctccgtcagatccctcgcccgggccaccatggcggaccagctcgccgacgaccagatcgcagagctcaaggaggcyttcagmctcttsaamaaggasggmgacggcwgcatcaccaccaaggaactkggaactgkgatgcgctcattggggcagaacccyascgaggctgaactccaggacatgatcaatgaggttgatgcagatggcaacggaaccattgacttccctgagttcctcaacctgatggcacgcaagatgaaggacactgactctgaggaggagctcaaggaggccttccgtgtgtttgacaaggaccagaacggcttcatctccgcggctgagctccgccacgtcatgaccaaccttggcgagaagctgacagatgaggaggtggacgagatgatccgcgaagctgatgtggatggtgatggccagatcaactacgaggagttcgtgaaggtgatgatggccaagtgagatgtgctcttttgaagctagtttctctcctgatggtagtaactagtttagtgttgaaaactgactgcatttggttatcccttattccgatccgtgcgccaatgaacagatatgttgtttgttttcttccctgggatttcactgtatctgtaatttcttttggattcgtttgcgattgtattacatttatgttatctgggtacaatgatcatgccttcccctttg

SEQ ID NO: 33223 - protein, 149 aa, Panicum virgatum
  misc_feature: Ceres CLONE 1949621
  misc_feature (121)..(149): Pfam Name: efhand Pfam Description: EF hand
  misc_feature (85)..(113): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 50110
  misc_feature: Useful for making plants with modulated salt sensitivity
  misc_feature (18)..(18): Xaa is any aa, unknown, or other
  misc_feature (20)..(20): Xaa is any aa, unknown, or other
  misc_feature (21)..(21): Xaa is any aa, unknown, or other
  misc_feature (23)..(23): Xaa is any aa, unknown, or other
  misc_feature (27)..(27): Xaa is any aa, unknown, or other
  misc_feature (36)..(36): Xaa is any aa, unknown, or other
  misc_feature (45)..(45): Xaa is any aa, unknown, or other
MADQLADDQIAELKEAFXLXXKXGDGXITTKELGTXMRSLGQNPXEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 33224 - DNA, 655 bp, Panicum virgatum
  misc_feature: Ceres CLONE 1949640
  misc_feature: Encodes the peptide sequence at SEQ ID NO. 33225
aaggattctaatgaagactgtttctcaattgacctctggaaaacagcctgttggtacaatggcctacatgggcaaagtacaacatctgatgcaatccaaatgtgcagtcaaaacagctgaagattggcttaaccctgctttcatacaagaggcatttgaagctagggctctcaggatggcggtaaactgtgcccagaacataggccaagcggcaaaccaagaaggtttctatgaacggtccccagatttgcttgagtctgcggtagctcacatccagttgatcattgtaaccaagtttatcgagaaggtacagcaggacattcctggacatggggtgaaggaacagctccagaacctctgcaatgtttatgccctctacattcttcacaagcacctgggtgatttcctggcaaccgggtgcatcacacccaagcagggagcgctggcaaacgagcagctgggcaagctctacgcacaggtgcgtccgaatgctgttgcgctggtgggcgcgttcaactacaccgaccactacctgggatcagtgctggggaggtacgacgggaacgtgtaccaggcactgtacgaggaggcgtggaaagaccctctgaacgagacggtggtgccggaggggtaccacgagtacctccgccccttg

SEQ ID NO: 33225 - protein, 217 aa, Panicum virgatum
  misc_feature: Ceres CLONE 1949640
  misc_feature (41)..(217): Pfam Name: ACOX Pfam Description: Acyl-CoA oxidase
  misc_feature: SWISSPROT Homolog: EC 1.3.3.6 Acyl-CoA oxidase
RILMKTVSQLTSGKQPVGTMAYMGKVQHLMQSKCAVKTAEDWLNPAFIQEAFEARALRMAVNCAQNIGQAANQEGFYERSPDLLESAVAHIQLIIVTKFIEKVQQDIPGHGVKEQLQNLCNVYALYILHKHLGDFLATGCITPKQGALANEQLGKLYAQVRPNAVALVGAFNYTDHYLGSVLGRYDGNVYQALYEEAWKDPLNETVVPEGYHEYLRP

SEQ ID NO: 33226 - DNA, 257 bp, Panicum virgatum
  misc_feature: Ceres CLONE 1949640-R
cagaatcatatcagaggtgtttgttgacagccaaatttggcacctgccgaggccgaccggtttgattggtcgacccgcccggttagaccggtctggtctgtacagtccgagtagaaataggttttttataaagggtcctcatgtaattttactcgtgaaggggtacgtcctccccggcctataaatataaaggctaaggccgattgagggatatacccaatcgaatcaatacaaaaatcgcattattttttatctct

SEQ ID NO: 33227 - DNA, 737 bp, Panicum virgatum
  misc_feature: Ceres CLONE 1949644
  misc_feature: Encodes the peptide sequence at SEQ ID NO. 33228
tcgtctccttgtcgtctctgtttcttcccacgttcctctctctctctctctctctctctcgcggccacccctttcctgccggcgacgaccgccgccacgtctacgccgggccctttgccggcgacgagccccgaaaagatcgactcttttatgagtccacaaggcacccaggatgaagtttttagaatacacccccttcgacagcataaatctgttcctcgaccaactcaacctcggcgattgtgcaatcagaggaaaccttgaagccttctcatgcaagcacactgcgacagaccgccggctttcaattagcctagaacatgagattcttgattacttaggaaagtcctctgacagtgacccttcttcaccagtggagcacctatcctccagatcaagccggaagacattgatatatctagttcttactcttgggcacatgtatccagattatgatttcagtgctgttcgggcacacttgttcttccaagaagaggagatggaaagtttcaagcagatgatagacacctacttatctgatgcttctaggcaatgggcagcaacaaatgagggcagttctcttctggacagtatgactaaagctattgatgaggttatcaaaatcagagagtgtgacatctacagctataacccagactctgatggagatccagttcaagagaaaggggccatatggtcattctactactttctctacaataggaagctaaagcgag

SEQ ID NO: 33228 - protein, 188 aa, Panicum virgatum
  misc_feature: Ceres CLONE 1949644
  misc_feature (25)..(188): Pfam Name: Maf1 Pfam Description: Maf1 regulator
MKFLEYTPFDSINLFLDQLNLGDCAIRGNLEAFSCKHTATDRRLSISLEHEILDYLGKSSDSDPSSPVEHLSSRSSRKTLIYLVLTLGHMYPDYDFSAVRAHLFFQEEEMESFKQMIDTYLSDASRQWAATNEGSSLLDSMTKAIDEVIKIRECDIYSYNPDSDGDPVQEKGAIWSFYYFLYNRKLKR

SEQ ID NO: 33229 - DNA, 322 bp, Panicum virgatum
  misc_feature: Ceres CLONE 1949644-R
cctttataaccaggaacataggccggccggcgttttgttcagacccggttgggtgtggttaatatatagcgtatatgccctattcccgttaggaagcttttaatataacttcccttttatcgtagcctgcggaagctatggctcttgttagcgttgtatatgcggattggagatttggtagcggcaaacttttaatccctgaggtttgaactgtcacgctatgttcgtactttagtgcttgctggaactgaatcctatgtcctgcttagttaaagaataaaatatttcagacaattgtgtaatcaaatttgctctactgttc

SEQ ID NO: 33230 - DNA, 1097 bp, Panicum virgatum
  misc_feature: Ceres CLONE 1949660
  misc_feature: Encodes the peptide sequence at SEQ ID NO. 33231
tctctctctctctctctcgtgtgccgcccccttccagttgtattcctttttcctttctggagcagttccctttctggagctgctccgggcgtgctctcacttcttcattttcctctcggccacccttggaattggaagacgacctcacgcggggcttcgaatattccttgtcttctcggctcggttaggcaccaacaccgcccttcggctccagtacgcgtcctcctctcctcccatctcaagaaatcgccgttgcagcaagtgaagctggaggaagcggaggggctcgcgatggggtccgagggaccgtcggctccggtcgtcgttcccagaaacttcaggctgctagaagaactagaacgtggtgagaagggcattggtgatgggacagtgagctacgggatggatgatgctgatgacatttatatgcggtcctggacaggaactatcattggccctcccaatactgttcacgagggacgaatctatcaattaaagcttttctgtgatacagattatccagataaaccaccaactgttcgatttcagactcgaatcaatatgacatgtgtgaacaaagaaactggattggttgaaccaagtctatttcctatgcttggaaactggcaaagggaacatacaatggaggacatcctaaccagcttaaaaagggagatgtcgactcctcagaatcgcaggctgcaccagcctcaagaaggtaatgaagaccaaagagtagagcagaaagggctgcctcatagatgtgtcatcatgtaacagatgtgcattgcaatgtacagcttgagttgagtagcatgactgcatgggatgcagaagtgaggaaccttctcaggaaatcgtgtaatttgtccaaactgcgcaagagttgcaataaagtatcgaggactctgttgatttgcctgcgcaccatgtaacatgttaccccattcaggttcagtgaaggacaatgagcttcacatcgctcattctgcctgtttgtaaacactctgtagtatgtaccgtcgggttatctgtctaggcctgttgttttatacaggaacagcgtattgataaatatcacagcctgattggttgtc

SEQ ID NO: 33231 - protein, 161 aa, Panicum virgatum
  misc_feature: Ceres CLONE 1949660
  misc_feature (17)..(159): Pfam Name: UQ_con Pfam Description: Ubiquitin-conjugating enzyme
  misc_feature: SWISSPROT Homolog: EC 6.3.2.19 Ubiquitin--protein ligase
MGSEGPSAPVVVPRNFRLLEELERGEKGIGDGTVSYGMDDADDIYMRSWTGTIIGPPNTVHEGRIYQLKLFCDTDYPDKPPTVRFQTRINMTCVNKETGLVEPSLFPMLGNWQREHTMEDILTSLKREMSTPQNRRLHQPQEGNEDQRVEQKGLPHRCVIM

SEQ ID NO: 33232 - DNA, 582 bp, Panicum virgatum
  misc_feature: Ceres CLONE 1949707-R
  misc_feature: Encodes the peptide sequence at SEQ ID NO. 33233
gacaataggattggtggcggtaatatatttccacattgcttgatactacattcttttgcttactttcatggtcaattatatccttacataatcattgcagaagctaatagcactgcacagaattttgttgacttcacagaagcagaggaagatcttgtttccagaatgcacaggcttgtggggaacagatgggagcttatagcaggaagaattccaggaaggacagcagaagaagtagagatgttttggtccaaaaaacaccaggaaaaatgaaaacggggccattactttatattgatctataaactatgtattaatatcacttgaaaatgtgcttataaataatgttaaccatgcaaagatgaaaaaagccatatagtattatgagctcactcgaggagcgatgtggattggcacttccaagttaagttagcagtgttatctgtgttcattttgtaattgcatcttgttataacatgatgtcaattttacaatagcaaagtattaaaaaacaccagaaaatgcgcattatgtgtacagtataatatgctacagataaagagatgagtacagctggctctt

SEQ ID NO: 33233 - protein, 90 aa, Panicum virgatum
  misc_feature: Ceres CLONE 1949707-R
  misc_feature (42)..(87): Pfam Name: Myb_DNA-binding Pfam Description: Myb-like DNA-binding domain
  misc_feature: The sequence is a functional homolog of SEQ ID NO 1090 in the 10/374,780 US patent application
  misc_feature: The sequence is a functional homolog of SEQ ID NO 1089 in the 10/374,780 US patent application
  misc_feature: The sequence is a functional homolog of SEQ ID NO 2147 in the 10/666,642 US patent application
  misc_feature: The sequence is a functional homolog of SEQ ID NO 2157 in the 10/666,642 US patent application
  misc_feature: The sequence is a functional homolog of SEQ ID NO 360 in the 11/435,388 US patent application
  misc_feature: The sequence is a functional homolog of SEQ ID NO 362 in the 10/714,887 US patent application
  misc_feature: The sequence is a functional homolog of SEQ ID NO 370 in the 11/435,388 US patent application
  misc_feature: The sequence is a functional homolog of SEQ ID NO 372 in the 10/714,887 US patent application
  misc_feature: The sequence is a functional homolog of SEQ ID NO 1071 in the 11/479,226 US patent application
  misc_feature: The sequence is a functional homolog of SEQ ID NO 1408 in the 10/666,642 US patent application
  misc_feature: The sequence is a functional homolog of SEQ ID NO 148 in the 10/374,780 US patent application
  misc_feature: The sequence is a functional homolog of SEQ ID NO 1808 in the 10/412,699 US patent application
  misc_feature: The sequence is a functional homolog of SEQ ID NO 234 in the 10/714,887 US patent application
  misc_feature: The sequence is a functional homolog of SEQ ID NO 234 in the 11/435,388 US patent application
  misc_feature: The sequence is a functional homolog of SEQ ID NO 286 in the 10/714,887 US patent application
  misc_feature: The sequence is a functional homolog of SEQ ID NO 42 in the 10/225,068 US patent application
  misc_feature: The sequence is a functional homolog of SEQ ID NO 468 in the 10/412,699 US patent application
  misc_feature: The sequence is a functional homolog of SEQ ID NO 758 in the 10/225,066 US patent application
  misc_feature: The sequence is a functional homolog of SEQ ID NO 1085 in the 10/374,780 US patent application
  misc_feature: The sequence is a functional homolog of SEQ ID NO 1086 in the 10/374,780 US patent application
  misc_feature: The sequence is a functional homolog of SEQ ID NO 2161 in the 10/666,642 US patent application
  misc_feature: The sequence is a functional homolog of SEQ ID NO 2163 in the 10/666,642 US patent application
  misc_feature: The sequence is a functional homolog of SEQ ID NO 374 in the 11/435,388 US patent application
  misc_feature: The sequence is a functional homolog of SEQ ID NO 376 in the 10/714,887 US patent application
  misc_feature: The sequence is a functional homolog of SEQ ID NO 376 in the 11/435,388 US patent application
  misc_feature: The sequence is a functional homolog of SEQ ID NO 378 in the 10/714,887 US patent application
DNRIGGGNIFPHCLILHSFAYFHGQLYPYIIIAEANSTAQNFVDFTEAEEDLVSRMHRLVGNRWELIAGRIPGRTAEEVEMFWSKKHQEK

SEQ ID NO: 33234 - DNA, 692 bp, Panicum virgatum
  misc_feature: Ceres CLONE 1949707
gtttatcctggccaaggattcacagatacagaggccattataggggttgaagccagctcaaaatagcctcaccgttccaggtgacaactggctcctctaatggatagcagcagaagcagcagccgggacaagaagtccaaagataacgatcgtcatgaagcaaaaggttcaccattgttgcttccctcacctggttttgctttacctttgctctctgcctcttctaaagtctgaattgcattttattgctgtcattatgtttaacaaaatggcttacatgatttaggcctcgtttagatacttaaacttttgtgtgtaaagtactatagcactttcgtttgtatttgataattattatcccgtcataggttaattaggctcaaaaaatttgtctcgcaaattatagacaaactgtgtaattagttattttgtttagctacatttaatactttctgcatgcgttgaaacattcgatgtgatgagaaatcttgtaaagttttggaattttgaaagcaactaaacatggccttagctattttaggagatctttcaccaagatatcctaaagcttcatgctttatttccacgtaaaagaaaaaaacagaaattagaaggtgcacagtaaccactataactgcaaaaatttgagatgacaaacaaaagaataggctattttactatcagaccaacct

SEQ ID NO: 33235 - DNA, 977 bp, Panicum virgatum
  misc_feature: Ceres CLONE 1949720
  misc_feature: Encodes the peptide sequence at SEQ ID NO. 33236
aatctctcatctcgtctcctgccgttcgcagtcagagcgcgccgccccctctcgcgtgcctcggcgatccctccaccccgcttccaagctgcagatctttgttaagaccttgactgggaagaccatcaccctcgaggtggagtcttctgacaccattgacaatgtcaaggccaagatccaggacaaggagggcatccccccggaccagcagcgtctcatcttcgctggaaaacagctcgaggacgggcgcacgcttgctgactacaacatccagaaggagagcaccctccacctggtgctccgcctaaggggaggcatgcagatcttcgtgaagaccttgactggcaagactatcacccttgaggtggagtcttccgacaccattgacaatgtcaaggcaaagatccaggacaaggaaggcatccccccggaccagcagaggctcatcttcgccggcaagcagctcgaggacgggcgcacacttgctgactacaacatccagaaggagagcaccctccacctggtgctccgcctgagaggaggcatgcagatcttcgtgaagaccttgactgggaagacaatcactctggaggttgagagctccgacaccatcgacaacgtcaaggccaagatccaggacaaggagggcatccccccggaccagcagcgtctswtytttgcsggcaagcagctsgaggatggccgcacccttgctgactacaatatccagaaggagtccaccctccacctggtgcttcgtctccgtggtggccagtaagccatcggttggttgttgaagctgctgctgttcctggaagcaggtcgctgctgtgaagggtgtcgtctttgaagtgtctgtggtgtttgtgtcgaaattgtatctggtttcatgaactggattgggtctgtgtttacccaaaacagttgcactgcagcagtatggggcatatgcatgaataagttatgtttgaacttag

SEQ ID NO: 33236 - protein, 258 aa, Panicum virgatum
  misc_feature: Ceres CLONE 1949720
  misc_feature (35)..(103): Pfam Name: ubiquitin Pfam Description: Ubiquitin family
  misc_feature (111)..(179): Pfam Name: ubiquitin Pfam Description: Ubiquitin family
  misc_feature (187)..(255): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
  misc_feature (225)..(225): Xaa is any aa, unknown, or other
ISHLVSCRSQSERAAPSRVPRRSLHPASKLQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLXFAGKQLEDGRTLADYNIQKESTLHLVLRLRGGQ

SEQ ID NO: 33237 - DNA, 988 bp, Panicum virgatum
  misc_feature: Ceres CLONE 1949725
  misc_feature: Encodes the peptide sequence at SEQ ID NO. 33238
acgcaaagccaaacgagccgacaaggaagccgaatatctccaccggcctcggcctgcctcctcttccgcacgtagcaggttggtggtgataaggaaagcggaaaacgcacaccatgggatccaaagaacctctctttctcttgctcctctcgctgcttgtcgtctcggtgcttgcacaagccagggatgctgataacggcccagtctacaaggaacaaatctcttcaaccaagattcctgtccatcgcaagagtagtagcccaatatgctcagcctgcggaaacttcacgactcaagctctcagttatctcagtgagaagcaaacacaagataagatcagggaattccttcatgatgcttgttgtcagtcattctccttggaacggaagtgtgtagagttgatggactcttatgcaactatactgttttccaagattacggatatcaatccaaaagagttttgcaaacagtatggcctgtgcagggacatagcccttttctctggtgtgacaagtgacagcacttgtgtgttttgccatcacctgcttgatgaaattgtgtccaaactgaaagatccagacgcagagtttgagatcattcaaattctcattaaggagtgcaataagattgaaggtcatgcccagcagtgcaagagactggtcctgcaatacattcctctcatcctggtgaatggtgagaagtttctcgagaagaacgatgtgtgcgcgcttttacaagcgtgtccggccagcaaagtcttggaaggggtgttgctcagtgatgcttgaaggttgaaagaacgcgcgaagtatgtagcaatggtgcaaatagtgtgtacaaactagggcgagttgtacataataaggtcatgaatggatgaaggatgggtgtctcgtgtttctgcattcttttcatcttgtatcgtgaacacattgtattaagtaaactttcatatacatccagaaagtgcagatcgtgcagcattagt

SEQ ID NO: 33238 - protein, 224 aa, Panicum virgatum
  misc_feature: Ceres CLONE 1949725
  misc_feature (49)..(88): Pfam Name: SapB_1 Pfam Description: Saposin-like type B, region 1
  misc_feature (135)..(173): Pfam Name: SapB_1 Pfam Description: Saposin-like type B, region 1
  misc_feature (176)..(210): Pfam Name: SapB_2 Pfam Description: Saposin-like type B, region 2
MGSKEPLFLLLLSLLVVSVLAQARDADNGPVYKEQISSTKIPVHRKSSSPICSACGNFTTQALSYLSEKQTQDKIREFLHDACCQSFSLERKCVELMDSYATILFSKITDINPKEFCKQYGLCRDIALFSGVTSDSTCVFCHHLLDEIVSKLKDPDAEFEIIQILIKECNKIEGHAQQCKRLVLQYIPLILVNGEKFLEKNDVCALLQACPASKVLEGVLLSDA

SEQ ID NO: 33239 - DNA, 735 bp, Panicum virgatum
  misc_feature: Ceres CLONE 1949738
  misc_feature: Encodes the peptide sequence at SEQ ID NO. 33240
agggcgcacctttgccaggtcctttcctagcctcagggcggggctcatctcctcccttgtttcttaaaccatttcccttctctcggaatctctcctcccttgcgcttccttccctggcgacgacgactgggcgagcggcggcgcccagccctttgccggcgaggagcatccaccaggaaccccaataagtttactgcttccatcaagtgaggacctgcctgtctccgagaacttaattgctcctgatcttccgtggcacaagcatcatccgaaaaaatgccatcagtttatctttacatccctaatattattgggtatttcaggatcatcataaatttcaaagcttttgctatttgctattccaacaaggccctctttgctatcctttacttcatcagttttgtccttgatggcgtggatggttggtttgctcggaagtttaatcaagcatcaacatttggagctgtgttggacatggttacagatagggttagcactgcttgcttgttggcccttctctcccaattttacaggcctggcttagtcttcttgatactgcttgggttggatatcacaagccactggtttcaaatgtacagttctttcttgtcaggtaagactagccacaaagatgtaaagcacacaggcaattggcttctgaaattatattacgggcacaggccgttcatggccttctggtgtgtttcttgcgaggttttgtatattatcctcttc

SEQ ID NO: 33240 - protein, 152 aa, Panicum virgatum
  misc_feature: Ceres CLONE 1949738
  misc_feature (35)..(152): Pfam Name: CDP-OH_P_transf Pfam Description: CDP-alcohol phosphatidyltransferase
  misc_feature: SWISSPROT Homolog: EC 2.7.8.11 CDP-diacylglycerol--inositol 3-phosphatidyltransferase
  misc_feature: Functional homolog of the protein sequence given in SEQ ID NO 50637
  misc_feature: Useful for biocontainment applications
MPSVYLYIPNIIGYFRIIINFKAFAICYSNKALFAILYFISFVLDGVDGWFARKFNQASTFGAVLDMVTDRVSTACLLALLSQFYRPGLVFLILLGLDITSHWFQMYSSFLSGKTSHKDVKHTGNWLLKLYYGHRPFMAFWCVSCEVLYIIL

SEQ ID NO: 33241 - DNA, 553 bp, Panicum virgatum
  misc_feature: Ceres CLONE 1949738-R
gttttgttcagtttgtattgatattatccaaggaaaattcccgtgaggcttgtacaccatgattcatacatacagtggctacttcttgtgtgccttgacatctttctgactatgcttatctgttgggaagagacggcaacttgctgtgggaagaacataaagaaaacagaggagacaaacgatttacggagaaagtataggctgttaagttgtttgtcagtgtttgttcactatatagttggatgcagagcatgaccttttgttagctggagtggccttttgagtcgatctgaacgatgtttacaagctgcatttttcagagtccaagaatatatgaagtttttgaattgcaaaatttattcttccctgagagggttaaatagttgcctttagcgtgcactatcaaataggcatctgacttttttgttatcttaccttgtattccttacaattatctgatttttctggttatcttgccttgtgtgccttacaattatctatcggataatttgtttttttatgtgatcttgaatcttaagttcattctaaaggc

SEQ ID NO: 33242 - DNA, 1344 bp, Panicum virgatum
  misc_feature: Ceres CLONE 1949744
  misc_feature: Encodes the peptide sequence at SEQ ID NO. 33243
cgtgctattcgacgtgctcgtgttgggctgaagaatccaaaccgtcctattgctagcttcatattctctggacctactggagttggcaaatcagaattagcaaaggcgctggcagcctactactttggctcagaggaggctatgatcaggcttgacatgagtgagttcatggagagacatactgtctccaaactcattggatcacctccaggttatgttggctacactgagggaggtcaattgactgaagcagttcgtcgccgtccatacactgttgttctctttgatgagattgaaaaggcacatccagatgttttcaacatgatgcttcagatcttagaagatgggaggctaactgacagcaaggggcgcacagttgactttaagaacacactattgatcatgacatcgaatgttgggagcagtgtaattgagaagggaggccgcaagatcgggttcgaccttgactatgatgagaaagacactagctacaacaggatcaagagcctggtgaccgaggagttgaagcagtatttccgtccagaattcctaaacagattggatgagatgattgtgttccggcagctgacgaagttagaggtgaaggagattgcggacattatgctgaaagaagtgtttgacaggctgaaggctaaggacattgacctccaggttacagagaagttccgtgatagagttgttgacaaaggttacaacccaagttatggtgcccggcctttgcggcgcgctatcatgaggcttctggaggatagtctggctgagaagatgcttgctggtgaggtgaaagaaggtgactctgccattgtcgatgtggattctgatggcaaggttatagtcctgagtggcggtaatggtgttgctgagcccctggaacctgctctcagtacctactgaggtcgaaaactctttggtccgaaatatggccttctttacaagacagttgggttcctcatgatggcaaaactagattgacatcgctcgcccgcccactgcagactcttcagctttccttggtatttaaattccattggaagtgaggcagtaggaatgctatggaaaggaatcggcagagacgcagcgagaacactgtatgcttagaccttgagttgcgttgtttttgaaaaaaaaacttgggacttttcagtttcctgcaattacatgtatcattacttcattagggctctgcaagcatgatgacatggttatcgcttgcactgttgtacttattctcccagttgtgtatgaatgtaacttattcaagtcacagataacattggtagataatgatatgctgttatggcgcctgagaactcaggttgtttc

SEQ ID NO: 33243 - protein, 304 aa, Panicum virgatum
  misc_feature: Ceres CLONE 1949744
  misc_feature (15)..(190): Pfam Name: AAA_2 Pfam Description: ATPase family associated with various cellular activities (AAA)
RAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKAKDIDLQVTEKFRDRVVDKGYNPSYGARPLRRAIMRLLEDSLAEKMLAGEVKEGDSAIVDVDSDGKVIVLSGGNGVAEPLEPALSTY

SEQ ID NO: 33244 - DNA, 793 bp, Panicum virgatum
  misc_feature: Ceres CLONE 1949746
  misc_feature: Encodes the peptide sequence at SEQ ID NO. 33245
aagactgctctccccttcggcccttccccttccccttcccctggtccgtctccgcccagatccagatccagatccagggttcaatcaccacaccaggataagcaaccgagacaatggcggcagactctggagctcgtaggcagccaaccttcaccaaggttgaccagctgcgcccggggacccacggccacaacctcatcgtcaaggtagttgactccaagatggttgtccagaggggccgcgagggagggcagcagggcaggcagatgaggatcgccgagtgcttggtcggcgatgaaaccggcatcatcgtcttcaccgcaagaaacgaccaagtggatgtaatgaagcttggaacaactgttgaactgaggaatgcaaagattgacatgttcaagggttcgatgcggctcgcggtggacaagtggggaattgtgaaagctgctgaaagcccagttgagtttgcagtcaaggaggacaacaacctgtccttgattgagtttgagctggtgaccgtggtggagtgaagaccaccttttgtaggagggtggtgcgttatgttatgttgttgaacctatttggcaccaccaaagaaaataaaccagtcatggtttgatgttatcgtatgcatccgaggttggttatggttagtgatcgtcggcaatggacggcatctctctgagattgtagtggggtagcccatcctcattggacctgtcataatgcgttgagctgcctattgctgtaccatgacttggcgttgagctgcatattgccgtatcatgagttgccg

SEQ ID NO: 33245 - protein, 137 aa, Panicum virgatum
  misc_feature: Ceres CLONE 1949746
  misc_feature: Functional homolog of the protein sequence given in SEQ ID NO 50161
  misc_feature: Useful for making plants with modulated drought sensitivity
  misc_feature: Useful for making plants with modulated water use efficiency
MAADSGARRQPTFTKVDQLRPGTHGHNLIVKVVDSKMVVQRGREGGQQGRQMRIAECLVGDETGIIVFTARNDQVDVMKLGTTVELRNAKIDMFKGSMRLAVDKWGIVKAAESPVEFAVKEDNNLSLIEFELVTVVE

SEQ ID NO: 33246 - DNA, 1200 bp, Panicum virgatum
  misc_feature: Ceres CLONE 1949756
  misc_feature: Encodes the peptide sequence at SEQ ID NO. 33247
acatctctcgacctaccggccgcggcagccaaaccctagcctcgacccgcccttccggccaccgcgtcttcagcggggaaggatgagcaggcgctggagccgcacgatctacgtcgggaacctcccgggcgacatccgggagagggaggtggaggatctcttctacaagtatgggagaattgttgacattgacttgaaggtccccccgaggccacctggttatgcttttgttgagtttgaagatcctcgtgatgctgaagatgcaattgctgggcgtgatggatacaattttgatggacaccgcctaagagtggagcccgctcatggtggtagaagtaatgcttcctcatatgaccgttcaggtggctttggtggtggagcccgacgtggtgtgtcaaggcgctcagagtatcgtgttcttgtcactggactgccttcttctgcatcatggcaggatttgaaggatcatatgcggaaggctggtgatgtttgtttctctgaagtgtaccgtgaaggcggtggcaccattggaattgtggactacacaaactatgatgacatgaaatatgctataaagaagctggatgatactgaattcaggaatgcctttgggcgagcttatataagggtgaaggaatatgatggcaagcgtcgacgctcctactcacgtagccgaagcccaagtcgtagctacagcagaagcaggagcccgagcaaatcgccccgggctcgccgctcagcatctagatcccgttcaaggtctgtttcttcccgttcaaggtctgcatcaaaagggcgttctccgtcaagatcaccagcaagatctaaatctcctaatgcttctccagcaaatggtgaagcagcaagccccaagaagcagagcccaagcagaagcccatctggctcacgctctcctgatgccaaacctgaataaaactggtgccaccgatgaggcattgcagatgggagtccagagctcgtctttgtctggtcacgtgatgtcctccatattgttctagtaccatcgctgtcctagcaactgcgcaatgagattggatattaactatcagtttgtatcgttggacccccgactttgttatgttttctggcccgctgaagggctcatttttacttcaactttttgagattgttgaatgctatgtggctctggattatgttcactgaatcatgttgttccgg

SEQ ID NO: 33247 - protein, 283 aa, Panicum virgatum
  misc_feature: Ceres CLONE 1949756
  misc_feature (9)..(77): Pfam Name: RRM_1 Pfam Description: RNA recognition motif. (a.k.a. RRM, RBD, or RNP domain)
  misc_feature (112)..(179): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 51213
  misc_feature: Useful for making plants with altered alkaloid content
  misc_feature: Useful for making plants with altered lignin content
MSRRWSRTIYVGNLPGDIREREVEDLFYKYGRIVDIDLKVPPRPPGYAFVEFEDPRDAEDAIAGRDGYNFDGHRLRVEPAHGGRSNASSYDRSGGFGGGARRGVSRRSEYRVLVTGLPSSASWQDLKDHMRKAGDVCFSEVYREGGGTIGIVDYTNYDDMKYAIKKLDDTEFRNAFGRAYIRVKEYDGKRRRSYSRSRSPSRSYSRSRSPSKSPRARRSASRSRSRSVSSRSRSASKGRSPSRSPARSKSPNASPANGEAASPKKQSPSRSPSGSRSPDAKPE

SEQ ID NO: 33248 - DNA, 655 bp, Panicum virgatum
  misc_feature: Ceres CLONE 1949763
  misc_feature: Encodes the peptide sequence at SEQ ID NO. 33249
gttcgctaaaaggatttcctagtgattccaaagaagcttcaaagctgaatctcgtgtgccgcaagaacctggtaattgataagagcattcacactgcatatgtccgggcaatcagatctgcacagcatttcatttatatcgagaatcaatactttcttggttcttcatatgcttggccatcctatgtgaattcaggtgctgacaatctgataccaatagaattagccctcaaaattgcaagtaagattagagcaggagaacgctttgcagtgtacgtagtgataccaatgtggcctgaaggagtccctactgcagcatctgtgcaagaaatccttttcttccaggcccggacaatggagatgatgtataaaataattgcagatgaacttaaggcaatggacattaaggatttgcaccctcaagattacttgaacttcttttgtcttggaaatcgggaagaaccaacatcaaatggcattctggagtcagagaaatcttcagataaaagtgcagcggccttagctacaaaatatcggcggttcatgatctatgttcatgcaaaagggatgattgtggatgatgaatacgtcattctgggttcggcaaacatcaaccagagatccctggcaggttctagagatactgaaattgcaat

SEQ ID NO: 33249 - protein, 217 aa, Panicum virgatum
  misc_feature: Ceres CLONE 1949763
  misc_feature (180)..(207): Pfam Name: PLDc Pfam Description: Phospholipase D Active site motif
  misc_feature: SWISSPROT Homolog: EC 3.1.4.4 Phospholipase D
SLKGFPSDSKEASKLNLVCRKNLVIDKSIHTAYVRAIRSAQHFIYIENQYFLGSSYAWPSYVNSGADNLIPIELALKIASKIRAGERFAVYVVIPMWPEGVPTAASVQEILFFQARTMEMMYKIIADELKAMDIKDLHPQDYLNFFCLGNREEPTSNGILESEKSSDKSAAALATKYRRFMIYVHAKGMIVDDEYVILGSANINQRSLAGSRDTEIA

SEQ ID NO: 33250 - DNA, 214 bp, Panicum virgatum
  misc_feature: Ceres CLONE 1949763-R
tacctgtgaactttgtgactgtctaaacttggcgggattgtcgcaaaatttgtatcatacctgtaatcatccatagttggcgcagggaaagcccaagttgttaatggtgtttgtagagttgttcctctgcgagttctcccagcgtctgtaaatgaaccctaataggatccttgacggtgattccacttccattacgattgtaccacccgtttcg

SEQ ID NO: 33251 - DNA, 1147 bp, Panicum virgatum
  misc_feature: Ceres CLONE 1949771
  misc_feature: Encodes the peptide sequence at SEQ ID NO. 33252
aggtagctgtccctctatccatcccctttacttcgtctcccaactcaaccattctccctgtgtcatcaccagcaacaggaagatgggctcgttagatgccacacgagcggaactcggcctcgttgttctgtacctgaacaaagccgaggctagggacaagatctgcagggcgattcagtatggctcaaagttcataagcaacgggcagcccggcaccgcgcaggatgtcgatagatcgaccaccttggctcgaaaagttttccgtctcctcaagtgggtcaatgatcttcatgctcttatcagcccgcctgctaaagggactcctctcacacttgtccttcttggcaagtccaaaaacgcgctgctttcgacgttcttattcctggatcaatttgtgtggttaggacgaacaggaataatcaagaacaaggaggcgacggaccgggttgccaggatatccctctactgttggatggcttcttctgcctgcgctagtctagtggagcttggagagcttaagaggctatcgaaatcgatgaggaagcttgcaagagagctgaggcacactgataaatacgagaacgaacagtaccagaacaaaatgaagcagtcggatgagcggctcctggccctggtgaaggcggccatggacgtggtcgtggccatcgggcttcttcagctggcacccaagaaggtcacccccagagtgacgggagctctcggattcgtcacctcgctcatctcctgctatcagcaactcccttcccgtggccccgtggccaaagtcaaggcgtgagatgggtccgggtcctccctactatggaagtagccgtcgctggaaattgaggtagctatacttgagcatgcatggaccacgtggctcctacatctgcgctggctttcttcaaataaaaaacatctgcgctggccatggctgctccgatccgagcaggggttttgattcatttcatgcagaataacggagctcacatgtaccagggcgttgtacgttgtcaaatcatcgatcaaacatggcgtctgatatctgaagtagtacatgcgagagccaacattcgcaaaaggaaaaaaattgctactattttacagctccatatataaatctaacacgaacacctgcacagctctg

SEQ ID NO: 33252 - protein, 237 aa, Panicum virgatum
  misc_feature: Ceres CLONE 1949771
  misc_feature (11)..(226): Pfam Name: PEX11 Pfam Description: Peroxisomal biogenesis factor 11 (PEX11)
MGSLDATRAELGLVVLYLNKAEARDKICRAIQYGSKFISNGQPGTAQDVDRSTTLARKVFRLLKWVNDLHALISPPAKGTPLTLVLLGKSKNALLSTFLFLDQFVWLGRTGIIKNKEATDRVARISLYCWMASSACASLVELGELKRLSKSMRKLARELRHTDKYENEQYQNKMKQSDERLLALVKAAMDVVVAIGLLQLAPKKVTPRVTGALGFVTSLISCYQQLPSRGPVAKVKA

SEQ ID NO: 33253 - DNA, 1295 bp, Panicum virgatum
  misc_feature: Ceres CLONE 1949792
  misc_feature: Encodes the peptide sequence at SEQ ID NO. 33254
tgaagttaggcaactgaaggttatggccaatgcggatactcctgaggatgcactggcagcaagaaacaatggggcgcaaggaattggactatgccggacagagcacatgttcttcgcttcggatgagaggatcaaggctgtgaggcagatgattatggctcctacacttgaactgaggcagaatgcactagatcgtctcttgccttatcagaggtctgattttgaaggcattttccgtgctatggatgggcttccggtgacaattcggctactggaccccccacttcatgagtttcttcctgaagggaatgttgaggacattgtgagtgaattatgcgctgaaactggagccgatcaggaggaagcccttgcaagaatagaaaaactatcagaagtaaatccaatgcttggtttccgtgggtgcaggcttggtatatcgtatcctgaattaacagaaatgcaagctcgtgccatctttgaagctgctatagcgatgaccaaccaaggtgttcaagtttttccagagataatggttcctcttgttggaacacctcaggaactggggaatcaagtggcccttatccgtcaaactgctaacaatgttttcactgctatgggtaaaaccattgagtacaaaattggaactatgattgaaattcccagggcagctctagtggctgatgagatagcagagcaggctgaattcttctcttttgggacgaacgaccttacacagatgacgtttggctacggcagggatgatgtggggaagtttctccccatttatctttctcagggtatcctccaacatgatccctttgaggtgcttgatcagagaggagtgggcgagctggttaagtttgctacagagaggggacgcaaaactaggcctaacctgaaggtgggcatctgtggagaacatggtggggagcctcagtcagttgctttcttcgcaaaggctgggctggattatgtttcttgctcccctttcagggttccgattgctaggctggctgcagctcaggtgctcatctgagagcacctcctcatcggcaaccggatcgccagctcttggtgcatctggtgaagaataatcatacaggtccatgaagcggtggaaactctgctttctggcaaaggctgttgtatgtagtcttctctgtgtgcgcgcgcatgtaagccttaatgggtggtgttctgaatttcccttgaactggcatggtaatgtagtaccaaattaaacagcgatgatgacgaagagctatcgaatatattggcgattactagtgctgtcg

SEQ ID NO: 33254 - protein, 344 aa, Panicum virgatum
  misc_feature: Ceres CLONE 1949792
  misc_feature (1)..(344): Pfam Name: PEP-utilizers_C Pfam Description: PEP-utilising enzyme, TIM barrel domain
  misc_feature: SWISSPROT Homolog: EC 2.7.9.1 Pyruvate, phosphate dikinase
EVRQLKVMANADTPEDALAARNNGAQGIGLCRTEHMFFASDERIKAVRQMIMAPTLELRQNALDRLLPYQRSDFEGIFRAMDGLPVTIRLLDPPLHEFLPEGNVEDIVSELCAETGADQEEALARIEKLSEVNPMLGFRGCRLGISYPELTEMQARAIFEAAIAMTNQGVQVFPEIMVPLVGTPQELGNQVALIRQTANNVFTAMGKTIEYKIGTMIEIPRAALVADEIAEQAEFFSFGTNDLTQMTFGYGRDDVGKFLPIYLSQGILQHDPFEVLDQRGVGELVKFATERGRKTRPNLKVGICGEHGGEPQSVAFFAKAGLDYVSCSPFRVPIARLAAAQVLI

SEQ ID NO: 33255 - DNA, 919 bp, Panicum virgatum
  misc_feature: Ceres CLONE 1949794
  misc_feature: Encodes the peptide sequence at SEQ ID NO. 33256
gctttcgccaccgaggagggagggcgaccctccgatcggctccgccatggctggaactgctgttctcaacgagcgcatcctttcttccatgtcccagaaacatgttgctgctcatccatggcatgatttggagataggaccaggggctcctgaagtttttaactgtgtggttgagattcctagaggcagcaaggtgaagtatgagttggacaaggcatctggtctgatcaaggttgatcgtgtcctttactcctctgttgtttacccacacaactacggtttcattccacgcacactctgtgaggatagcgaccccatggacgtcctcatcctgatgcaggaacaagttgtccctgggtgttacctgcgagctcgtgctattgggctcatgcctatgattgatcagggagagaaagatgataagatcatagcagtctgcgctgatgaccctgaataccgtcactacacggacatcaaggaccttcctccacatcgccttcaagagattcgctgcttctttgaagattacaagaagaatgaaaacaaagaggttgcggtgaatgagttcctcccagcaaaagatgccatcgacgcaatcagatactctatggacctgtatggctcgtacatcatcgaaggactgaggaagtaacaagattgcagatgcttcatgatttactcagcagctcgagagtactgtagcacgacatatgttaacatgcacgaactgaaatcatgacaaaggaatattaccttgtgttcatgttgagactagcagcagtgccttttgtttccattatatatgccgtgtcaagtccaagcacttggctttgctgaaatcagtcgtcagaccaacatttgacagaacgattaccaaatagaatatcactgattacataaacgccatttgcttatcttc

SEQ ID NO: 33256 - protein, 201 aa, Panicum virgatum
  misc_feature: Ceres CLONE 1949794
  misc_feature (39)..(193): Pfam Name: Pyrophosphatase Pfam Description: Inorganic pyrophosphatase
  misc_feature: SWISSPROT Homolog: EC 3.6.1.1 Inorganic diphosphatase
  misc_feature: Functional homolog of the protein sequence given in SEQ ID NO 50116
  misc_feature: Useful for making plants with modulated nitrogen use efficiency
MAGTAVLNERILSSMSQKHVAAHPWHDLEIGPGAPEVFNCVVEIPRGSKVKYELDKASGLIKVDRVLYSSVVYPHNYGFIPRTLCEDSDPMDVLILMQEQVVPGCYLRARAIGLMPMIDQGEKDDKIIAVCADDPEYRHYTDIKDLPPHRLQEIRCFFEDYKKNENKEVAVNEFLPAKDAIDAIRYSMDLYGSYIIEGLRK

SEQ ID NO: 33257 - DNA, 923 bp, Panicum virgatum
  misc_feature: Ceres CLONE 1949795
  misc_feature: Encodes the peptide sequence at SEQ ID NO. 33258
acccatcgcgcgagtcagcagtcagcactagggtttttgccaagcagccgccgccgccgccgcctcactgccccccgcatcccatcctacccaccgagagaccaagatgacggcgcagaccgccgaggagctcgccgcccagatcgagcagcagaagctcgaggagcagaagaccgaggcagaggatgttgtggttgaggatgaggacgatgacgacgaggacgatgacgatgatgataaggatgatgaagatggacaagaaggcgatgccagtggcaaatcaaaacaaagcaggagtgagaagaagagccgcaaggccatgctgaaacttggcatgaagccgatcactggtgtcagccgtgtcactgtgaagaaaagcaagaatatactgtttgtcatctccaagccagatgtgttcaagagcccaaactcagacacctatgtcatcttcggtgaggccaagatcgaggacctcagctcccagctgcagacccaagctgcggaacagttcaaggctcctgacttgagccagatgatctccaagcctgagacatctggcctaggccaggaggacaatgaggaggaggttgatgagactggtgtcgagcccaaggacattgagttggtgatgacgcaggcatccgtctcgaggcccaaggctgtcaaggccctcaaggctgccgatggggacattgtcactgccattatggagctgaccacttagagcgttatttttggcatggtcgaaacattttccctctgtgagtgttctgcagcttgagcgttatttgtggactaatgcttcgataagttcttaatgtttgcttgcactttggtcaaggttgcaaaatggttctttgctagcttgtttacggctcatgctatctctggcaatgatatttcagccatgcctctgttttctt

SEQ ID NO: 33258 - protein, 205 aa, Panicum virgatum
  misc_feature: Ceres CLONE 1949795
  misc_feature (63)..(122): Pfam Name: NAC Pfam Description: NAC domain
  misc_feature (166)..(203): Pfam Name: UBA Pfam Description: UBA/TS-N domain
MTAQTAEELAAQIEQQKLEEQKTEAEDVVVEDEDDDDEDDDDDDKDDEDGQEGDASGKSKQSRSEKKSRKAMLKLGMKPITGVSRVTVKKSKNILFVISKPDVFKSPNSDTYVIFGEAKIEDLSSQLQTQAAEQFKAPDLSQMISKPETSGLGQEDNEEEVDETGVEPKDIELVMTQASVSRPKAVKALKAADGDIVTAIMELTT

SEQ ID NO: 33259 - DNA, 1011 bp, Panicum virgatum
  misc_feature: Ceres CLONE 1949832
  misc_feature: Encodes the peptide sequence at SEQ ID NO. 33260
gctggtggggtggccgatctagatcgcccccacagatctccgctcaccgccaccacttctctccctctctcgtggcgtcattccgggcgccgccgccctcttcgtcgggcccttcgccggcgacgagcatccaccaggatccaaagcgtgctacgacgtctcctacccatccgccatgattaatttcgtgctcctgatcagccgccagggcaaggtgaggctcaccaagtggtattcgccttacacccaaaaggagaggaccaaggtcattcgtgagctcagtggactcattattacgcgagggcccaaactctgcaactttgtcgagtggagaggttacaaggtcgtatacaggaggtatgccagtctgtatttctgcatgtgcattgatgctgatgacaatgagctcgaagtcctcgagatcatccatcatttcgttgagatactggaccgctattttggcagtgtatgtgaactggatttgatattcaattttcacaaggcctactacatactggatgagattcttatcgctggcgagcttcaagaatctagcaagaagaatgttgcaaggcttattgctgcacaggactcattagttgaggctgcgaaagaggaagccagctccataagtaacatcattgctcaagttacaaaataaaattctacaccactctaatgtgtgcccctttactctatcctgtcgttgttgtacaagtaaatgtaatgcactggactgttccgtgcatttgctctgttcatttttttctccaaaggaatacgtctctcaagactccagatcatttagaatgagcgtgatgtgtgactacattgtatgtgttcctttgcaagtaaaattggcatgttcctgactgctcacacatagttgtaaattcttattttactagcaaattactttctcttgatctcatagattgttcatgttgttttgcaatgtctgaaaacctgtgagagttgtgttggaggaaagaaacagtgcgagttatcagc

SEQ ID NO: 33260 - protein, 161 aa, Panicum virgatum
  misc_feature: Ceres CLONE 1949832
  misc_feature (1)..(142): Pfam Name: Clat_adaptor_s Pfam Description: Clathrin adaptor complex small chain
MINFVLLISRQGKVRLTKWYSPYTQKERTKVIRELSGLIITRGPKLCNFVEWRGYKVVYRRYASLYFCMCIDADDNELEVLEIIHHFVEILDRYFGSVCELDLIFNFHKAYYILDEILIAGELQESSKKNVARLIAAQDSLVEAAKEEASSISNIIAQVTK

SEQ ID NO: 33261 - DNA, 1132 bp, Panicum virgatum
  misc_feature: Ceres CLONE 1949838
  misc_feature: Encodes the peptide sequence at SEQ ID NO. 33262
atctcccctcctcctcctcctccttcctccaccaccaccgcccgggctggttgcagcaagcgagccttatcttcttcttcgtccgtccagaccgtcctggcactggctagtaggtgtcgcgagacagggagggtagcagcgagctgagactgagaggtttacggagggcggcgcggcggccatgaagatccagtgcggcgcgtgcgaggccgcggcggccacggtggtgtgctgcgccgacgaggcggcgctgtgcgcgcgctgcgacgtcgagatccacgccgccaacaagctcgccagcaagcaccagcgcctcccgctcgaggcgctctccgccaggctcccccgctgcgacgtctgccaggagaaggcggccttcatcttctgcgtggaggaccgggcgctcttctgccgggactgcgacgagcccatccacgtccccggcacgctctccggcaaccaccagcgctacctcgccaccggcatccgcgtcggcctcgcctccgcctccgcgtgcggcgacgccagcgacgcccacgactcggaccaccaccacgccccgcccaaggccaccgtcgagcccgccgtctccgccgcggcgcagcaggtgccctcaccgccgccgttcctgcctcagggctgggccgtcgacgacctcctccagttctccgactacgagtccggcgacaagctgcagaaggagtcgccgctcgggttcaaggagctcgagtggttcgccgacatcgacctcttccacgaccaggcgccgcccaaggccggcagggcgctggcggaggtcccggagcttttcggatcccaggcggcaagcggcgcggcgtactacaggccgagcaaagccggcgccggccttcgccagagcaagaaggcccggatcgaggtcaccgacgaggacgactacctcatcgtccctgaccttggctgaaaagaagagcgcgagagttttggttcttcgcctgttgtggtgttgtataccagaagaattctactgtgtacaagctaatgtcatgtgttgtgcatcttgactgtagtatggctcaactgtgaacattataattctggccactttgttgctatgctagcaacagagcctgtgtgatattttgatgatttc

SEQ ID NO: 33262 - protein, 253 aa, Panicum virgatum
  misc_feature: Ceres CLONE 1949838
  misc_feature (1)..(47): Pfam Name: zf-B_box Pfam Description: B-box zinc finger
  misc_feature (52)..(99): Pfam Name: zf-B_box Pfam Description: B-box zinc finger
  misc_feature: The sequence is a functional homolog of SEQ ID NO 465 in the 11/479,226 US patent application
MKIQCGACEAAAATVVCCADEAALCARCDVEIHAANKLASKHQRLPLEALSARLPRCDVCQEKAAFIFCVEDRALFCRDCDEPIHVPGTLSGNHQRYLATGIRVGLASASACGDASDAHDSDHHHAPPKATVEPAVSAAAQQVPSPPPFLPQGWAVDDLLQFSDYESGDKLQKESPLGFKELEWFADIDLFHDQAPPKAGRALAEVPELFGSQAASGAAYYRPSKAGAGLRQSKKARIEVTDEDDYLIVPDLG

SEQ ID NO: 33263 - DNA, 1187 bp, Panicum virgatum
  misc_feature: Ceres CLONE 1949839
  misc_feature: Encodes the peptide sequence at SEQ ID NO. 33264
gtagcctctctctctctctctgcacactccctcctgctctctctctctctacacagactgctgcacaaagccgccttcgtcttccactgctcgttcttgttcacacacacgcagcctcccggaaaagagaagcccgtctccctatttctccctcaggttggttcaggccatctacccattcggtggcttcagcagcagtgttcttcctgtcaacaagcaatctttctacagttttagctctgtagccatgatacaagcatgactggttcttgaacattacaaggctttggagagatgggatgtgctgcttccaggttagaagatgaggaggctgtcaagatgtgccgggacagaagggaattcatcaagcaggcactggagcagcgcaaccgatttgcatcatctcacattgcctacattgagtcacttaagcgcgtttcaatggctctccagcgttttgttgctggagatgatcaccatgaactcattttcgatacattcatctctcctgtcaagcaattggagccagagatgctcggcctaccttatggttcatatgagaagagaaccattcatgtctaaggtacttgaggtctggacctaacccatcagtgtcagttgaggagcatccacgaccggtggaaacagtccgtgtcgaatcacattatcccatggacaactacagtggcacggataggttcttccagactcattcctcaccgatgagatcgtcttcatactacccgccaccttataacaggccaagctatccacctccatctgcccaggaaccagcgaggaattcttcctattacatgccttatgacaggccaagctatgcacctccatcaccccaggagccaatgaggacatcttattatgcatctcatgacagggcaagctacccaccaccatcaccccaggagacagtgaggaattcttatcacacatcatatgacaggccaagctatccacctccctcaccccaggagcaggaatcatcaccatgggacttcttctggaacccattctcgtcgctagaaagctttgcatatcctcgccctcggagtagctatgaaaatgtggtcactgatgatgaattggcacggttacagcgggtacgagaggaggaaggaattccagaactcgaagaggaagatgatgagtgtcaagatcatgtaccaatg

SEQ ID NO: 33264 - protein, 95 aa, Panicum virgatum
  misc_feature: Ceres CLONE 1949839
  misc_feature: The sequence is a functional homolog of SEQ ID NO 168 in the 10/225,068 US patent application
  misc_feature: The sequence is a functional homolog of SEQ ID NO 228 in the 10/374,780 US patent application
MGCAASRLEDEEAVKMCRDRREFIKQALEQRNRFASSHIAYIESLKRVSMALQRFVAGDDHHELIFDTFISPVKQLEPEMLGLPYGSYEKRTIHV

SEQ ID NO: 33265 - DNA, 1059 bp, Panicum virgatum
  misc_feature: Ceres CLONE 1949851
  misc_feature: Encodes the peptide sequence at SEQ ID NO. 33266
tgactcctgcccaccgccgtcacttgcgcctcctcctaccgtgccctttttttctcaaaaaaaaaataccgtgcccttttcgctctgcttcttcttgcactcctcgatctcaccggcggcggaaatggcggaagttgaggcgcccacccaggaggtcaagctcttcggccgctggtccttcgatgacgtccaggtcaatgacatttctctggctgattaccttgccgtcagtcatacaaagcacgccatatatcttccccacactgctggaaggtattctgctaagaggttccgcaaggctcagtgcccaattgttgagaggctgacaaactctctgatgatgcacggccgcaacaatggcaagaaggtcatggctgttcgtattgtgaagcatgccatggagattattcacctgctgactgatgccaaccctattcaaattatcgtcgatgccatcataaacagtgggccaagagaagatgcgacccggattggatctgctggtgttgttagaaggcaagctgttgatatatctccattgaggcgcgtgaaccaggcaatctacctggttaccactggtgctagggaaagtgctttcaggaacatcaagaccattgccgagtgccttgcagatgagcttatcaatgcagctaaaggttcttctaacagctatgcgatcaagaagaaggatgagatsgagcgtgttgcaaaggccaaccgttgagcattctcatgcaaagcaatgttttggggtggaacgatgcctacttatgaatctactaccctgtttatttgtgaacttggcttggtgttggagctacagacttcgatgttccctaaaaacacaagtaccgttcctgatctggttgttttagctgcagtatgaattgaagttttgccacagctagtttgtcgtgttgacagctccatctctatcagtgtcaagacttgtaattataaatggtctgtaaacatgttctctatcttgtttctttgtcccaaaaccatgggaaatgtgctggagctcggtgtacctggtaatgcattagtgtttggctc

SEQ ID NO: 33266 - protein, 199 aa, Panicum virgatum
  misc_feature: Ceres CLONE 1949851
  misc_feature (44)..(199): Pfam Name: Ribosomal_S7 Pfam Description: Ribosomal protein S7p/S5e
  misc_feature: Functional homolog of the protein sequence given in SEQ ID NO 51435
  misc_feature: Useful for making plants with modulated biomass
  misc_feature: Useful for making plants with modulated flowering time
  misc_feature (191)..(191): Xaa is any aa, unknown, or other
MAEVEAPTQEVKLFGRWSFDDVQVNDISLADYLAVSHTKHAIYLPHTAGRYSAKRFRKAQCPIVERLTNSLMMHGRNNGKKVMAVRIVKHAMEIIHLLTDANPIQIIVDAIINSGPREDATRIGSAGVVRRQAVDISPLRRVNQAIYLVTTGARESAFRNIKTIAECLADELINAAKGSSNSYAIKKKDEXERVAKANR

SEQ ID NO: 33267 - DNA, 954 bp, Panicum virgatum
  misc_feature: Ceres CLONE 1949866
  misc_feature: Encodes the peptide sequence at SEQ ID NO. 33268
atcccacaactcccccacttcggccaccagacacacgtctcctcattttctcaggtcttctcttcttctgcacccaaacttccccccattctgctctgtcgtcaatttctccgtcctgaacagaaatacagatggcggggactgtgttcacgccctcccttgagggaatgaagcatgtcaagtcagagaacggcctgatcctgaccaagccgtttctcgaagtatgcaagcacatccttcctgtgctagagaaattcgggtcagccatggctattgtcaagactgatataggaggcaatatcacgaggctggagacaaaatatgcatctgatcctacaaagtatgagcagctgcacagtctggtgaaagtagaagttagtgcaaagactgccagaagttctagcagttgtactaacggtcttctctggctgacaagagccatggacttcttggttgcactgttccataatttggtacagcacccagattggcaaatgtcacaagcttgcaatgacgcatatagcaaaacactgaagaaatggcatggctggctagcgagttcaagcttttcggttgccataaagcttgcaccagacaggaagaagttcatggagatcatcagtggttcaggcaacatcaacacagacattgagaagttttgctcaacattctcccctttgctggcagaaaaccacaagtttctggccagtgtgggcatggatgatcttaaggcgtcttgatgcagtacactcgtttatcatttggcattctccatgccaagcttacacagaaacatgcatcatgcgttgttgaatttgtattgaggataatgaatctctgctctgtctaaatgtaatatttgtcacatccttgtttaatcatgaacacaggataacttctggctgaccgtgtcaattttcaatggatgagatttggtttgcaacttgtgttttt

SEQ ID NO: 33268 - protein, 202 aa, Panicum virgatum
  misc_feature: Ceres CLONE 1949866
  misc_feature (10)..(198): Pfam Name: GLTP Pfam Description: Glycolipid transfer protein (GLTP)
  misc_feature: Functional homolog of the protein sequence given in SEQ ID NO 51116
  misc_feature: Useful for making plants with modulated oxidative stress sensitivity
MAGTVFTPSLEGMKHVKSENGLILTKPFLEVCKHILPVLEKFGSAMAIVKTDIGGNITRLETKYASDPTKYEQLHSLVKVEVSAKTARSSSSCTNGLLWLTRAMDFLVALFHNLVQHPDWQMSQACNDAYSKTLKKWHGWLASSSFSVAIKLAPDRKKFMEIISGSGNINTDIEKFCSTFSPLLAENHKFLASVGMDDLKAS

SEQ ID NO: 33269 - DNA, 1143 bp, Panicum virgatum
  misc_feature: Ceres CLONE 1949867
  misc_feature: Encodes the peptide sequence at SEQ ID NO. 33270
tcctccccacccctcgacccgccgccaaacctcgtcgcgccgccgccaccggagagaagatggtcgggccaggcctctacaccgagatcggcaagaagaccagggatctgctgtacaggggctaccaaaccgaccacaagttcaccctcaccacctacacctccaatggcgtcgctatcacagctactagcacaaagaaagctgacctaatttttggtgagatccaatcacagataaagaacaagaacgtcaccatagatgtgaaagcaaactcaggatcaaatgtcattactacggttactgttgatgagattgctacaccaggactgaagactatcttgagctttgctgttcctgatcagagatctggaaagtttgagcttcagtacttgcatgatcatgctggggttaatgcaagcattggtctgactgccaatcctgtagtcaacctctccggctcctttggaaccaaggctgtggcagttggtgcagatatctcacttgataccgcatctgggagcttaaccaaatacaatgctggactgagcatcactcatgaagaccttatcgcatccctgaacctgaacaacaagggagacagcctaactgcagcttactaccacaatgttaacctattgactagcacagctgttggggcagagctgacccacagcttctcaaccaacgagaacaccctcgcctttggcacccagcacgctctggatccactgaccgtcgtgaaggcccggttcaacaattgtggcaaggccagcgcgctgatccagcatgagtggaggccaaagtcactggtgaccatctcgggtgaggttgacaccaagaccattgagaagagctcgaaggttgggatcgccgtggccctcaagccctgattgttttaccaagtccctttttctctttttaaagctcccagcgtgtacttatttcccagctgaaattgggaccaggtcggcttgggaaaacaaaaaactttgggttcccggcatcttttggtcgttgcagcctattgatttcatgaactgcgatgtttccttgaggattttttttgcagtcgccggtgtagcactctgttaaatgagcaaccttcacaataattcaagctcggtagaattctgaacttgtttg

SEQ ID NO: 33270 - protein, 276 aa, Panicum virgatum
  misc_feature: Ceres CLONE 1949867
  misc_feature (3)..(269): Pfam Name: Porin_3 Pfam Description: Eukaryotic porin
  misc_feature: Functional homolog of the protein sequence given in SEQ ID NO 50463
  misc_feature: Useful for making plants with modulated drought sensitivity
MVGPGLYTEIGKKTRDLLYRGYQTDHKFTLTTYTSNGVAITATSTKKADLIFGEIQSQIKNKNVTIDVKANSGSNVITTVTVDEIATPGLKTILSFAVPDQRSGKFELQYLHDHAGVNASIGLTANPVVNLSGSFGTKAVAVGADISLDTASGSLTKYNAGLSITHEDLIASLNLNNKGDSLTAAYYHNVNLLTSTAVGAELTHSFSTNENTLAFGTQHALDPLTVVKARFNNCGKASALIQHEWRPKSLVTISGEVDTKTIEKSSKVGIAVALKP

SEQ ID NO: 33271 - DNA, 683 bp, Panicum virgatum
  misc_feature: Ceres CLONE 1949873
  misc_feature: Encodes the peptide sequence at SEQ ID NO. 33272
gcgcttcgttcctcctcgtccctcggcatcgcctcctctccgtctccctgcagagagagcgccgcaaggcactgaaactcgcggcggcgtgttgtttgcttgcttgctggcaagagggagaaaaggaggaggaagagagcaggagatggcaggctgcgatggagccaagtcgccggcctccaaggaggaagaggcatgtgttgagaagaagtatggaggaattgcacccaagaagcctttgatatccaaggaccacgagcgcgcgtacttcgattcagcagactgggtgctcggcaagcaagctgcaaatagcagcacacggactgctgttgagtctctgaagcccaagctgaagcgaacgcctcaccaccagcttccccctcgcaagccgacctgcgcttccagctgagacgcacggtgagctggctgacctccaatccaaaagcctgcagcacttagctcgtagtagcatcacgcgcagcaatgtgcaaaagcgccgcaagaaatgaccacccctctgtgttcatgcagtgcagctgctggagggagtgctgggaggtaaggatagggctcggataaatgtttggccgctggtccgaaatcgtagggatggatcagaagcctgaggggcaatctggctacttgtcaattgcagcctctactatgtctgtcatcaagaacgg

SEQ ID NO: 33272 - protein, 87 aa, Panicum virgatum
  misc_feature: Ceres CLONE 1949873
  misc_feature (20)..(87): Pfam Name: Lg106 Pfam Description: Lg106-like protein
  misc_feature: Functional homolog of the protein sequence given in SEQ ID NO 50181
  misc_feature: Useful for biocontainment applications
MAGCDGAKSPASKEEEACVEKKYGGIAPKKPLISKDHERAYFDSADWVLGKQAANSSTRTAVESLKPKLKRTPHHQLPPRKPTCASS

SEQ ID NO: 33273 - DNA, 365 bp, Panicum virgatum
  misc_feature: Ceres CLONE 1949884-R
  misc_feature: Encodes the peptide sequence at SEQ ID NO. 33274
gaacccgagcagtttcagcctcgcagatgggaggggctgaaccagccggctggcaagagcttcgcgccgttcggaggtggactgcggctctgccctggatcggagattgtcaaagtggaggctgctttcttcctgcaccaccttgtgctcaactacaggtggaggatgggtgaagaggacgctcccatgctgcaccagtacgtggaattcaagaagggcctgcccatacagctcgagccggtcagctgatgctcatcaagcctttgcctcgctcgctcttcgtcaagactccaagagagatgaaataagttgagacgtcggacccccgccagccagccagtcctgaatcgcgatttacaagtcac

SEQ ID NO: 33274 - protein, 82 aa, Panicum virgatum
  misc_feature: Ceres CLONE 1949884-R
  misc_feature: SWISSPROT Homolog: EC 1.14.13.93 (+)-abscisic acid 8'-hydroxylase
  misc_feature: Functional homolog of the protein sequence given in SEQ ID NO 50272
  misc_feature: Useful for making plants with modulated oxidative stress sensitivity
EPEQFQPRRWEGLNQPAGKSFAPFGGGLRLCPGSEIVKVEAAFFLHHLVLNYRWRMGEEDAPMLHQYVEFKKGLPIQLEPVS

SEQ ID NO: 33275 - DNA, 490 bp, Panicum virgatum
  misc_feature: Ceres CLONE 1949884
taataatttttcccccctccctttgaaaacttctttccaccaaaccccaccaggtggtggtaccccctcttgtgggccccttgggcggcctccccccccccggcggggttccccccttacttcccctggtccccgggcgccctcccaagggccgcttccggtggccccctcttcgccaaaaccttcggtttcctccccccccccccttccaaacccgcggggggtttcttaaagaacaccttccccagttacggaacgtggttcaattcccccttcttcgctcccccggcgtggtcctcctgcaacaagaacttcacccctttctggctcaacaacaagaacccctggttcaattgaactacccccggccccttccccaccttctccggcaattcttcccccttgtggttccccgccaacccccccccccaattccgaagcttgttcccccccctctccgcctcaccgggcttcagggcttctaactccg

SEQ ID NO: 33276 - DNA, 972 bp, Panicum virgatum
  misc_feature: Ceres CLONE 1949889
  misc_feature: Encodes the peptide sequence at SEQ ID NO. 33277
attttctgcacgcgctcccgggtttcagctccggcgccatcagggcaggggggagcgatagttctgtgctattgggagaggagggtgaggaggaggaggttgcgagatggggtccggatctttcctcaaggtgctggccaagaacttcgacgtgctcgccgggccaataatatcacttgcttatcctctgtatgcttctgttagagcaatagagacaaaaaatcctgtagatgatcagcaatggctcacttattgggtgctgtactcctttatcactttgtttgagctaacttttgctccaattattgagtggcttcccttttggtcatatgcaaagctgtacttcaactgctggttggtcttaccttggttcaacggtgctgcttatgtttacgtccattttgtgcggccaatgtttgtgaaccgccaaatagtaaacatatggtatgtcccaagaaatgagaagtcaagtaaacctgatgatgtactgtcagctgcagagagatatattgaacagaatggaccagaagcatttgagaagctcatcagcaagtctacaaagtcttcaaaatcaaggaccacaaggcgttcgatcttggaggaggctgaggctgaaagagaatcctggggtgaaaatcctttctacgacaaaaacttccgacactaaactacttgaaggcgaattccccagttttctgttagtgttatggattttcaattgcgagatttccttgacaacatgcgcttcatgcagccttgctgggccacacggcctcgagacgaccttcatgtattcctgacttgaggactgtaccttgttgcatccactgctagcaattgtggactctactgtaaatggaggtagatgctagcgttgctgatttatgtgagcttttggctggtgtaatatcaacaacatcgcctgtgtcactaaaccttcaggaggatacaagcctagatttttcagtttcc

SEQ ID NO: 33277 - protein, 186 aa, Panicum virgatum
  misc_feature: Ceres CLONE 1949889
  misc_feature (7)..(104): Pfam Name: TB2_DP1_HVA22 Pfam Description: TB2/DP1, HVA22 family
MGSGSFLKVLAKNFDVLAGPIISLAYPLYASVRAIETKNPVDDQQWLTYWVLYSFITLFELTFAPIIEWLPFWSYAKLYFNCWLVLPWFNGAAYVYVHFVRPMFVNRQIVNIWYVPRNEKSSKPDDVLSAAERYIEQNGPEAFEKLISKSTKSSKSRTTRRSILEEAEAERESWGENPFYDKNFRH

SEQ ID NO: 33278 - DNA, 1885 bp, Panicum virgatum
  misc_feature: Ceres CLONE 1949905
  misc_feature: Encodes the peptide sequence at SEQ ID NO. 33279
cccgtgctcaccgctcaaaaccctccccatctcctcctcccactccggcggcggcggcggggcctcttctccggcgaggcctcctcctctacaccacagaaaaacatggatgtacctgttgaggaccctgtggagaataacctggctggaactcctcctacccttggcaatgaggaacaagccaatccttatgctgatgtgcaagagaagctcaatgaagaaccagaaaagccgtatgatggggaatccaaagacccaaaacctgatgagttggggaactccgagcatgcggatgtgaacaatgaagatgcgggggatctgagcaaagaggaccaagctacccccatgcagcaggagcctgccaatgtctatgttgaggaagctgggacaaagcagcagggtattgtggtgcctgatgaacagaaatggcctgggtggcctggagaaagcgtattccgtatactggttcctgtcacgaaggtgggtgctgtcattgggcgaaaaggagatttcatcaagaaaatgtgtgaggaatccaaagctcgcattaaggtcctcgagggcccacaaggcgtgccagaaagagctgtaatgatttcagcaaaggatgaacctgatgcagtgctatctccagctgtcgatgggttgcttagagttcataaaaggataactgatggtttagatgctgaaactgatcagcctcaacgaggcactgtcaccgctgggcctacaaggctactggttccagcttcccaagctggaagcctgattggcaagcaaggaggaactattaaatccatacaagatgcttcaaagtgtgctctccgaattcttgagaatgttcctcctgtggcattaaatgatgatagagttgttgagatacagggtgaacctcttaatgttcacaaagcagtggagctgattgcaagtcatttgagaaaatttcttgttgaccgcagtgttctccctttgtttgaatcccagatgaaagcatacaatgtgcacagagagcaacctatgccacctcctcagccatggggtccccctccaccctcaccctggggtcatccaccaaaccttcctcctggtcctggtggcccaggttatgttgggaatccacaatacatgcctccacgaccacaagacaactattaccctcctcctgatatgccccctgtagaaaagcaaccacactatggaatttcttcatatgggcgcgacgcacctccaagtgctccctcagggaatcagcaccaagcacatgggtcttctcaggtgacacacagcatgcaagttcctctttcctatgcagatgctgtgattggagcagctggtgccagcatcagctacatccgcaggcatagtggcgcaaccataagtattcaagaaggtgctcctggggagatgacagtggagataacaggaagcgcctcacaagtacaaactgctcagcagctgatcaagaatttcatggctgaagcttctccccagggcccaccaggtcctgctgcacccgctcaatctgttgacacgggctacagctcttcttacctaccatacggcggagcatcatacggatctcctccaggcagcgcagctccaggcccacacaatggaggaagctatggcgctgcaccatatccgccgaactacggatactagttggagggagaacttggtttcctagttgcagatcttggggaaagggggtattcaggttttgtttgctagtcacctagtctgttcatgtgttgagaacgaggtcgttaggatttctgaactaccttctggtgttgtaagctgctttctgttcccaatgcgcgtacgctctttctttgctctgtggttgcgtgaacttaccattaatccagtatttccatattcg

SEQ ID NO: 33279 - protein, 518 aa, Panicum virgatum
  misc_feature: Ceres CLONE 1949905
  misc_feature (208)..(273): Pfam Name: KH_1 Pfam Description: KH domain
  misc_feature (392)..(452): Pfam Name: KH_1 Pfam Description: KH domain
  misc_feature (116)..(178): Pfam Name: KH_1 Pfam Description: KH domain
  misc_feature: Functional homolog of the protein sequence given in SEQ ID NO 50722
  misc_feature: Useful for making plants with modulated flowering time
MDVPVEDPVENNLAGTPPTLGNEEQANPYADVQEKLNEEPEKPYDGESKDPKPDELGNSEHADVNNEDAGDLSKEDQATPMQQEPANVYVEEAGTKQQGIVVPDEQKWPGWPGESVFRILVPVTKVGAVIGRKGDFIKKMCEESKARIKVLEGPQGVPERAVMISAKDEPDAVLSPAVDGLLRVHKRITDGLDAETDQPQRGTVTAGPTRLLVPASQAGSLIGKQGGTIKSIQDASKCALRILENVPPVALNDDRVVEIQGEPLNVHKAVELIASHLRKFLVDRSVLPLFESQMKAYNVHREQPMPPPQPWGPPPPSPWGHPPNLPPGPGGPGYVGNPQYMPPRPQDNYYPPPDMPPVEKQPHYGISSYGRDAPPSAPSGNQHQAHGSSQVTHSMQVPLSYADAVIGAAGASISYIRRHSGATISIQEGAPGEMTVEITGSASQVQTAQQLIKNFMAEASPQGPPGPAAPAQSVDTGYSSSYLPYGGASYGSPPGSAAPGPHNGGSYGAAPYPPNYGY

SEQ ID NO: 33280 - DNA, 1020 bp, Panicum virgatum
  misc_feature: Ceres CLONE 1949906
  misc_feature: Encodes the peptide sequence at SEQ ID NO. 33281
cttttcgctctgcttcttcttgcactcctcgatctcaccggcggcggaaatggcggaagttgaggcgcccacccaggaggtcaagctcttcggccgctggtccttcgatgacgtccaggtcaatgacatttctctggctgattaccttgccgtcagtcatacaaagcacgccatatatcttccccacactgctggaaggtattctgctaagaggttccgcaaggctcagtgcccaattgttgagaggctgacaaactctccgatgatgcacggccgcaacaatggcaagaaggtcatggctgttcgtattgtgaagcatgccatggagattattcacctgctgactgatgccaaccctattcaaattatcgtcgatgccatcataaacagtgggccaagagaagatgcgacccggattggatctgctggtgttgttagaaggcaagctgttgatatatctccattgaggcgcgtgaaccaggcaatctacctggttaccactggtgctagggaaagtgctttcaggaacatcaagaccattgccgagtgccttgcagatgggcttatcaatgcagctaaaggttcttctaacagctatgcgatcaagaagaaggatgagatcgagcgtgttgcaaaggccaaccgttgagcattctcatgcaaagcaatgttttggggtggaacgatgcctacttatgaatctactaccctgtttatttgtgaacttggcttggtgttggagctacagacttcgatgttccctaaaaacacaagtaccgttcctgatctggttgttttagctgcagtatgaattgaagttttgccacagctagtttgtcgtgttgacagctccatctctatcagtgtcaagacttgtaattataaatggtctgtaaacgtgttctctatcttgtttctttgtcccaaaaccatgggaaatgtgctggagctcggtgtacctggtaatgcattagtgtttggttcatggatgggtaatataaaggcaaaggtaattgattc

SEQ ID NO: 33281 - protein, 199 aa, Panicum virgatum
  misc_feature: Ceres CLONE 1949906
  misc_feature (44)..(199): Pfam Name: Ribosomal_S7 Pfam Description: Ribosomal protein S7p/S5e
  misc_feature: Functional homolog of the protein sequence given in SEQ ID NO 51435
  misc_feature: Useful for making plants with modulated biomass
  misc_feature: Useful for making plants with modulated flowering time
MAEVEAPTQEVKLFGRWSFDDVQVNDISLADYLAVSHTKHAIYLPHTAGRYSAKRFRKAQCPIVERLTNSPMMHGRNNGKKVMAVRIVKHAMEIIHLLTDANPIQIIVDAIINSGPREDATRIGSAGVVRRQAVDISPLRRVNQAIYLVTTGARESAFRNIKTIAECLADGLINAAKGSSNSYAIKKKDEIERVAKANR

SEQ ID NO: 33282 - DNA, 922 bp, Panicum virgatum
  misc_feature: Ceres CLONE 1949916
  misc_feature: Encodes the peptide sequence at SEQ ID NO. 33283
aatctcatatcgtctcatcgttcggagcgcacaaccccgttccaaatccaaatcgctcttctcgtgaccctcggcgatccttcccccgcttcaagatgcagatctttgtgaagaccttgaccggcaagactatcaccctcgaggtggagtcctccgacaccattgataacgtcaaggcaaagatccaggacaaggagggcatccccccggaccagcagaggcttatcttcgccggcaagcagctggaggatggccgcactcttgcggactacaacatccagaaggagagcaccctccacctggtgctccgcctgaggggaggcatgcagatcttcgtgaagactttgaccggcaagactatcaccctcgaggtggagtcctccgacaccattgacaatgtcaaggcaaagatccaggacaaggagggtatccccccggaccagcagaggcttatcttcgccggcaagcagctkgaggatggccgcacccttgcsgactacaacatccagaaggagagcaccctccacctggtgctccgcctgaggggagggatgcagatctttgtgaagaccttgactggcaagactatcacccttgaggttgagagctccgacaccattgacaacgtgaaggccaagatccaggacaaggagggcatccccccggaccagcagcgacagcgactgatcgcctcgccgcgcgccgtgcttgccggtgaaaaaggtgcttggagaggactatctaccggaagctgtgtgatgtaatgtttcatgagtgccatgcgtgtgtgtgtgtgtgctaatcaagggagaaatgcaaaaaaaaaaaatcctttatgttggtgaatgtactcctaatgatggctccatggtgctagcttgtaataaaatgttaatgcagaaattggtctgctagcttgtgt

SEQ ID NO: 33283 - protein, 222 aa, Panicum virgatum
  misc_feature: Ceres CLONE 1949916
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(219): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRQRLIASPRAVLAGEKGAWRGLSTGSCVM

SEQ ID NO: 33284 - DNA, 620 bp, Panicum virgatum
  misc_feature: Ceres CLONE 1949942
  misc_feature: Encodes the peptide sequence at SEQ ID NO. 33285
aatgcatgttttattgagatatttctttaaccaaatgattattcttgccgaattgaccatctgatgcaggagtagcactgatgtttggtctttcaaccatttttctttcttaaggtgagggattggtacttggactcgttccgcgacatcagatacttcccagaagtgaggaatcacaacgacgagcttgctttcacacagatgattaaaatggtcaaggtgcggcacaataatgtggttccaacaatggctttgggagtgcagcagctgaaaaaccaactgtgccgcacaaggaaggttccctttggatccgacgagatccacgagttccttgatcgattctacttgtcaaggattggcatccgcatgctgatagggcagcatgtggctttgcatgatcctgaaccagagcctggtgtcataggcctcattaatacaagattgtcccccatacaggtggctcaagctgctagcgaagatgcccgtgctatttgtttaaggacatacggatcagctcctgatattaacatttatggtgatccaaattttacatttccatatgtcgcatcacacctatatctgatgttatttgaattggtgaagaactcgcttcgtgcagt

SEQ ID NO: 33285 - protein, 139 aa, Panicum virgatum
  misc_feature: Ceres CLONE 1949942
  misc_feature: SWISSPROT Homolog: EC 2.7.11.2 [Pyruvate dehydrogenase (acetyl-transferring)] kinase
MIKMVKVRHNNVVPTMALGVQQLKNQLCRTRKVPFGSDEIHEFLDRFYLSRIGIRMLIGQHVALHDPEPEPGVIGLINTRLSPIQVAQAASEDARAICLRTYGSAPDINIYGDPNFTFPYVASHLYLMLFELVKNSLRA

SEQ ID NO: 33286 - DNA, 258 bp, Panicum virgatum
  misc_feature: Ceres CLONE 1949942-R
ggctgcccttcttcttgtaatagaatccagtgctggtctgcaaatattgttctaatggcccagccacctatagctatagttggttgctgctccgtatcttctagccccctcaatttcatcttttagctctgctgcattgcgagcacaagcactcctacttcctatgatccctcgtcctggtttcagaaaaatagtatgattataatctctcatcctctcagaaattatcattacaaatgggctctgggagcgttactg

SEQ ID NO: 33287 - DNA, 995 bp, Panicum virgatum
  misc_feature: Ceres CLONE 1949965
  misc_feature: Encodes the peptide sequence at SEQ ID NO. 33288
ctctctctcgctcgctctcgtccccctcctcccgcagcggttcttccctcccttcctctcgccgccgccgccgccgccgttgccgtgttccgtttccttgcagatggcttccgccaaggtggagaaccgaggcgcgctgtccaagaggtcgcgcaacgacgtgtctgtaaaggagggggactggaattgtcctcagtgtggtaatgtcaacttcagttttagaaatgtttgcaaccgtggagcctgtggtgcaccgcgtccatcaccgagtccaagtccaagaatgatgccagcacctcctgctgctggatatgagcggtcacctctattttacggagggggtggtggggcgccatctccaatccctcttggatctggtagctatggtggtccatatccacaccttgggatgcgttatggttatggtccaccagtaggagctcctggttcatatggccttttctcttcgtatggtcaacctggaccgatgggtggcatgggatatggccctggacctgagctaggccgatacaactatgggtttagaggatctccaatgccggtttctagcccatggtctggtggagcattagtggaaaacaatgataacattgcttcacgaaagcgccgtggaggcccagatggactttctgagggtgactggacctgtcccaaatgtgacaatattaacttttccttcagaaccacctgcaacatgaagaaatgtggagccccgaggccaactcctggagctaacatgagttcagctcgcaaagacaaggatgcccctgaaggaagctggacctgcccagagtgcaacaacctgaactacccattccgcgcggtgtgtaacaggaaagggtgctcatacagcaagccgaccccggccaacaactgaacccaacctttccgttcattgtcgaaatattgttgtaccctagattgtgacctatatcagtcgtgttaaactgcagagacgtttttcctgttccgtt

SEQ ID NO: 33288 - protein, 264 aa, Panicum virgatum
  misc_feature: Ceres CLONE 1949965
  misc_feature (23)..(54): Pfam Name: zf-RanBP Pfam Description: Zn-finger in Ran binding protein and others
  misc_feature (183)..(214): Pfam Name: zf-RanBP Pfam Description: Zn-finger in Ran binding protein and others
MASAKVENRGALSKRSRNDVSVKEGDWNCPQCGNVNFSFRNVCNRGACGAPRPSPSPSPRMMPAPPAAGYERSPLFYGGGGGAPSPIPLGSGSYGGPYPHLGMRYGYGPPVGAPGSYGLFSSYGQPGPMGGMGYGPGPELGRYNYGFRGSPMPVSSPWSGGALVENNDNIASRKRRGGPDGLSEGDWTCPKCDNINFSFRTTCNMKKCGAPRPTPGANMSSARKDKDAPEGSWTCPECNNLNYPFRAVCNRKGCSYSKPTPANN

SEQ ID NO: 33289 - DNA, 1046 bp, Panicum virgatum
  misc_feature: Ceres CLONE 1949977
  misc_feature: Encodes the peptide sequence at SEQ ID NO. 33290
acccataatcgggcgcccgctgcgctccctccgccgccgcgaccaccaaggcgacgagacgatgctgcggatctaccgcttcctcccatccgcctccaggagaggttttgatctaaaagaacctctttggagtggttcgttgacattccaacaagctgtctcaacttcagcaggaaatcttgatgagaacctgtctggtaaaaagtttgcaagctatactgtgttcaagggaaaggctgcactttctattcatcctatactgccaagtttcagcaaaatggaatctggagcatatcggatgaacagaaatggatcagtaatgttgaccttccttcctgctgttggacaaaggaagtatgactatacaaagaaacagctttttgctctgtcacctactgaagttggatgcttgataagtcttgggcctgctgaatcctgtgagtttttccatgatccgtccatgaaatctagtcatgaaggacaggtgaaaaaatcgctgtcgcttactccccttggcagtgacagtggatactttgttaatataaccgttctgaacaacgtgcagaagactaccgatcgcctttcagtccctatcacaaaagctgagtttgcggtgatgcgcacagcactgagttttgcgttgccacacatcatgggctgggatcaggtgttgacgcmccatccagctcccctagctagcaacaaacaagcctaggatggagcgtccacccccggattttgaatgggaaaaggtgaagctttccttgtagcagcaagatggagtattttgggcatcactatgaagttgctgctgcaaagtttcgaatgttggtgtgcgttgattgtatctccctcctgatcgattcagaacacttgtctgctttagatttctgtaacttgagattgaaggcacgatggagcatgatggaccatattgtttgttcagtgcatgtataacttcaccatgcctactaagcgcatgtttctagtcgagtgagctggtagcactacagtttcctgtaaataatgtctgtgcttggtgttcc

SEQ ID NO: 33290 - protein, 217 aa, Panicum virgatum
  misc_feature: Ceres CLONE 1949977
  misc_feature (53)..(191): Pfam Name: Whirly Pfam Description: Whirly transcription factor
  misc_feature (206)..(206): Xaa is any aa, unknown, or other
MLRIYRFLPSASRRGFDLKEPLWSGSLTFQQAVSTSAGNLDENLSGKKFASYTVFKGKAALSIHPILPSFSKMESGAYRMNRNGSVMLTFLPAVGQRKYDYTKKQLFALSPTEVGCLISLGPAESCEFFHDPSMKSSHEGQVKKSLSLTPLGSDSGYFVNITVLNNVQKTTDRLSVPITKAEFAVMRTALSFALPHIMGWDQVLTXHPAPLASNKQA

SEQ ID NO: 33291 - DNA, 1435 bp, Panicum virgatum
  misc_feature: Ceres CLONE 1949986
  misc_feature: Encodes the peptide sequence at SEQ ID NO. 33292
agaaatacaaagcaaggaaagaactttgaaaagctatggctgtcccacaagttgataagaaaatgctcagtgaacttgaatccatgggattcccaaccactcgttcaatcagggcactccatttttcaggtaattccaatcttgaatctgctgtaaactggcttctggaacatgaaagtgacccagacattgatcagctaccattgattccacgagaaatccccattgaatgcggtgacacatcaaatgaagtaagaaatgacattcaaggaatgagggatcccgtgcaggagcagaaacgagaagaacggactgaaactggaagacagaatgagacatcccagttggaacgagaattaaatgcagatgaacaggaggaagaagatagaaagaggatattagcactatataagcaaaaacgagatgaggaaggaagagcaagagagcaaaaacgaaatcagttacaagatgatcagaggggagaggattcgagcttctaaagatcttatggaagcaaaacgaactcttgaggaaaatcaaagaaagcgcatgatggaaagtcgtatagcagatcamgaagaggagaaaagagcaagagagagaatacmacagcgtrtmwcmgatgataggggcagaaagmacgagaaggcttcctttgccgccctacaatcctgctggggcttcccttccgatcactacgccctcttgggtatgtcctgctggggcttcagttccgatctcgcctcccacctcggtaaaacctgctgggccttcacttccsmtcacwmcscccaccawggtaaamcctgctgggccttcagttccgatcacaacgcccacmaagcaggtaaaacctgttgaacgtgttgtaacttcagaacagctgagagattgcctgcgaactctgaagaagaatcacaaggatgacagtgccagagtcacaagagcataccaaacattgttgaagattatcgccaacattgttaagaacccagcagaggacaagttcaggaggattcggctcagcaaccctattttcaaggacagggtgggtaacctgcaaggaggcatagaattcctggagctgtgcgggttccagaggctcagcgccagcggctacctggtgatgcccagggacaggatcgacatgacgctcctcaacgccgccggagtcgagatcgcgtcggccatggagaacccctacttcgggctgctctccaagtgaacggaacagccactatcgatgttctcgtctgcttggtcgagtactgactgaaacggggtgtgcaaccagacggacttcatcgtaacgtgtcggggcgtcacggctgactggatctgtccccattgccagtgccattgtacagtcacccatcagaacaaatgtaccaaatctcatcccggagaaataaaatggaaccatgtacattggtgc

SEQ ID NO: 33292 - protein, 154 aa, Panicum virgatum
  misc_feature: Ceres CLONE 1949986
  misc_feature (6)..(43): Pfam Name: UBA Pfam Description: UBA/TS-N domain
  misc_feature: SWISSPROT Homolog: EC 3.1.2.15 Ubiquitin thiolesterase
MAVPQVDKKMLSELESMGFPTTRSIRALHFSGNSNLESAVNWLLEHESDPDIDQLPLIPREIPIECGDTSNEVRNDIQGMRDPVQEQKREERTETGRQNETSQLERELNADEQEEEDRKRILALYKQKRDEEGRAREQKRNQLQDDQRGEDSSF

SEQ ID NO: 33293 - DNA, 1060 bp, Panicum virgatum
  misc_feature: Ceres CLONE 1950000
  misc_feature: Encodes the peptide sequence at SEQ ID NO. 33294
aggttatctccgtttcttaaaccctttcccttctgtcggactctcttctcttgctcttctttccctggcggcgacgaccgggcgagcggcggcgacatttgtcacttctttgcccagccctgtgccggcgacgagcatccaccagattcaccatgagtaatgccggcactagattgctgaaaggcttgaggagggtcttagaacagcaaaagatttcagccgttttctgcagacgatctcaagcttggagttctactgtctctttttctgaccttgatgagaagggtgatatggactttgacaatgattataccgattcaaagagagagttacagccccagagcgtagatcccaaaaagggttggggattccgcggtgtacacagggctattatctgcggcaaagttggacaagtgcctgtgcaaaaaattttaaggaatgggcgtacagtaactgtttttaccgttggaactggtggcatgtttgaccagagggtaattgggcctgaggatttaccaaagccagctcagtggcatcgaatagctgttcataatgaccacctaggtgcttatgctgttcagaagctggtgaagaattctgcagtctatgttgagggtgatattgaaaccagggtctacaatgacagcattaatgatcaagtcagaaacatacctgagatatgcgtacggcgcgatggcaagatttgtctggttaaatcaggggacagtgctgctaacatatcattagatgaactcagagaagagctgttctagtgatagttaaggatgtcagtgcaagcagatcatgaggttgcttcttgcttgaggcacattgtatcttgtgcagtgcactagctggtgaaggcctatgatctgcgtcgaaggctgctggtcacatggccgtagctgtgatgaaggtacgaatagcagcagaagcctgtagttgattggaaaatgccgtaaaacttgggttcacgcctccatttctgattgtatttcttcctccatgttttcagcacataaacaatggtctatgaagcaactttttttttcgttgaagc

SEQ ID NO: 33294 - protein, 206 aa, Panicum virgatum
  misc_feature: Ceres CLONE 1950000
  misc_feature (76)..(187): Pfam Name: SSB Pfam Description: Single-strand binding protein family
MSNAGTRLLKGLRRVLEQQKISAVFCRRSQAWSSTVSFSDLDEKGDMDFDNDYTDSKRELQPQSVDPKKGWGFRGVHRAIICGKVGQVPVQKILRNGRTVTVFTVGTGGMFDQRVIGPEDLPKPAQWHRIAVHNDHLGAYAVQKLVKNSAVYVEGDIETRVYNDSINDQVRNIPEICVRRDGKICLVKSGDSAANISLDELREELF

SEQ ID NO: 33295 - DNA, 1030 bp, Panicum virgatum
  misc_feature: Ceres CLONE 1950004
  misc_feature: Encodes the peptide sequence at SEQ ID NO. 33296
taacctactacttggtccgacacttgcagcgtaccacagtctaggcctctacagttgtagttgtagattcgtttcgcgcctcttgcttgggccaatcaccaagtcgtcttctgttcaaccactgtgctcagctgtgccatcaattagttagtcatacatgtaattgtcatactgacagacgacataaaagaactaggtcggaagggggatacattgaaggtgcgagctggattctaccgcaatttcctccttcccaagggcaaggccacgcttctaaccccagaagtcctcaaggaaatgcaactcgaacaggagagaatagaagctgagaagaagcgggtcaaagaagagtcacaacaacttgctcgagtttttgaaaccatcggggctttcaagattccacgcaaaggcggaaaaggaaaacaaatctttggaagcgtcacagcacaggatgttgttgacataataaagtcacaacttaatagagatgtcgacaagaggcttgtgacagttccagaaatccgtgaaaccggggagtatgttgcagagattaagcttcacccggatgtgacagctcgagtaaggctgaatgtctatgcgaaatgagatgtgcagttactgaagctgaatggacggtgggggtctgggggagcctgatttcgccagagattttgctgaaaatgccaggcgttgtggtagaaaaatggaggtctggactggttcatcctgcctgtaaagttaattttcagtttgttgatttcgtggagtgaaaactagaaaagtttgtaaaccacagttggtttgaccgcagtttgtaaaccacagttggtttgaccgcagtttgtaaaccacagttggtttgaccgctgaagcatcccttgcatgtttatcatggctgaagaaaaatggctgcagcctttagcaaaaacagttagttcgatgaacaggcccccaaaggtagatgcgacaatcggctttccagggatatgttttcatttgtgttcgtcatatatatattttttttttgagc

SEQ ID NO: 33296 - protein, 102 aa, Panicum virgatum
  misc_feature: Ceres CLONE 1950004
  misc_feature (16)..(102): Pfam Name: Ribosomal_L9_C Pfam Description: Ribosomal protein L9, C-terminal domain
MQLEQERIEAEKKRVKEESQQLARVFETIGAFKIPRKGGKGKQIFGSVTAQDVVDIIKSQLNRDVDKRLVTVPEIRETGEYVAEIKLHPDVTARVRLNVYAK

SEQ ID NO: 33297 - DNA, 498 bp, Panicum virgatum
  misc_feature: Ceres CLONE 1950011-R
  misc_feature: Encodes the peptide sequence at SEQ ID NO. 33298
taggaatctgcctctaagaccaattagcacttgccctgtaataagtttagtggacactccagaagttaaggcaccccctgaacctgtgaaggaggttcccaaggagccaaagttcacctgccctatatgcatgaatgagctgacagaagcagcatccactgtctgcggtcacattttctgccagaagtgcatcaaggctgccattcaggctcagaagaagtgccctacctgccgaaagagccttaataaaaaccagcaccaccgggtatacctcccgacaacggagtaatccgatagtcattttggagcaagctgtgcagcacctgaccttcaccacattgtggcgattgtatggcggagctatttagagaggcttatcgatagcaatagagtattactgcgatttaacaagtggttttgccctcgcatgtgggacatcatgccaagctgtatcctcagtaaagtatatcctagtatcatctggatgtgggtgttatc

SEQ ID NO: 33298 - protein, 95 aa, Panicum virgatum
  misc_feature: Ceres CLONE 1950011-R
  misc_feature (40)..(77): Pfam Name: zf-C3HC4 Pfam Description: Zinc finger, C3HC4 type (RING finger)
  misc_feature: The sequence is a functional homolog of SEQ ID NO 2446 in the 10/374,780 US patent application
  misc_feature: The sequence is a functional homolog of SEQ ID NO 736 in the 10/225,066 US patent application
RNLPLRPISTCPVISLVDTPEVKAPPEPVKEVPKEPKFTCPICMNELTEAASTVCGHIFCQKCIKAAIQAQKKCPTCRKSLNKNQHHRVYLPTTE

SEQ ID NO: 33299 - DNA, 696 bp, Panicum virgatum
  misc_feature: Ceres CLONE 1950011
gaaaaaaaaccacaagtcttcctgccagctcgcaaccacaaaccctagtcgctcctcgcgactcagacgacgggctcgattcgttcctgtgtcctgttggcttcgctcaagcctgtatcttttactgcaacactatgaactcccctggcgctggaaggcggattccgaagaggcgacggacgactaagccgctttcacagccttttgacctgaactgcccccctgctgaaggggctggtgaggggggttcacctttcagcattatgcctgtctcacacatccaggcttccagcagtatgcctgtctcacacagtcaggcttccagtagcatgccacctgctactaatgagccacatattggcatgcatagttgccccattgatgtggaagccattgatgatgatgttgttatctattcttcaagatcactccctcaagtatgttattgtgcctttttctagtctctatttgtacatttgcatatttattttagtcaaattttgtttcttatatgattgtttaaagcggaagaatgacactgataatcaagttgtttgctttaaagtttcaggcaaggcaacagtcgaccgggactgaacgtattactgtgataatagatgatgattctgaaacgaacccagaaccagcaggggatgctcttgatgagcatgtgaatacactgctatccctgggcat

SEQ ID NO: 33300 - DNA, 1064 bp, Panicum virgatum
  misc_feature: Ceres CLONE 1950012
  misc_feature: Encodes the peptide sequence at SEQ ID NO. 33301
cttgttgtactcctgctattacccatccctgtcccaatcaactgatcgcccgcaaaacgagtagcagctgcagcaaggcaggcaggcgggcttgattcgccgaattcgcaggcgcagtttactcaattcacaccatgacttctttggacactgtgagaggagatcttgctttggtcattttgtacctaaacaaggctgaagcaagagataagatctgcagagctatacagtatggatcaaagtttctgagtaacggagaaccagggccagcgcagaatgtcgacaagtcaactagtctagctcggaaagttttcaggctttttaagtttgtcaatgacctgcatgctctaattagtcctcctgccaaaggaacgccacttccgctgatcttacttggaaagtcgaagaatgcaatgctgtcaactttcctcttcctggatcagattgtgtgggctgggaggacaggaatatacaagaataaggagcgagcggagttcctcagccggatagctttctattgcttcctcggttctaatacctgcacaaccattattgagcttgctgagctccaacggttatctgaatcgatgaagaagctagagaaggagctcaaacaccaagtgctgtacaagaacgagcaataccgaatgaagctgcagaagtccaacgagcggcgtctggctctgatcaagtcgagcctggacatagttgttgccgtggggctgcttcagctggcccccaaaaaggtgaccccccgcgtcactggggcgttcggctttgccagctcactgatcgcttgctaccagttgcttccgagcccacccaagagcaagtgatgcgatctgtagagggcagctggtggctccatccgctactgatggcatcgatgacgacaaataaatccggaagaaactctccgtgtagcatgtttggtagacacttgtattgttgacttggttatagtccattgtggctgattattgtacgatccaagttgtagcttgcggtgccgggacttgtcatcagttttcacgaaataagaaatggcccggaacttgtcattt

SEQ ID NO: 33301 - protein, 233 aa, Panicum virgatum
  misc_feature: Ceres CLONE 1950012
  misc_feature (11)..(226): Pfam Name: PEX11 Pfam Description: Peroxisomal biogenesis factor 11 (PEX11)
MTSLDTVRGDLALVILYLNKAEARDKICRAIQYGSKFLSNGEPGPAQNVDKSTSLARKVFRLFKFVNDLHALISPPAKGTPLPLILLGKSKNAMLSTFLFLDQIVWAGRTGIYKNKERAEFLSRIAFYCFLGSNTCTTIIELAELQRLSESMKKLEKELKHQVLYKNEQYRMKLQKSNERRLALIKSSLDIVVAVGLLQLAPKKVTPRVTGAFGFASSLIACYQLLPSPPKSK

SEQ ID NO: 33302 - DNA, 619 bp, Panicum virgatum
  misc_feature: Ceres CLONE 1950014
  misc_feature: Encodes the peptide sequence at SEQ ID NO. 33303
atcacgtttccccctggcacagccagcgcctctgtgtgtgcacggaagcaagcgcgttacagagcgcagagccaccacacccctcgatctcgcctccgccgccgcctcctttagatattgcctcatatggctcccgcggcgctgctccaccctgccctccgcaaaaaaagcgatgacgatcaacgtggatgcaacggtcaacgccatggaacctatcctgacgtgcagcgacgtgatgacgaattcctgatgtcgaacaagagtgacttgatgaacaagtattacaatcttgtaacgcgcttcactgaataccacgggggtcaatcattccatttcacccagtgatggcgtggagaaaccattcgtgaaaacatcaagaaatttgagctttttattgcccttcaattggggttcaagaaggaaatgaaggtcctggatatatgatgtacaattgggggacccttaagagaaatctccagaatcatctcaaaagaaataactgggttgaacaacaatgcttatgagatattgaggggaaatgatcgcattttctttgacaagtttgagtgaaccagtgtaactttataaagggagacttcatgaagatgccattggatga

SEQ ID NO: 33303 - protein, 72 aa, Panicum virgatum
  misc_feature: Ceres CLONE 1950014
  misc_feature: SWISSPROT Homolog: EC 2.1.1.41 Sterol 24-C-methyltransferase
MAPAALLHPALRKKSDDDQRGCNGQRHGTYPDVQRRDDEFLMSNKSDLMNKYYNLVTRFTEYHGGQSFHFTQ

SEQ ID NO: 33304 - DNA, 475 bp, Panicum virgatum
  misc_feature: Ceres CLONE 1950014-R
  misc_feature: Encodes the peptide sequence at SEQ ID NO. 33305
gcgatgcgtactaccttcctgactggtgctcaccctcagactatgtgagcatcgccaagtctctgtctctcgaggatgtcaagacagccgattggtcggagaacgtggccccattctggccggccgtgataaaatcagcactgacatggaagggcatcacctctctcctgacaagcgggtggaagacgatcagaggggcgatggtgatgccgctgatgatccagggctacaagaaggggctcatcaagttcaccatcatcacctgtcgcaagcccggaggagcgtaggaggtcaagttaccgtcgcggcgcctctgttcggcgcaataacgtagaaccaaatacctaccaatggcgagctagaaactagaaggcgccccgtcgtcgtcttctctttctttctgtacgcgcacgcacgtttggccatgtgccccattcccaataattttctaccactcgttgagatagcagatttc

SEQ ID NO: 33305 - protein, 94 aa, Panicum virgatum
  misc_feature: Ceres CLONE 1950014-R
  misc_feature: SWISSPROT Homolog: EC 2.1.1.95 Tocopherol O-methyltransferase
  misc_feature: The sequence is a functional homolog of SEQ ID NO 22 in US patent 7226745
  misc_feature: The sequence is a functional homolog of SEQ ID NO 36 in US patent 7244877
  misc_feature: Functional homolog of the protein sequence given in SEQ ID NO 50201
  misc_feature: Useful for making plants with modulated nitrogen use efficiency
DAYYLPDWCSPSDYVSIAKSLSLEDVKTADWSENVAPFWPAVIKSALTWKGITSLLTSGWKTIRGAMVMPLMIQGYKKGLIKFTIITCRKPGGA

SEQ ID NO: 33306 - DNA, 894 bp, Panicum virgatum
  misc_feature: Ceres CLONE 1950023
  misc_feature: Encodes the peptide sequence at SEQ ID NO. 33307
aacctgccctctcatctcatccttgttgcccgcctaccgccgccattctgcgctgcgcctccaccgctccacgctctcccgctgctctcaccaccgtctcgcgcgaagctactgagctcaagctagagaagatgtatacggcaaggaggaagatccagaaggacaagggtgtggagccaactgagtttgaggacacagttgcccaggcgttctttgacctcgagaatgggaatcaggagcttaagagtgacttgaaggacctttacatcaatggagcagtgcagatggacatgcctggcaacaggaaggctgttatcatccatgttccatacaggctacaaaagtcttacaagaagattcatgtgaagcttattcgggagcttgagaagaagttcagtgggaaggatgttgttctggttgcgactagaagaattgtgcggcccccaaagaagggttcagctgttgttcgtccccgtagctgcactcttaccaccgttcatgatggcattttggaagatgttgtgtatccggctgagattgttgggaagcgtgttaggtaccacttggatggtgcaaaaatcatgaaggtcttcctggatccaaaggagcgtaccaacactgagtacaagcttgacactttcagctcagtctaccggaggctttgtgggaaggaggttgtgtttgactaccccatggctgagagcgcttgagcccccttgtcctttagtcagctggctattacaatatgtttcgtctatctgaaacagacattaccatatatttcatgtgtgaaatagtgttcaacatcctgggacatgccaatctcgtttcttcttaaagctgtcttggattctgcaaatgttttgcattgcagtgcattatatatctgctgat

SEQ ID NO: 33307 - protein, 192 aa, Panicum virgatum
  misc_feature: Ceres CLONE 1950023
  misc_feature (6)..(191): Pfam Name: Ribosomal_S7e Pfam Description: Ribosomal protein S7e
  misc_feature: Functional homolog of the protein sequence given in SEQ ID NO 50192
  misc_feature: Useful for making plants with modulated biomass
MYTARRKIQKDKGVEPTEFEDTVAQAFFDLENGNQELKSDLKDLYINGAVQMDMPGNRKAVIIHVPYRLQKSYKKIHVKLIRELEKKFSGKDVVLVATRRIVRPPKKGSAVVRPRSCTLTTVHDGILEDVVYPAEIVGKRVRYHLDGAKIMKVFLDPKERTNTEYKLDTFSSVYRRLCGKEVVFDYPMAESA

SEQ ID NO: 33308 - DNA, 513 bp, Panicum virgatum
  misc_feature: Ceres CLONE 1950042
  misc_feature: Encodes the peptide sequence at SEQ ID NO. 33309
aaaacaaaccctgaccagaacccctcgccgccgacctcagttcccgaccgccaccgtctccggcgatgtcgcacttcaggcgctccggggcgccggagaaccgcgactccttctccctcctcgtcctcaacgtctccttccgcactacggccgacgacctcttcccggtcttcgaccgctacggcgatgtcgtcgacatcttcatcccgcgcgaccgcaggactggagattcgcgtggcttcgcgttcgtgaggtacaactacgaggacgaggcgcagaaggccgtcgacgggcttgatgggaggaaggtggatgggagggtgatcatggcgcagttcgcaaagtacggacccaatgctcaaaagattcataggggtaggattacagaagaaacttcaaagccaaggggtcatttcagaagccgcagtccgagatggaggtatcaaaatgattatcgggacagagattatagaaagcaaagccggagcagaagtagggagaggtatgaacagg

SEQ ID NO: 33309 - protein, 149 aa, Panicum virgatum
  misc_feature: Ceres CLONE 1950042
  misc_feature (18)..(89): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSHFRRSGAPENRDSFSLLVLNVSFRTTADDLFPVFDRYGDVVDIFIPRDRRTGDSRGFAFVRYNYEDEAQKAVDGLDGRKVDGRVIMAQFAKYGPNAQKIHRGRITEETSKPRGHFRSRSPRWRYQNDYRDRDYRKQSRSRSRERYEQ

SEQ ID NO: 33310 - DNA, 136 bp, Panicum virgatum
  misc_feature: Ceres CLONE 1950042-R
ccccttttggaactccatccatatttagatattgtcatctcaatacggtttcttactgtagcctgtgacctgtatatttctagttacttgatggaacgaagaggggtttttttggataaaggtcaggatgcaagtt

SEQ ID NO: 33311 - DNA, 1282 bp, Panicum virgatum
  misc_feature: Ceres CLONE 1950087
  misc_feature: Encodes the peptide sequence at SEQ ID NO. 33312
atcccgtggtcgccgccgcatccaaagccactcccaaacccccgcttcccgtaccttctcgaagctccccgtggccgcctccacccgctccgatggccaaggaaccgatgcgcgtgctcgtcactggcgccgcaggacaaatcggatatgcgcttgttcccatgattgctagaggagttatgcttggtacagaccagcctgttattctgcacatgctcgacattccgccagcggctgaagctcttaatggtgttaagatggagttggttgatgctgcatttcctcttcttaagggtgttgttgcaacaactgatgttgtggaggcttgcactggtgtgaatgttgcggtcatggttggtggattccccaggaaggagggaatggaaaggaaggatgttatgtcaaaaaatgtttcaatctacaaagctcaagcatctgcccttgaagcccatgctgcccccaactgcaaggttctggttgttgccaacccagcaaataccaatgctcttatcttgaaagaatttgctccatctatccctgagaggaatgttacttgcttgacccgcctggaccacaacagggctcttggccagatttctgagagacttaatgttcaagtcagtgacgtgaagaatgttattatttggggtaaccactcgtccactcagtaccctgatgttaaccatgccacagtgaagacttccagtggagagaagcctgtttgtgagcttgttgctgatgatgcatggcttaatggggaattcatcacaaccgtccagcagcgtggtgctgcaatcatcaaggcgagaaagctctccagtgctctttctgctgccagctctgcttgtgaccacattcgtgattgggttcttggaacccctgagggaacatttgtttccatgggtgtgtactccgatggttcgtacggtgtgcctgctggactgatctactcattcccagtaacgtgcagtggtggtgaatggaaaatcgttcaaggccttcccatagacgagttctcgaggaagaagatggacgcgactgcccaggagctgtcagaggagaaggcgcttgcttactcatgcctcgagtaaactctacccatactcagagcaattgctgctcctatgttttgaataaaagaaactccagcgtcattcatagattctctcactcagaactgctgcacatctgcggtgcaggtcgctggcttcgcccagtgtgcatgaggcttgtagccctttttgccagatgatctgcaggacatttattgaaacttgcaact

SEQ ID NO: 33312 - protein, 332 aa, Panicum virgatum
  misc_feature: Ceres CLONE 1950087
  misc_feature (157)..(331): Pfam Name: Ldh_1_C Pfam Description: lactate/malate dehydrogenase, alpha/beta C-terminal domain
  misc_feature (6)..(155): Pfam Name: Ldh_1_N Pfam Description: lactate/malate dehydrogenase, NAD binding domain
  misc_feature: SWISSPROT Homolog: EC 1.1.1.37 Malate dehydrogenase
MAKEPMRVLVTGAAGQIGYALVPMIARGVMLGTDQPVILHMLDIPPAAEALNGVKMELVDAAFPLLKGVVATTDVVEACTGVNVAVMVGGFPRKEGMERKDVMSKNVSIYKAQASALEAHAAPNCKVLVVANPANTNALILKEFAPSIPERNVTCLTRLDHNRALGQISERLNVQVSDVKNVIIWGNHSSTQYPDVNHATVKTSSGEKPVCELVADDAWLNGEFITTVQQRGAAIIKARKLSSALSAASSACDHIRDWVLGTPEGTFVSMGVYSDGSYGVPAGLIYSFPVTCSGGEWKIVQGLPIDEFSRKKMDATAQELSEEKALAYSCLE

SEQ ID NO: 33313 - DNA, 1005 bp, Panicum virgatum
  misc_feature: Ceres CLONE 1950105
  misc_feature: Encodes the peptide sequence at SEQ ID NO. 33314
atcgccacaagttcgcgatctctcgatttcacaaatcgccgagaagacccgagcagagaagttccctccgatcgccttgccaagatgcagatctttgtgaagacactcactggcaagactatcacccttgaggtggagtcttctgacacaattgacaatgtcaaggcaaagatccaggacaaggaagggattcctccagaccagcagcgccttatcttcgctggcaagcagcttgaggatggccgtacacttgcagattacaacattcagaaggagtccacactgcaccttgtcctcaggctgcgtggaggcatgcagattttcgtgaagaccctcactggcaagacgatcaccctggaggtggagtcatctgacaccatcgacaatgtgaaggcaaagatccaggacaaggagggcatcccccctgaccagcagcgcctcatctttgcaggcaagcagttggaggatgggcgaactctggctgactayaatatccagaaagaatcmaccctgcacctsgtsctccgcctgcgtggtggaatgcagatctttgtgaagacgcttaccggcaagaccatcaccttggaggtggagtcttcggacaccatcgacaatgtgaaggcgaagattcaggacaaggagggcattcctccggaccagcrgcgcctcatctttgctggcaagcagctagaggacgggcgtaccctggcggattacaacatccagaaggagtccaccctccaccttgtcctgcgcctccgtggtggtttctgagcctagtgctcctgagttgccttttgtcgttatggtcaacctctggtttaagtcgtgtgaactctctgcattgcgttgctagtgtctggttgtggttgtaataagaacatgaagaacatgttgctgtggatcacatgactttttttttttgaaccggaagatcacatgactttcatggctttaagttcctgaactctgaaatctggacccccttttaagctctgaactcat

SEQ ID NO: 33314 - protein, 229 aa, Panicum virgatum
  misc_feature: Ceres CLONE 1950105
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(226): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
  misc_feature (193)..(193): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQXRLIFAGKQLEDGRTLADYNIQKESTLHLVLRLRGGF

SEQ ID NO: 33315 - DNA, 1034 bp, Panicum virgatum
  misc_feature: Ceres CLONE 1950114
  misc_feature: Encodes the peptide sequence at SEQ ID NO. 33316
gaactaaactgtaccccgaacagagccgtgcgctgcacgccggcgttggtagggtcgtcgtcgtcttgccgtcgcctgagaagaatcttatccagttccaccgagttgccatgctatcgatccatgtcatagaagtatggtaacatctggtaccagagactcgatcctggcatctcacgatcaccagatgcgccttcaagtcaccatgaagacggatgaacaatttgagcgtattctcaagatgctctaagaaaacaagcaagggatggttgagatcaaggccacgatgacggagatgcgtttggcgaaggatgaattcgaagcttggaaacccgaagtcgacaagagtgttgccgatctgcagatcgccgtcaacaccctcggccaccgcttcgacaagctcttctccaacaccgtccctgcctccccgcatctggatgcacccatcactcaccctgcaccagagattgtgggatcttcaccggcgctggccactgcccatctggtggcgacctccaaggaggctgcatttgggccacatggccatcgcgtcgaaacacacaactgggggtctggatttggagtggtgtataccattcctcatccgtctccagtcatagatgatctacagattccaatgtttgtgctcgaccgtcatccgcatcgatatcaagacaagatgatcacgcaagttctggtacaatggtcacactggcctgtggaactttctacttgggaagatgaggaagcactacgccagcagtttcctcgtgctccggcttggggacaagccggttctgaagaagggaggaatgttaccgcccgtgttgtgcctagatggcgtcatcgccttcggaggcgcgcgctccaggaaggcgttttttccaaaatcagctttagaattgctgggcctgattgggtccgttaaaactcagcccttgtaatagcgtagcccatttttctttcttgattgagtgtcatgaggatataagtcttgccgtcgcctgagaagaatcttatccagttccacccgg

SEQ ID NO: 33316 - protein, 220 aa, Panicum virgatum
  misc_feature: Ceres CLONE 1950114
  misc_feature (122)..(176): Pfam Name: Chromo Pfam Description: 'chromo' (CHRromatin Organisation MOdifier) domain
MVEIKATMTEMRLAKDEFEAWKPEVDKSVADLQIAVNTLGHRFDKLFSNTVPASPHLDAPITHPAPEIVGSSPALATAHLVATSKEAAFGPHGHRVETHNWGSGFGVVYTIPHPSPVIDDLQIPMFVLDRHPHRYQDKMITQVLVQWSHWPVELSTWEDEEALRQQFPRAPAWGQAGSEEGRNVTARVVPRWRHRLRRRALQEGVFSKISFRIAGPDWVR

SEQ ID NO: 33317 - DNA, 1103 bp, Panicum virgatum
  misc_feature: Ceres CLONE 1950132
  misc_feature: Encodes the peptide sequence at SEQ ID NO. 33318
aaaaacagcctccaccgcacacactgacaggctcccgacgcgcctccgccggccgcgcgcggttgccctgccctctctccgccgctcctccaccggtttctccaaccatgtataataactatgggaaccctcctgggatgcagatgccacagcagaattctcagccgggccagtttaacaatccattatatggtgcaagctcaggtctaattagatctgggctaggagtatatggggagaagttcttggattctagttcagaattcatgcaaagcaatatcaatagatacttctccaacccgcagtattacttccatgtgaatgatcaatatgtcaggaacaagttgaaagttatattgtttccattctttcacagggggcactggactcggataagtgaacctgttggtgggcgtttgtcctacaaacctccaatctatgacataaatgcaccagatctgtacatccctttcatggcatttggaagcttcatcattcttgctggttttacattaggtttcatgggaaagtttactccagaagctataaatctgcagttttccagggcactcattggatgggccttccagctcgtgatactgaaaggtttgctctactcaatgggcggtggtgaggtgccacttctcgacttggtagcatatggtggctacttatttgccgggctatcccttgctgttgttgtaaggctcatatgggcatactcgtattacatcatgatgccatggatgagcctgtgcatgggagtgttcttggtgaggacaatgaagagggtgcttttcacagagatgagaagcagcgagaggcactcatcgcgacagcattacttccttctcttcatggcaatagcacagtttcccctgttcttctggcttggcagcataggtgcatgatacagtttcctgtttgttttagttttgcggttcacattacaagtgatatttaagtatttaaatgtgttgtaaaaatagttggagaattgatctcaacaactgaagcagtttgagcatcaacagtatgttattgaccgactgtatagatcaagagtgctgcttgtgaagttatatgtgatgcttcccagactc

SEQ ID NO: 33318 - protein, 267 aa, Panicum virgatum
  misc_feature: Ceres CLONE 1950132
  misc_feature (34)..(263): Pfam Name: YIF1 Pfam Description: YIF1
MYNNYGNPPGMQMPQQNSQPGQFNNPLYGASSGLIRSGLGVYGEKFLDSSSEFMQSNINRYFSNPQYYFHVNDQYVRNKLKVILFPFFHRGHWTRISEPVGGRLSYKPPIYDINAPDLYIPFMAFGSFIILAGFTLGFMGKFTPEAINLQFSRALIGWAFQLVILKGLLYSMGGGEVPLLDLVAYGGYLFAGLSLAVVVRLIWAYSYYIMMPWMSLCMGVFLVRTMKRVLFTEMRSSERHSSRQHYFLLFMAIAQFPLFFWLGSIGA

SEQ ID NO: 33319 - DNA, 691 bp, Panicum virgatum
  misc_feature: Ceres CLONE 1950135-R
  misc_feature: Encodes the peptide sequence at SEQ ID NO. 33320
tgttttaaaaggatattatggtgagtgtggtaaaaagaggaggctacatggagattactggcttcagtgcttccgtaagagagcaggtctacaagatagcttcggtgaacttatgctccaatatcactggtcaaatccttgccagccttatcatgaatccaccaaaggaaggggatgaatcatatgctgcctacaaggcagagaaagatggaatccttcaatctctagctcgtcgtgcaaaggcattggaggatgcattcaacaatcttgagggaatttcgtgtaacaaggctgaaggagcaatgtaccttttccctcagattcatctgccacagaaggcaattgaggctgctaaagcagctaagaaagcacctgatgcattctatgcgcttcgtctccttgaagcaactggaattgttgtggtccctggatccgggtttggccaagttcccggaacatggcatatcaggtgcacgatcctgccgcaggaagacaagatccccgccgtgatcacccgcttcaaggcgttccatgaggcgttcatggccgagtaccgcgactaagctgttacaccatgtgaatgaacatggggtcatgtaatttatttttttgtaatatcagtctgtaatttgaactcgaactctcctgcttcttcccttatatgaaagcgcagtgctcctgcaaacttttc

SEQ ID NO: 33320 - protein, 181 aa, Panicum virgatum
  misc_feature: Ceres CLONE 1950135-R
  misc_feature: SWISSPROT Homolog: EC 2.6.1.2 Alanine transaminase
  misc_feature: Functional homolog of the protein sequence given in SEQ ID NO 51391
  misc_feature: Useful for making plants with modulated nitrogen use efficiency
MVSVVKRGGYMEITGFSASVREQVYKIASVNLCSNITGQILASLIMNPPKEGDESYAAYKAEKDGILQSLARRAKALEDAFNNLEGISCNKAEGAMYLFPQIHLPQKAIEAAKAAKKAPDAFYALRLLEATGIVVVPGSGFGQVPGTWHIRCTILPQEDKIPAVITRFKAFHEAFMAEYRD

SEQ ID NO: 33321 - DNA, 1256 bp, Panicum virgatum
  misc_feature: Ceres CLONE 1950135
aactgctcggccacaagctcggcacatgtgagttctccccccgtcctctcctaattttctagtgtttgtactcctctcctgattccctgtgcagcccttgcaaatctcggacattatactcttctccaagaaccactccttgttcatctttttgcttgttactccttgcctaggtcagcctcccaactttgtagtgcataatgtctgtgtgcttttctgtctggttcaaagcccatacagatctaggaggcacatagcaatgggcatctgatgctcactttggccttttgagaggacgcctcatctactctacctagaagtgccccccaagcagccatagacattcaattatattaccctgctaataattttaattttttaatcgaaattgcttcatagcaagtttttagaattcaatactatttgcctttttgagtagccattataattgtacatactatcttggtttagttagaaggcacatagagatgctgttgacgaagtcaggttggctgattcagattgcagcagaattcttttattagaggtgttctttgaggagccatacattagcattttcatgcttctgtttgtttctgttgccctctgcttatcagattttctagaccggatggctttatatggatatagaacaaacactcataaggcaaattctttacaacacatgatgtgcttctcgaataaccaattgctgtgatttgtatatttgcatttggttccgacaggtgcacatagcaaatggatcttttgagggaagggatcttgttctttgttcatcccttcttagattgattccgacagtaacatctatttctatgtcagtcttttcttttcttaattttattctttttgttttgcaaggaaagcacctcttcacacttcacattccacaaaatgaaccgcgcctgccaagctgcccaaatcggcacaggaccgagaacagagcacggccgtcgctcttgcctttgacacacacattgcctttcaaaatctgtatatgaacatacattgtctttcgtaataaattcagcaaaagaggctacatgacatgagaatttggtaaattccgatttgaaacaacaaaaaatcaccttcagtcagtaacaaatatcagttgcatatcagttgttcagttcgggttgcataacatagcaacgcacaaacagcagcctactggtacgaggatctggtgagccctcctctctcctccttgtcgtgccctggttgagctcctg

SEQ ID NO: 33322 - DNA, 619 bp, Panicum virgatum
  misc_feature: Ceres CLONE 1950164
  misc_feature: Encodes the peptide sequence at SEQ ID NO. 33323
attttcactccctatccagtttatcctctccctaatggcgcttcctctgcgccccgccgctccggcgccaccgccttggcgatgctccggcttgaggtcctcgccgcacgcatccctcctggacacggcctccaagcaaacatttcctgttccattaccagctgaccgggttgcaagattttccttatctgcaaagcgttctgcatctcggcttgtccagtcaatgactgatctcaccggttttagaagtgatgggatccatgcagccaatgaacattcacgtgatctcatgaggtccatatctgatcttcaggtacgatggaagttgtattatcctcttttgggaaagcatgtattttcggtagttgcatcatatatgttctgcctcctgcttgtttagcagaaccatgcgagcaagagtactctctccctaacatgcctttgctgtttgcaatagccatggttggtgctactgttggagggctcctcgcaagacagaggagaggggagcttgcacggctgaatgatcagttacgtcagataaatgctgcactgagaagacaagccaagattgaatcttacgctcctactttgagctatgccccagttggtagtaaga

SEQ ID NO: 33323 - protein, 100 aa, Panicum virgatum
  misc_feature: Ceres CLONE 1950164
  misc_feature: Functional homolog of the protein sequence given in SEQ ID NO 51436
  misc_feature: Useful for biocontainment applications
  misc_feature: Useful for making plants with altered alkaloid content
  misc_feature: Useful for making plants with altered lignin content
  misc_feature: Useful for making plants with modulated biomass
MEVVLSSFGKACIFGSCIIYVLPPACLAEPCEQEYSLPNMPLLFAIAMVGATVGGLLARQRRGELARLNDQLRQINAALRRQAKIESYAPTLSYAPVGSK

SEQ ID NO: 33324 - DNA, 273 bp, Panicum virgatum
  misc_feature: Ceres CLONE 1950164-R
  misc_feature: Encodes the peptide sequence at SEQ ID NO. 33325
aggacgcgggtgtcactgaagcatatggagcaatagcagactgctacaccgagcttggtgagcttgagaaggctggcgagttctacgacaaatacattgcaaggttggagagtgactgaaaagaagagcaccgatcagaaaatatgttagagcattgacaagtctaatggaatttctaccctttttcgcttgtcatgtagtttattgtagatttgcagttcccagatcgaattgagttttattaccaccaagcaaattctttttggcaggatt

SEQ ID NO: 33325 - protein, 38 aa, Panicum virgatum
  misc_feature: Ceres CLONE 1950164-R
  misc_feature: Functional homolog of the protein sequence given in SEQ ID NO 51436
  misc_feature: Useful for biocontainment applications
  misc_feature: Useful for making plants with altered alkaloid content
  misc_feature: Useful for making plants with altered lignin content
  misc_feature: Useful for making plants with modulated biomass
DAGVTEAYGAIADCYTELGELEKAGEFYDKYIARLESD

SEQ ID NO: 33326 - DNA, 1055 bp, Panicum virgatum
  misc_feature: Ceres CLONE 1950171
  misc_feature: Encodes the peptide sequence at SEQ ID NO. 33327
atcaagtgatcattcgcacttgcaaccttgcattgcattactagtagagagagatggccagagaaatggagaaggcaaggaaggccactacttcccctaagatctcaacgatgaatgctggtccaaagagcccagtaaggaatggaggaggtaattctccgcctcctaagaagaacacctctgagccacgaggacggaaaaatgagcagcaaatcgttcggaaaggaggtcaagaccatgatgagggcaaacgccgatctccaacttcacaaacctcgcccaagagatcaccaagactcgatcaacccctgagctactgtaggcttcatactgaggagagagcaataaggcgagccggttacaattatcaggttgcgagcaagataaatacacagcaaatcattcggagatttgaagagaagttagcacagttgatggaggagcacgaaataaagctgatgaggaaggagatggttcctaaggcccagctcatgccagcgtttgacaaaccattccacccacaaaggtctactaggccgctgacagtcccaaaggagccgagcttcctgaagctgagatgctgcatcggcggagagttccatcgccatttttgcttcaacgggtcatcagccaaggccatcaagtagagtagtagtccatctgcatgcgcctacaaccacaagattgatcaagtatttttgccgttgcacaatgaacatacatacgttttccaatcgacacacacgcatatatacgaaagaactggttgctgatcgatgtaaatttccccggccttagtagcttgcccctttaactttttctcccctttatcttttgtatatttcctgtcatcttttttcttttcttttcttttcttcctcctcttcttcttttattttgtcctcctcgatgtgatccacactgaaagctaggtaggaacgaaaccatgcatgcaaaaggggccatccgagatgatccggacgatgccctgcatgcgccatgtacgccctgtcgatctgatggcagtaataaagcaaggttgcatacagagtgcc

SEQ ID NO: 33327 - protein, 197 aa, Panicum virgatum
  misc_feature: Ceres CLONE 1950171
  misc_feature (91)..(147): Pfam Name: TPX2 Pfam Description: Targeting protein for Xklp2 (TPX2)
MAREMEKARKATTSPKISTMNAGPKSPVRNGGGNSPPPKKNTSEPRGRKNEQQIVRKGGQDHDEGKRRSPTSQTSPKRSPRLDQPLSYCRLHTEERAIRRAGYNYQVASKINTQQIIRRFEEKLAQLMEEHEIKLMRKEMVPKAQLMPAFDKPFHPQRSTRPLTVPKEPSFLKLRCCIGGEFHRHFCFNGSSAKAIK

SEQ ID NO: 33328 - DNA, 1070 bp, Panicum virgatum
  misc_feature: Ceres CLONE 1950183
  misc_feature: Encodes the peptide sequence at SEQ ID NO. 33329
cttcacttccgagcgatctctctctcctgctctccggcggaagcaccaacacccaccgatccgaatccgatcccttgggccctccgtccgaagcaggaacgcccacagatacgatcgatccgagcaatagccagcttcaattccacagttgacttcagaatgcaggtctttgtgaggagccccacaggcaagacaatctgtctcagggtccaaccatcagataccttgcatagtgttaagacaaaaattctggaacaacaccgccttgtctttgatggaaggcagctagatgataatcttacattggctgactataacatccagcataaatccactcttgacctccaagaaaagatgcagatctatctaatggatacactagtaggaatgagcatcactcttgaggttaacagctttgatactattgccaatgtgaaggccaagattgaatgtagtgagggatttcccaagggtcagcagtgtctcatctttggcaacaaacaattggaggacaacgacaccttggtgcaccacaacatttgcaatgagtccacccttctccttgtcctccacccacttccaaaaggtacgatgaagattttcgtgataaagctaactggaattaccctcactcttgaggttgacagcttggatactatcggcgatgtcaagatgcggatctatgagaaggatggtactcctcccagccagcaacgcatcatctatgccggcaggcaactggaggacagccgcaccctggctgactataatgtacagaaagagtctaccgttcacttggtgctccgccttgctggttcttgagatggatgacatgcatggtcactcaacaacaagtctcttgctgcagtcttattttttttccatgctagtagacaatagttgtgtgtcagtaaagctatcactgtactgtggtcttgttcattcaagttgctgtgtgtttatcagtaaaactttcgttacgttaatgtgtgaaatcatcaagagtagtcctcgtactcttggtctgtcttgacatcttgattgagcaatatagatgatcttgctagatc

SEQ ID NO: 33329 - protein, 220 aa, Panicum virgatum
  misc_feature: Ceres CLONE 1950183
  misc_feature (150)..(218): Pfam Name: ubiquitin Pfam Description: Ubiquitin family
  misc_feature (73)..(140): Pfam Name: ubiquitin Pfam Description: Ubiquitin family
  misc_feature (6)..(67): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50597
  misc_feature: Useful for making plants with modulated cold sensitivity
MQVFVRSPTGKTICLRVQPSDTLHSVKTKILEQHRLVFDGRQLDDNLTLADYNIQHKSTLDLQEKMQIYLMDTLVGMSITLEVNSFDTIANVKAKIECSEGFPKGQQCLIFGNKQLEDNDTLVHHNICNESTLLLVLHPLPKGTMKIFVIKLTGITLTLEVDSLDTIGDVKMRIYEKDGTPPSQQRIIYAGRQLEDSRTLADYNVQKESTVHLVLRLAGS

SEQ ID NO: 33330 - DNA, 735 bp, Panicum virgatum
  misc_feature: Ceres CLONE 1950192
  misc_feature: Encodes the peptide sequence at SEQ ID NO. 33331
ctgccggccgagtagagtgcgacctcagatcaggtgttgctcaggtgatgatgcaaagggacgtgcggacatgtgcaagggaggcaaggatgaagaaactagaccttcaagacgaaagtgtcttgtctgcctaggtgctgtagccctaatcagtgcaacaggcccaacgatttgtacaccaaatgtaatcgccgcagatatgacaaacaagtctgggatacagaaagctgtttgcagaaattgcaacggcagcggtgctgtgatatgtgacatgtgcggtggcacaggaaaatggaaggcgctcaacaggaagagggcaaaagatgtttatgaattcacagagtgtccgaattgctatggccgagggaagctggtctgcccagtctgtcttggaactgggctgccgaacaacaagggactcctccggcgaccagaagccaagcagttgcttgacaagatgtacaacggcaagatattgccaaggtcgtagagcgcacaggcaggcagccacaggattttgcatcaaccatcgtgtaggaatatcattcgagacaaatgtagctctcaagagtgtaactttgtgtaccaagttaaaaagttacagcttggattttagctttcagattaccacagatatgttgactaagtagccttctgaatgtcatttccaaatacattattgcacaaatatagtgattttaaatcgttcgcggtgcaccagagcatcaccaccat

SEQ ID NO: 33331 - protein, 162 aa, Panicum virgatum
  misc_feature: Ceres CLONE 1950192
  misc_feature (67)..(140): Pfam Name: DnaJ_CXXCXGXG Pfam Description: DnaJ central domain (4 repeats)
CRPSRVRPQIRCCSGDDAKGRADMCKGGKDEETRPSRRKCLVCLGAVALISATGPTICTPNVIAADMTNKSGIQKAVCRNCNGSGAVICDMCGGTGKWKALNRKRAKDVYEFTECPNCYGRGKLVCPVCLGTGLPNNKGLLRRPEAKQLLDKMYNGKILPRS

SEQ ID NO: 33332 - DNA, 1331 bp, Panicum virgatum
  misc_feature: Ceres CLONE 1950206
  misc_feature: Encodes the peptide sequence at SEQ ID NO. 33333
ggactcgagactttcaggtcacatctcctccctcttttttttttttttttttgcgagggacatctcctccctctgtttctcccttctctcggactctctccctggctctttcttccctgtcggcgacgactgggcgagcggcggcgccgtttgtcacgtcttcgccaagccttttgccggcgacgagcatcccccaggctgagataagttgaagcaaagttcaaggcaaaatgttttacggtggatatgcgtaccatggcaatacgtttgagcaaacgtaccgttgttatccagcatccttctttgataagccacacctggaaggtggtgacaaagtaataatgccaccatctgcccttgattgcctggcttccctccacatcgagtacccaatgctatttgaactgcacaatgatgcaactcaacggatttcacactctggtgttttggagtttgtggcagaagaaggcatgatcatcatgccctactggatgatgcaaaacatgcttcttcaagagggtgacactgtccgtgtgaaaaacgccacacttcccaagggtacatatgtgaagttgcaacctcacacaactgattttctggacatctcgaatccaaaagccatcctggagaaaactctgagaaatttctcctgtttaactacgggagacagcatcatggtggcttacaacaacaaacagtattatattgatattgttgaaacaaagcctgcttcagctgttagcattattgagacagactgtgaagtggattttgctcctccccttgactacaaagaacctgagaaaccacagcagcccacagttcctgccagcaaggcaactgctgaaggtggagatactgtagtcgaagatgaaccaaaattcaaaccatttactggttccggaaagcggttggatggtaaagcctcaaaactacaagcatccgaggttccatccagtgcaagttctgttccctcagattcaaacaaaagatcaaatcagcaagcatctgcacccgcaacttctggagctagcaattccactcgtcagaaaacaggaaagcttttttttggttcaagtgcaagcaacaataaagaaccacaaaaggctcctgctaaagaggaggaacccccgaagaaggacgagcccaagttccaagcttttagtgggaagagctactccttgaaacgttagctgcccattactggagtttagcgtatcatgttcagtggtagctgtagaccactgtgtcttaagtgtccaccagcatgtagatataatttgaattatgtaaatgtttatcttcatggaaatatggccatctttctattc

SEQ ID NO: 33333 - protein, 320 aa, Panicum virgatum
  misc_feature: Ceres CLONE 1950206
  misc_feature (10)..(184): Pfam Name: UFD1 Pfam Description: Ubiquitin fusion degradation protein UFD1
MFYGGYAYHGNTFEQTYRCYPASFFDKPHLEGGDKVIMPPSALDCLASLHIEYPMLFELHNDATQRISHSGVLEFVAEEGMIIMPYWMMQNMLLQEGDTVRVKNATLPKGTYVKLQPHTTDFLDISNPKAILEKTLRNFSCLTTGDSIMVAYNNKQYYIDIVETKPASAVSIIETDCEVDFAPPLDYKEPEKPQQPTVPASKATAEGGDTVVEDEPKFKPFTGSGKRLDGKASKLQASEVPSSASSVPSDSNKRSNQQASAPATSGASNSTRQKTGKLFFGSSASNNKEPQKAPAKEEEPPKKDEPKFQAFSGKSYSLKR

SEQ ID NO: 33334 - DNA, 985 bp, Panicum virgatum
  misc_feature: Ceres CLONE 1950211
  misc_feature: Encodes the peptide sequence at SEQ ID NO. 33335
attccagtcctcaatccgtcgagaaattctcgcgagcgatcgaaatctaagcgaagcgaagaggcctccccagatcctctcaagatgcagatctttgaagaccctcaccggcaagaccatcaccttggaggtggagtcatctgacaccattgacaatgtgaaggccaagatccaggacaaggagggcatccccccggaccagcagcgtctgatcttcgctggcaagcagctggaggatggccgcaccctggcggactacaacatccagaaagagtccaccctccacctggtgctccgcctgcgtggtggtatgcagatctttgtgaagaccctcaccggcaaaactatcaccttggaggtggagtcttctgacaccatcgacaatgtgaaggcgaaaatccaggacaaggagggcatccccccrgaccagcagcgtctgatcttcgctggcaagcagctggaggatggccgcaccctggcggactacaacatccagaaggagtccaccctccacctggtgctccgcctgcgtggtggtatgcagatctttgtgaagaccctcaccggcaagaccatcaccttggaggtggagtcttctgacaccatcgacaacgtgaaggcgaagatccaggacaaggagggcatcccgccgggccagcagcgtctgatcttcgccggcaagcagctggaggatggccgcaccctggcagactacaacatccagaaggagtccaccctccacctggtgctccgtctccgtggtggacagtaagtccatggagctgctgttgtccctgggttcacaagtctggtgccttgccttgtctctccaatggtgattgcctgcgtgtccttgtcatgcctgtctgatgtgagttttatgtcatctggttgtgttttgtgaacacttaactgctgctgtgcagcagtttggttgaactatgtaatgaataagtgagccctgaagttactatggtaatcttgt

SEQ ID NO: 33335 - protein, 256 aa, Panicum virgatum
  misc_feature: Ceres CLONE 1950211
  misc_feature (33)..(101): Pfam Name: ubiquitin Pfam Description: Ubiquitin family
  misc_feature (109)..(177): Pfam Name: ubiquitin Pfam Description: Ubiquitin family
  misc_feature (185)..(253): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
FQSSIRREILASDRNLSEAKRPPQILSRCRSLKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPGQQRLIFAGKQLEDGRTLADYNIQKESTLHLVLRLRGGQ

SEQ ID NO: 33336 - DNA, 656 bp, Panicum virgatum
  misc_feature: Ceres CLONE 1950215
  misc_feature: Encodes the peptide sequence at SEQ ID NO. 33337
aatcccatcccgctctttccgatccactgcgcaggtcgtcgttgccctccacgccgtcatgccccgaggctgggaccttcaaagagcaataggactcatggaggctggagacgcaggaaacggttctgcagcagtggcacagataaagggaagtggggatgatgcctcctgcaaaccgctgcctccttgctgcgtcaaggccaaggcaggcgtgcctgaatctgaggccaagtgccatgataccgtggtttctggctggttcaccgaaccccggtcacgctttggtaaaacaagcaaagtgcagtactacaacaaccctatgtggcctggagaggctcattcactgaaagtggagaagattttgtaccaagggaaatcgccttaccaagagattttagttttcgagtcttcaacctatggaaacgttcttgtgcttgatggtatagttcagttgactgacaaggatgaatgcgcataccaggaaatggttactcaccttccactgtgctcaattccatcaccgaaaaatgttttggttgttggaggtggtgatggtggtgtactgcgggaaatagccagacatgattcagtggagactattgatatatgtgagattgatcagcttgttattgatgtttgcaaagaattctttccaa

SEQ ID NO: 33337 - protein, 186 aa, Panicum virgatum
  misc_feature: Ceres CLONE 1950215
  misc_feature (53)..(186): Pfam Name: Spermine_synth Pfam Description: Spermine/spermidine synthase
  misc_feature: SWISSPROT Homolog: EC 2.5.1.16 Spermidine synthase
MEAGDAGNGSAAVAQIKGSGDDASCKPLPPCCVKAKAGVPESEAKCHDTVVSGWFTEPRSRFGKTSKVQYYNNPMWPGEAHSLKVEKILYQGKSPYQEILVFESSTYGNVLVLDGIVQLTDKDECAYQEMVTHLPLCSIPSPKNVLVVGGGDGGVLREIARHDSVETIDICEIDQLVIDVCKEFFP

SEQ ID NO: 33338 - DNA, 517 bp, Panicum virgatum
  misc_feature: Ceres CLONE 1950215-R
  misc_feature: Encodes the peptide sequence at SEQ ID NO. 33339
cccaattgagaagatacaaggagctacaaaagctggaaaggagctcagattttacaattcagagattcatagggctgcttttgttctgccaacatttgtaagaagagaactggaatcatatactgctactaagacttctactgaaaaggagaaaccaaaagaatcagtttcaaaatcgcagaagataaagattttgccgaacaatgccattcttacagcttcctaggcttgaatcatactcgatctacctctgagttctgatgtatccaagccggagtcgtgtatagttgtattcttacagagaaaaaccagttggtgagatgttagtgacgtggcgccaggagcataagtatatactgggtttgtgagtgatgactgattgaataatgggggaattgaattgctgtgatgcctactggaataatgtgttcccctctgtttctgttgtttggtgtgcataatttcccaacttggaacttgtaagacctgttgatgtaatatagtccttgtttgcatc

SEQ ID NO: 33339 - protein, 74 aa, Panicum virgatum
  misc_feature: Ceres CLONE 1950215-R
  misc_feature: SWISSPROT Homolog: EC 2.5.1.16 Spermidine synthase
PIEKIQGATKAGKELRFYNSEIHRAAFVLPTFVRRELESYTATKTSTEKEKPKESVSKSQKIKILPNNAILTAS

SEQ ID NO: 33340 - DNA, 1049 bp, Panicum virgatum
  misc_feature: Ceres CLONE 1950218
  misc_feature: Encodes the peptide sequence at SEQ ID NO. 33341
gaggaagctgctccagaactggcttcattgaagaaggcctcggttgacacttgacaccaggaagatgggctcgttagatgccacacgagcggaactcggcctcgttgttctgtacctgaacaaagccgaggctagggacaagatctgcagggcgattcagtatggctcaaagttcataagcaacgggcagcccggcaccgcgcaggatgtcgatagatcgaccaccttggctcgaaaagttttccgtctcctcaagtgggtcaatgatcttcatgctcttatcagcccgcctgctaaagggactcctctcacacttgtccttcttggcaagtccaaaaacgcgctgctttcgacgttcttattcctggatcaatttgtgtggttaggacgaacaggaataatcaagaacaaggaggcgacggaccgggttgccaggatatccctctactgttggatggcttcttctgcctgcgctagtctagtggagcttggagagcttaagaggctatcgaaatcgatgaggaagcttgcaagagagctgaggcacactgataaatacgagaacgaacagtaccagaacaaaatgaagcagtcggatgagcggctcctggccctggtgaaggcggccatggacgtggtcgtggccatcgggcttcttcagctggcacccaagaaggtcacccccagagtgacgggagctctcggattcgtcacctcgctcatctcctgctatcagcaactcccttcccgtggccccgtggccaaagtcaaggcgtgagatgggtccgggtcctccctactatggaagtagccgtcgctggaaattgaggtagctatacttgagcatgcatggaccacgtggctcctacatctgcgctggctttcttcaaataaaaaacatctgcgctggccatggctgctccgatccgagcaggggttttgattcatttcatgcagaataatggagctcacatgtaccagggcgttgtacgttgtcaaatcatcgatcaaacatggcgtctgatatctgaagtagtacatgcgagagc

SEQ ID NO: 33341 - protein, 237 aa, Panicum virgatum; identical to SEQ ID NO: 33252
  misc_feature: Ceres CLONE 1950218
  misc_feature (11)..(226): Pfam Name: PEX11 Pfam Description: Peroxisomal biogenesis factor 11 (PEX11)

SEQ ID NO: 33342 - DNA, 631 bp, Panicum virgatum
  misc_feature: Ceres CLONE 1950234
  misc_feature: Encodes the peptide sequence at SEQ ID NO. 33343
aaatagactcggagaaacaagcatacacatggctacttccgttgctacgaccattccagctcctgtgtttcaccccacagtatggggggattactttatcaattttaccccagagccattgcagatctcagatgaaaagatggcagaaagaatcaaccaattaaaggaagacgtaagtggtatgttccaggctgccaagaataatgtcgtggagacaatgaacctagtagatgtggttcaacgtcttggaatagatcatcattttgaggagcagatagccactgccttagctcgccttcatagtgctgacttcaatagctcaagcctacatgaagttgctcttcggtttcgcctgcttaggcagcaagggttttgggtttctccagatgaatttaacaagttcaaaaatgaagatgggagctttatcagtggtatagagaatgacccaaagggcttgttgagtttatacaatgcagctcaccttcttactcatgatgaggggacacttgaagacgctatcttattttcaaggagacatctggaatcaatacagagtagtctcaagccccctttagctgatcaagttggccgtgcccttcaaataccatttaccaaggaccttaaagaggga

SEQ ID NO: 33343 - protein, 200 aa, Panicum virgatum
  misc_feature: Ceres CLONE 1950234
  misc_feature (19)..(199): Pfam Name: Terpene_synth Pfam Description: Terpene synthase, N-terminal domain
  misc_feature: SWISSPROT Homolog: EC 4.2.3.9 Aristolochene synthase
MATSVATTIPAPVFHPTVWGDYFINFTPEPLQISDEKMAERINQLKEDVSGMFQAAKNNVVETMNLVDVVQRLGIDHHFEEQIATALARLHSADFNSSSLHEVALRFRLLRQQGFWVSPDEFNKFKNEDGSFISGIENDPKGLLSLYNAAHLLTHDEGTLEDAILFSRRHLESIQSSLKPPLADQVGRALQIPFTKDLKE

SEQ ID NO: 33344 - DNA, 363 bp, Panicum virgatum
  misc_feature: Ceres CLONE 1950234-R
  misc_feature: Encodes the peptide sequence at SEQ ID NO. 33345
cagggatgacatgtcagcgttcaagaatggtaggaacaaattggatgtacccagtactgtggagtgctacatcaaggagcacaacgtctcaagtgatgttgccttgaccaagataagctcatttgttgaagatgcatggaaaaccataaatcaagcaccttttaagtatcctgccctacttccggttgtgcgaagagtcgccaggctagcaaagagcatgacacttttgttccttgacaagagagatgcatacacatacagcaaggacttcaaaaagacattggagagccatttcgtcaagcatatttgatataatattagcaaagaatacgtcaacaacaaagatatatatttttggcagcg

SEQ ID NO: 33345 - protein, 102 aa, Panicum virgatum
  misc_feature: Ceres CLONE 1950234-R
  misc_feature: SWISSPROT Homolog: EC 4.2.3.13 (+)-delta-cadinene synthase
RDDMSAFKNGRNKLDVPSTVECYIKEHNVSSDVALTKISSFVEDAWKTINQAPFKYPALLPVVRRVARLAKSMTLLFLDKRDAYTYSKDFKKTLESHFVKHI

SEQ ID NO: 33346 - DNA, 616 bp, Panicum virgatum
  misc_feature: Ceres CLONE 1950237
  misc_feature: Encodes the peptide sequence at SEQ ID NO. 33347
tctccgttctccccacctcccgcgaaagcagcagcagcagccatggccgcctcccgcgacctcctcgacgtcgacccgccggagcttcagttcccgttcgtgctctacaagcagatctcttgccccctgcggctcaccaacaggacagacagtaccgtcgcctttaaggtcaagacgacgagccccaggaagtactgcgtgcggcctaacgatggcgtcgtacccccacggtcctcctgcacagttgtagttacgatgcaagcgcagaaggtggtgcctcccgatttgcagtgcaaggacaaattcttggtgcagagcgtgattgtcagtgacggcttttcagccaaggacataacctcgcagatgttcgtgagagaagggggtaatgtggttgaggaggtgaagctgaaggttgcttatgtgatgccacctgaaccacaatcagagattgcagaagagcacgatggtttagagagaattttagtgcctatgcagcggaatgtggacaatggaaggagtacttcaggtgtgtcgagtggctctgcatctttgagatcagctgaggaggtgggatcacctgttgggcgaattgtgaagagtgaggaaatccctgaag

SEQ ID NO: 33347 - protein, 191 aa, Panicum virgatum
  misc_feature: Ceres CLONE 1950237
  misc_feature (7)..(108): Pfam Name: Motile_Sperm Pfam Description: MSP (Major sperm protein) domain
MAASRDLLDVDPPELQFPFVLYKQISCPLRLTNRTDSTVAFKVKTTSPRKYCVRPNDGVVPPRSSCTVVVTMQAQKVVPPDLQCKDKFLVQSVIVSDGFSAKDITSQMFVREGGNVVEEVKLKVAYVMPPEPQSEIAEEHDGLERILVPMQRNVDNGRSTSGVSSGSASLRSAEEVGSPVGRIVKSEEIPE

SEQ ID NO: 33348 - DNA, 423 bp, Panicum virgatum
  misc_feature: Ceres CLONE 1950237-R
ctgcacttgagcaaaataggaagtttcgagatgaattggaacttgtaaggcgtgaagccagtaaccagcagggcagcttctcgctggttctcataatagctatcgggctcctgtgcatcatactgggttatcttgtaaataaatgagaatttcatagcctaattgggtgctagttatggtaaataaaaggtaacatatcatgtgattcttagattcgtcgaccagctgccaatgctacgagccgtgcaacagcacgagcgtcaaattgacaaaagtgggttgtgtaatggcatctagtttgatccttgatgtattttaactaatcactgtaaaagtgattgctcttattatgtttgattcctgtatcaatcccattcaatttatcacctacattgtggataaatcttacagctacaatttatt

SEQ ID NO: 33349 - DNA, 1353 bp, Panicum virgatum
  misc_feature: Ceres CLONE 1950241
  misc_feature: Encodes the peptide sequence at SEQ ID NO. 33350
atccagatccaggtacgcatctctccttccttccttcccccgttggatggcgtcctcatctgcccccgacgacggacgccattggccttgagtggagatccgggcgcggttttaatcacaaagcgcaatggaccttccagtagcggatcctggaacagagagaggcgaagggccgctcattcaatgtccgtactgcgattcagaggcaatgcacaaactggcacagctcctgctccctggcctggctgcagtctgcgttgatggcacgacaggtgatctgttcagaaagccctccgttgtcgcggttgagttgaggaaggagatggtggactacatcacgcagaggagcgatactttcattgccgatgctctgatcgagtccgaagcgaatcaggaacccgagaatgagatgccggaggacccttttgaaatcgtttcaatttttatggatgatttcagcagcaccaagaggaatatcatcggccatgtctctgggtggctgctgagcgacaaccgtgaggataagattgatgactttgtccaggagatggagatgacccgcttctggcctctagataggagggaagccatcgccgaggtcctcctcaagaatgtcgacatcaagaccaagttccactgccctgagaagtatgaaaatgaggagcggctggctgatcacaaggaacaatgtagcttcagacctgttacttgcccaaatgacggatgccgagccaaagtttctgtccgctgcatggatgctcatgatgctgcttgcccgttcaaggtccttcagtgcgagcagaactgtgacaagcgcctcctgaggcgtgatatggataggcactgtgtcactgtctgcccaatgaggcccatgaagtgccccttcggctgcgattcctcattcgctgagcgcgatcttgagaagcactgcttggagtttcttcaggcacatttgcttaaggtccttaaggtgattcacaagaaagggcgttccgaagaagaacttaaggaacttgctcagaagctagaaaagtatgatgaacatggtaagctggctaaagctcaggatgcaagacctcttactaatgctgtgaaggaccttgaagcaaagatgaaaggtgaaccgtcgagttaaaggggtcttttatacagccaaatctcacaagatggataatgacatggattagttgaagagtttgttcctacgtacagcatacagagaagaatataagttctgttttatttttttgcttctttctctcccttcataatcaaatcaatttgtcagtattatattgtactattgctatgcgcctgcaattttgtacgagtatattgtttgttttggtatac

SEQ ID NO: 33350 - protein, 335 aa, Panicum virgatum
  misc_feature: Ceres CLONE 1950241
  misc_feature (212)..(267): Pfam Name: zf-TRAF Pfam Description: TRAF-type zinc finger
MDLPVADPGTERGEGPLIQCPYCDSEAMHKLAQLLLPGLAAVCVDGTTGDLFRKPSVVAVELRKEMVDYITQRSDTFIADALIESEANQEPENEMPEDPFEIVSIFMDDFSSTKRNIIGHVSGWLLSDNREDKIDDFVQEMEMTRFWPLDRREAIAEVLLKNVDIKTKFHCPEKYENEERLADHKEQCSFRPVTCPNDGCRAKVSVRCMDAHDAACPFKVLQCEQNCDKRLLRRDMDRHCVTVCPMRPMKCPFGCDSSFAERDLEKHCLEFLQAHLLKVLKVIHKKGRSEEELKELAQKLEKYDEHGKLAKAQDARPLTNAVKDLEAKMKGEPSS

SEQ ID NO: 33351 - DNA, 1069 bp, Panicum virgatum
  misc_feature: Ceres CLONE 1950259
  misc_feature: Encodes the peptide sequence at SEQ ID NO. 33352
aacggataacgctcttctccctcacctcgctcctctcctctccccttccctccccgcccatggcgaccgccatttcctccctgattacccctccggccctccacctccgctgccggagtactgcatcggcctccgtctctgtatctgcccgcctctccttccgtgcagtggcggcgccgcaggcccggggccgggggttggcgctgcgggtagccgcctcctcggcggtgttcgaggcgccggcggaggtggcggcgcggaagctctacgtcgggaacatcccccggactgtcaccaacgacgagctccgcgagatgtttgccgcgcacggcaccgtcgagcgggcagaggttatgtacgataagtacaccaatcggagccggcgctttggatttgtcaccatgagcactgctgaagaggccaatgctgcaattgaggctctcaacgggactgaggttggtggtagaaaaattaaagtgaatgtcacagagagtttcttgccaaacattgatcggtcagcaccagaaccggagcctgtatttgtggatagtcagtacaaggtttatgttggtaaccttgcgaagactgtgacaacggaagttcttaaaaatttcttctctgaaaagggccagatcctcagcgccacggtttcccacattcccgggacatcaaaatccaagggatacggctttgtcaccttctcttccgaggaagaagttgaagctgctgttgctactttcaataatgtggaattggaaggacaacccattcgtgtgaatagagcttagattagcaggaatttgcaggagcagtgaaggcggggggaacatctcggcaaatacatgtagaatgagggatacttggaggttagattttgataacagtgatcaagaccttcaatgtaatttcaatctgtcaaacaattttcgtaccgtaacagtgtatgtgaaggattttgcttgtcaaagtcattgttcatatgatcacagtttttcttatagtcacttccacatgattacaaaaaggaagaatggttttgtttttgtcatataccatctttgtatacttc

SEQ ID NO: 33352 - protein, 242 aa, Panicum virgatum
  misc_feature: Ceres CLONE 1950259
  misc_feature (69)..(140): Pfam Name: RRM_1 Pfam Description: RNA recognition motif. (a.k.a. RRM, RBD, or RNP domain)
  misc_feature (168)..(239): Pfam Name: RRM_1 Pfam Description: RNA recognition motif. (a.k.a. RRM, RBD, or RNP domain)
  misc_feature: Functional homolog of the protein sequence given in SEQ ID NO 51437
  misc_feature: Useful for making plants with altered alkaloid content
MATAISSLITPPALHLRCRSTASASVSVSARLSFRAVAAPQARGRGLALRVAASSAVFEAPAEVAARKLYVGNIPRTVTNDELREMFAAHGTVERAEVMYDKYTNRSRRFGFVTMSTAEEANAAIEALNGTEVGGRKIKVNVTESFLPNIDRSAPEPEPVFVDSQYKVYVGNLAKTVTTEVLKNFFSEKGQILSATVSHIPGTSKSKGYGFVTFSSEEEVEAAVATFNNVELEGQPIRVNRA

SEQ ID NO: 33353 - DNA, 997 bp, Panicum virgatum
  misc_feature: Ceres CLONE 1950280
  misc_feature: Encodes the peptide sequence at SEQ ID NO. 33354
gatccccacaaaggcagagccccaaccccaatcggagaagacttcccaatcccacccgcagaggaccaggaggagccatccctcaaccgcagtcgccggatcggaggacgccaaccactcgtcgccggacttcctccccgcccgccggtcaccatgagcttcatcttcggcaagaagaagaccccagccgagctgctgcgggagaataagcggatgctggagaagtccatcagggatattgagagggagaggcagggcctgcagaaccaggagaggaagctcatcaacgagatcaagaaggtggccaagcagggacagatgggagctgtaaaaatcatggcgaaggaccttatccgcacaaggcaccagataacaaaattttatgccctgaaatcccagctacaaggtgtatctcttcgcattcagacactgaaatcaacacaagcaatgggtgaagctatgaagggtgtcacaaaagctatgggacgaatgaacaggcagatgaatctgcctgctctgcagaagataatgcgggagttcgagatgcaaaatgagaagatggagatggttagtgaagtgatgaacgatgccatcgatgatgcattggagggcgacgaggaggaggaagagacagaagagctagtcaaccaagtcctcgatgaaattggcattgatgtcaactccgagcttgtcaaggctcctgccactgcagttgctcaacctgtcgcagcaggaaaagttccggctcaagctgaagccgcaggtggggtggatggtggaatagatgatgacttgcaggcacggcttgataacctgaggaagatgtgatgattggagtctgacagaattattcacacgctttgtttgtagttttgtaatttgaatatagccattgcggcaatccttttggcattggccatttgtacatagaatagaatatatctggtaccatgaactaggctttgcaatatatatattcctaatcccattgggtgcc

SEQ ID NO: 33354 - protein, 224 aa, Panicum virgatum
  misc_feature: Ceres CLONE 1950280
  misc_feature (17)..(187): Pfam Name: Snf7 Pfam Description: Snf7
MSFIFGKKKTPAELLRENKRMLEKSIRDIERERQGLQNQERKLINEIKKVAKQGQMGAVKIMAKDLIRTRHQITKFYALKSQLQGVSLRIQTLKSTQAMGEAMKGVTKAMGRMNRQMNLPALQKIMREFEMQNEKMEMVSEVMNDAIDDALEGDEEEEETEELVNQVLDEIGIDVNSELVKAPATAVAQPVAAGKVPAQAEAAGGVDGGIDDDLQARLDNLRKM

SEQ ID NO: 33355 - DNA, 569 bp, Panicum virgatum
  misc_feature: Ceres CLONE 1950296
  misc_feature: Encodes the peptide sequence at SEQ ID NO. 33356
caggcaattgttgcagataatgagactgggaaaaaggggtacactgttccattagaggtcatgcctgcaggacaattcgaaccattgtacagaactccattaagcattcaggatggagaattgccagtcctgccgatgtctgtatatggtgctattgccatggcacatagtgtggattcagatgaatactcctcaccaacgcagttcttcttctatctttatgacaagagaaacgtgagtaaaaaagcctagcactcatcatcatactttaagacatcaaactgcatattcttactatccaatttaaaagatcgaattgtataaggccaatcccagtgcaagtttcatagaggtttcatgcacatttaagacagtgacacgtcagcaactgtgatgacatggcaaggtaattatgaagaaagagagggaatgagtttcatcaggatgaaactgtgtatatactgtttcccagactatgaaacttgttgacacttgcattggggccataaaatttcatttcatgcacttgtgcccaatcacatgcctcacaattaaatgctatggctagc

SEQ ID NO: 33356 - protein, 83 aa, Panicum virgatum
  misc_feature: Ceres CLONE 1950296
  misc_feature: SWISSPROT Homolog: EC 5.2.1.8 Peptidylprolyl isomerase
QAIVADNETGKKGYTVPLEVMPAGQFEPLYRTPLSIQDGELPVLPMSVYGAIAMAHSVDSDEYSSPTQFFFYLYDKRNVSKKA

SEQ ID NO: 33357 - DNA, 946 bp, Panicum virgatum
  misc_feature: Ceres CLONE 1950299
  misc_feature: Encodes the peptide sequence at SEQ ID NO. 33358
agcaaacaactgaaattccccagtccggttccttccgtgcgatttgatctcgtcggaggcgcggccgcggttacccccaacccgccatcgaattcgatggcggccaacgccggcaacaagatccgcaacgccaagctggttcttcttggagatgtgggcgctggcaaatctagtttggttcttcggtttgtgaaaggacagtttgttgaattccaggaatcaacgattggagcagctttcttctctcagaccttggcggtcaatgatgagactgttaagtttgaaatctgggatactgctgggcaagagaggtaccatagcttggcacccatgtactataggggtgctgccgccgccatcgttgtctacgacattacgaatctggcctccttcactcgtgcgaagaaatgggtccaagaacttcaagctcaaggaaacccgaatacaatagtggctcttgctggcaacaaagctgatatgctagatgcaaggcaggtgccagcagaggaagcaaaaacatatgcacaggagaatggacttttcttcatggagacatctgccaaaactgcgatcaatgtgaatgacatattttatgagatcgcaaagagactgctccaagggcaacaggatccaagcccacaggctggaatggttctgaaccaaagaccaaatgagagaatggtcagcagttcttcatgctgctcttgaatctgtgtttcaacctcttactgccattgtgaaatgtatcagaggaagttaaacaaaatgtcccagtcttctgtgtggctgcattccagcctgataatgctccagcttccctcttcttttcttctcatgtgtttgtcatgtaaatgtcaatactagaacatcactgcacggatagtgttactgaagtgttgaatgtgctcttattatatgattgcgcccactccaatcagatttgcac

SEQ ID NO: 33358 - protein, 203 aa, Panicum virgatum
  misc_feature: Ceres CLONE 1950299
  misc_feature (13)..(174): Pfam Name: Ras Pfam Description: Ras family
  misc_feature (13)..(127): Pfam Name: Miro Pfam Description: Miro-like protein
  misc_feature: SWISSPROT Homolog: EC 2.7.11.1 Non-specific serine/threonine protein kinase
MAANAGNKIRNAKLVLLGDVGAGKSSLVLRFVKGQFVEFQESTIGAAFFSQTLAVNDETVKFEIWDTAGQERYHSLAPMYYRGAAAAIVVYDITNLASFTRAKKWVQELQAQGNPNTIVALAGNKADMLDARQVPAEEAKTYAQENGLFFMETSAKTAINVNDIFYEIAKRLLQGQQDPSPQAGMVLNQRPNERMVSSSSCCS

SEQ ID NO: 33359 - DNA, 775 bp, Panicum virgatum
  misc_feature: Ceres CLONE 1950309
  misc_feature: Encodes the peptide sequence at SEQ ID NO. 33360
ccgacgcgccgcctctctgcatctgtcgtcgccggtgactcggataaagctgcatttgatcctcagagatgatgaacgagtcttttcttgataggatggtttcccagcttcggtcaacatgcaagtactacactggatatcccaaggacctagggccatcaagaattataccattcacatctgagcgtcagtttgtacagctattgcatgaaggaaggcctgtagttgttgcctttactattaagtgcacttatacacagcatcttgataaagtactggaagaggctgctgccacattttatccacatatcaagtttgtcagagttgaatgcccaaagtatcctgggttttgcctcacgaggcaaaggaatgaatatccatttgttgaagtattttacaatccagaacaggctgcaagccaaggaaagagtgtggatcctaacatcaccaagtattctgtaaaagtgctacctttcaactatgatcagagcttgtatggatttcgggaatatttcaagaagcatggtttcaagtattctgaaacaaactaattctgtcaatagaaatatgcgatgtgagaacttctagggacttaacatggaggcattcattgtcggagttgaactgtggggctttattgatgtctttcctagttcaaggaatgcctgccatgtactcatgttagggtatcatgcctatagattagcactgcaatagcaaatgcctgctgaactatcgaccttcaatctggtaaattaaacatttccccaacctc

SEQ ID NO: 33360 - protein, 160 aa, Panicum virgatum
  misc_feature: Ceres CLONE 1950309
  misc_feature: SWISSPROT Homolog: EC 5.3.4.1 Protein disulfide-isomerase
MMNESFLDRMVSQLRSTCKYYTGYPKDLGPSRIIPFTSERQFVQLLHEGRPVVVAFTIKCTYTQHLDKVLEEAAATFYPHIKFVRVECPKYPGFCLTRQRNEYPFVEVFYNPEQAASQGKSVDPNITKYSVKVLPFNYDQSLYGFREYFKKHGFKYSETN

SEQ ID NO: 33361 - DNA, 1330 bp, Panicum virgatum
  misc_feature: Ceres CLONE 1950345
  misc_feature: Encodes the peptide sequence at SEQ ID NO. 33362
aaagtctgaatggcttgaatgcgaggcggcccaactcacggagggattaagctcggctggctcacatcatcttctcggatggatcattccgagactcgtgttcatcagcctggccatccgacggcatcctaaattctgaaatttctatcgtcgacaggggagtggcgccgcccttgccagttcttcgtcgggagcttcgccggcgacaagagaatctcggtggttctagctgaactcgcgcccctgctatgcacccagtttcagtctccttgcagcctttccctgcaactccggcaagcatacttgtcccaaggagcgcagctgggaggaattccatcgattttgccgagttgcggagagctggaaggtctagtggaaaccttgctatgaattccacacagaatcctgcccgtgggtcagaaacgtctgggagtgaggatttcaatgtgggggataaggatgccgtggtcattgtcgaccatgggtcacggcgccaagaatccaatctcgtgctcaatgactttgtcgagatgttcagggcacgaactggttataagatcgttgagcctgctcatatgaatgacgccgatctctggatgcttgcaggcgccaagggccttactggtctggttgctgctcaacctcaggagctggctgagcttactattaaggatgcttttggaaaatgtgtgcaacaaggggcatcccgtgttattgttagtccatatttcctttcccctggacgacattggaaacaagatatccctgctttagcagcagaagcatccaaggagctctcaaatataccctatattgtcactgcccctcttggactgcatgagcttatggtggatatcatgaatgatcgcatcaagtactgcctgcaacacgctgcaggtaatgtcgatgagtgtacagtatgtgctggaactggaaagtgccgcctctactcctgatggtgaatacctgggaggccacagttctctatatatgagtatatgactgttcatactgcctcttagaatctgaatagctgtggcagtggcatttcaatgccagcttttctctccgttttaccatttacaaggtctgggccaatatttttcttctgtaagagatctgacgagtgtatgtcccggtcccttatgtcccgtgcagccaaaattaccattgtaatcggctttgtgcatcttgaaattcgggactgtccatattctgagcagattgtcaaattagtcggacaggtggaccatcaagaaaagagtatagcatcattagctaaccttaagaacaattactgttgttatttgaacaacgaacaagatctagc

SEQ ID NO: 33362 - protein, 235 aa, Panicum virgatum
  misc_feature: Ceres CLONE 1950345
  misc_feature (78)..(206): Pfam Name: CbiX Pfam Description: CbiX
  misc_feature: SWISSPROT Homolog: EC 4.99.1.3 Sirohydrochlorin cobaltochelatase
MHPVSVSLQPFPATPASILVPRSAAGRNSIDFAELRRAGRSSGNLAMNSTQNPARGSETSGSEDFNVGDKDAVVIVDHGSRRQESNLVLNDFVEMFRARTGYKIVEPAHMNDADLWMLAGAKGLTGLVAAQPQELAELTIKDAFGKCVQQGASRVIVSPYFLSPGRHWKQDIPALAAEASKELSNIPYIVTAPLGLHELMVDIMNDRIKYCLQHAAGNVDECTVCAGTGKCRLYS

SEQ ID NO: 33363 - DNA, 1149 bp, Panicum virgatum
  misc_feature: Ceres CLONE 1950358
  misc_feature: Encodes the peptide sequence at SEQ ID NO. 33364
acacggctcgcccatttctctcgtctccttcgtcgtctctgtttcttcccacgttcctctctctctctctctctctctctctctctctctctcgcggccacccctttcctgccggcgacgaccgccgccacgtctacgccgggccctttgccggcgacgagccccgaaaagatcgactcttttatgagtccacaaggcacccaggatgaagtttttagaatacacccccttcgacagcataaatctgttcctcgaccaactcaacctcggcgattgtgcaatcagaggaaaccttgaagccttctcatgcaagcacactgcgacagaccgccggctttcaattagcctagaacatgagattcttgattacttaggaaagtcctctgacagtgacccttcttcaccagtggagcacctatcctccagatcaagccggaagacattgatatatctagttcttactcttgggcacatgtatccagattatgatttcagtgctgttcgggcacacttgttcttccaagaagaggagatggaaagtttcaagcagatgatagacacctacttatctgatgcttctaggcaatgggcagcaacaaatgagggcagttctcttctggacagtatgactaaagctattgatgaggttatcaaaatcagagagtgtgacatctacagctataacccagactctgatggagatccagttcaagagaaaggggccatatggtcattctactacttcttctacaataggaagctaaagcgagttgtgagctttcgatgttactgcactagcaaattatcagcagatgacttcctaactggtgtggcgtctgatggtgaagaggaagatgccttgattgacatggacatatgactgaccgcgttctgctcagaacctgttgtgtgtgtgtaatatatagcgtatatgccctattcccgttaggaagcttttaatataacttcccttttatcgtagcctgcggaagctatggctcttgttagcgttgtatatgcggattggagattcggtagcggcaaacttttaatccctgaggtttgaactgtcacgctatgttcgtactctagtgcttgctggaactgaattctatgtcctgcttagttaaagaataaaatatttcagac

SEQ ID NO: 33364 - protein, 224 aa, Panicum virgatum
  misc_feature: Ceres CLONE 1950358
  misc_feature (25)..(193): Pfam Name: Maf1 Pfam Description: Maf1 regulator
MKFLEYTPFDSINLFLDQLNLGDCAIRGNLEAFSCKHTATDRRLSISLEHEILDYLGKSSDSDPSSPVEHLSSRSSRKTLIYLVLTLGHMYPDYDFSAVRAHLFFQEEEMESFKQMIDTYLSDASRQWAATNEGSSLLDSMTKAIDEVIKIRECDIYSYNPDSDGDPVQEKGAIWSFYYFFYNRKLKRVVSFRCYCTSKLSADDFLTGVASDGEEEDALIDMDI

SEQ ID NO: 33365 - DNA, 827 bp, Panicum virgatum
  misc_feature: Ceres CLONE 1950361
  misc_feature: Encodes the peptide sequence at SEQ ID NO. 33366
ggagagatggctgagtggactaaagcggcggattgctaaacagaagcctcgtccgctcatctcctccctctgtttctccaccccttccccttctctcggactctctcgatccttgctcctctttcccttgcggcgacgactgggcgagcggcggcgccatttgttacgtcttcgtccagcccctttgccggcggcgagcatcctccaggtaattttcttgtctgtagcatagacaagatggttaatgcgatcaaggggttgttcatctcctgtgatatacctatggcacagtttattgttaatctgaatgcttcaatgccggcatcagagaggttcatcgtgcacatgctcgatcctacacacatgtttgttcagccccatgtggcagaaatgatcagaagcaaaataggggagttcagggaccagaatagctacgagaagccgcagtgaaggatcatcccaccttgcagtttgcattgtttccctccctcccaaagatgcataccttgcactcaaatctgcgcgactgctatagaatggttggttggatggcattgccatgcctcaccctgtcacccgtgatgatctagaataatgtatgtattcgtgtttctagtctcwgaagcagctgtatttcagtgacttatttgtatctcgggtgatctcttttttgtgccctttcgccattgggcaacccacttggtggcgccgataaattgaaagtgcgttgcctgcttaggaaagggtaagatgtcttgcatgtattgctgttgtggactcgactctgatgtttgtgagctttttatgagtcgatggttccgtgaaat

SEQ ID NO: 33366 - protein, 70 aa, Panicum virgatum
  misc_feature: Ceres CLONE 1950361
  misc_feature (1)..(70): Pfam Name: Tbf5 Pfam Description: Transcription factor TFIIH complex subunit Tfb5
MVNAIKGLFISCDIPMAQFIVNLNASMPASERFIVHMLDPTHMFVQPHVAEMIRSKIGEFRDQNSYEKPQ

SEQ ID NO: 33367 - DNA, 1006 bp, Panicum virgatum
  misc_feature: Ceres CLONE 1950387
  misc_feature: Encodes the peptide sequence at SEQ ID NO. 33368
gtgccttgcagcccgtctggtaagctggtgcagatcgagcacgccctgacggcggtgggctctggccagacctccctcgggatcaaagctgctaatggagttgttattgccactgagaagaaactgccgtctattttagttgatgaaacatctgtgcaaaagattcaagcgttgactccaaatattggagttgtttacagtgggacgggtccagatttccgcgttctcgtgaggaaaagccggaagcaagcacagcagtattaccgattgtacaaggaatctatacctgttacacagcttgtcagagaaaccgctgctgttatgcaggagttcacacagtctggcggtgtaagaccatttggtgtatctttgttgatagctgggtatgatgacaatggaccccagttgtatcaggtagatccatcaggatcatacttctcctggaaagcatcagcaatggggaaaaatgtgtccaatgcaaagacatttcttgagaagaggtacacagaagatatggagctcgatgatgccatccatactgcaattttgactctgaaagaaggatacgaagggcagatctcgtccaacaatattgagatcgggataattcgacctgaccgtgagttcagggttytgagccctgcggagatcaacgatttcytggaagaggtggagtaaagcctggccctcgacaattcgcgggttccaaagatgatgagaaatgcaaaagcccaagcagctcccaccgcctaagttcatcacatcttcaggattctttttccaaatcttttgagctgattatcagcggcatgtcgtagactcggtaggagcagctaggcttccaggtagatgtaggtgcgtcgtgcatgctgtaccctgcttgtcgcactgcccgccacttgcctggcgagcttacaatgtgcggtggtgcccgtcctcgtgtgtcccccgggggcccatgtacaacgtccatttcaccgtcccgatcagaggtcagccagcatcc

SEQ ID NO: 33368 - protein, 225 aa, Panicum virgatum
  misc_feature: Ceres CLONE 1950387
  misc_feature (19)..(203): Pfam Name: Proteasome Pfam Description: Proteasome A-type and B-type
  misc_feature: SWISSPROT Homolog: EC 3.4.25.1 Proteasome endopeptidase complex
VPCSPSGKLVQIEHALTAVGSGQTSLGIKAANGVVIATEKKLPSILVDETSVQKIQALTPNIGVVYSGTGPDFRVLVRKSRKQAQQYYRLYKESIPVTQLVRETAAVMQEFTQSGGVRPFGVSLLIAGYDDNGPQLYQVDPSGSYFSWKASAMGKNVSNAKTFLEKRYTEDMELDDAIHTAILTLKEGYEGQISSNNIEIGIIRPDREFRVLSPAEINDFLEEVE

SEQ ID NO: 33369 - DNA, 632 bp, Panicum virgatum
  misc_feature: Ceres CLONE 1950407
  misc_feature: Encodes the peptide sequence at SEQ ID NO. 33370
ttgtgaagatgtggatcgcagaaggctttgtgctgagcaggggaagcaaaacagcagaggaggtggctgagaggaacctcaccgagctgatcaactgcaatcttctggtaattgggcataatgacgagcaaggacgggtgagaacctgtaggatgcatcctattatgcgagatctggttcttgttgttgcgaaacaggagagatttggctctgcaaatgactatagaagaatgatacagatgaataaggatgttcgtcgtctgtcatcttatggatggaaagacaatactccaataaaagttaattttccccagcttcggactcttgtatcacttggaacagtttcatcctcccctggcatgttgtcatcaattttgtctgaagccacctaccttactgtgctcgagctacaagattctgaggtcactgaattaccagcatctatagggattctgttcaacctacgttacattggcttgcggcgcacgaaggtcaagttactccctgactctgttgtgaatctatctaacctcctcactttggacatcaagggaacaaaaatacagaggttaccaagaggactcgggaaggtcaagaagctacggcaccttatggctgatagatgtgctgat

SEQ ID NO: 33370 - protein, 209 aa, Panicum virgatum
  misc_feature: Ceres CLONE 1950407
  misc_feature: SWISSPROT Homolog: EC 3.1.13.4 Poly(A)-specific ribonuclease
VKMWIAEGFVLSRGSKTAEEVAERNLTELINCNLLVIGHNDEQGRVRTCRMHPIMRDLVLVVAKQERFGSANDYRRMIQMNKDVRRLSSYGWKDNTPIKVNFPQLRTLVSLGTVSSSPGMLSSILSEATYLTVLELQDSEVTELPASIGILFNLRYIGLRRTKVKLLPDSVVNLSNLLTLDIKGTKIQRLPRGLGKVKKLRHLMADRCA

SEQ ID NO: 33371 - DNA, 257 bp, Panicum virgatum
  misc_feature: Ceres CLONE 1950407-R
  misc_feature (236)..(236): n is a, c, t, g, unknown, or other
gaaacttcagaagtcagtggcacaacaatagaatgttcgagaagatgcaacacgttttaaagattgacatctaggagagccaaattgttacttctggtcgtgttcacagaactttctatgttgtagttttaatcgtcctccttttacaacgagtaggagcactacatttccatctgggttgtagttgaagactgtataacaacttgtcttgaaacattggcttgcaatgccttcanagatgttttgttttttggatc

SEQ ID NO: 33372 - DNA, 1169 bp, Panicum virgatum
  misc_feature: Ceres CLONE 1950465
  misc_feature: Encodes the peptide sequence at SEQ ID NO. 33373
aagatcaaagatgaaggctgctggtcagacccagaagcctgcaggaacaaccaggtaagtaggtaactgtaaacacagctgcagtcaatgtccggcagatttgaattggtcacttcgccctgggcgactgcaggactggtactctgttgccaagaggtgcacttgagtatgggaagcaaaccgggctggatgttgttactgtcaacccagccctggtcttcggtccccttctgcagccaacgctcaacacaagctgccagttcctcgtctacttcctgaaaggaggccctgatcaaatgaggaacaaactttggcacatcgttgatgttcgggataccgccgatgctcttttgctggtctatgaggcacctgaagcctctggtaggcacatctgcgcacctcacttcatcagcgcccgtgaccttctggacttactgaagagcatgtacactgagtaccctttcatgagcaaggagagcatctgtgacatggatcacccagctccaatgacgtctgacaagctgaagaaactggggtggaaggccaggccgttgaaggaaactatcgcggataccgttgagttctgcaagaacgctgggtttcttgaggatgtggaggggagtccctgccgttttcctgatgttttacacaaaatctagcttgagaaagaatcttattggatttcgttgkggcttcgatgtctcctcggacggatgttgcttctcggtgccttcggtttgggggttggcaacgtgaagtcggagctgctgcgtcagaggcgtggctcggcaacgatgacacatgtcgaccctccctacagctgggaatctacatcctccggggacgaggcgagagttcatgatcggaagtcggagctgctcttcacggggtgtcgagcttggcaacgataactggttgtggctacttacttcgggaccggtggtatgtggtttgtgggtggcctgccatgggaagtcggagctgttggcagctttgcttccatgctcggcaataataacctttggtagtgtgtcgtgtattgcactctatcgtgtcgcgtgggttggtagcctctcgggaggtcttttttaaattctcattgggctattgttttcttgtactcgattcctttcgacttaattgatcggcagagctcctgcctttagttc

SEQ ID NO: 33373 - protein, 120 aa, Panicum virgatum
  misc_feature: Ceres CLONE 1950465
  misc_feature: SWISSPROT Homolog: EC 1.1.1.219 Dihydrokaempferol 4-reductase
  misc_feature: Functional homolog of the protein sequence given in SEQ ID NO 50443
  misc_feature: Useful for making plants with altered carbohydrate content
MRNKLWHIVDVRDTADALLLVYEAPEASGRHICAPHFISARDLLDLLKSMYTEYPFMSKESICDMDHPAPMTSDKLKKLGWKARPLKETIADTVEFCKNAGFLEDVEGSPCRFPDVLHKI

SEQ ID NO: 33374 - DNA, 709 bp, Panicum virgatum
  misc_feature: Ceres CLONE 1950488
  misc_feature: Encodes the peptide sequence at SEQ ID NO. 33375
ccccccccccccccaatctaccacaaacaatccacgaaaccctagtccatacgggggcctcgaattggggtcttggcgctggggatttcagccgtctgggcatggatttggatctgtggatcgccaaggtcaaggaggggcagcacctcgccgagcacgagctccagtccctgtgcgaatacgtgaaggagattctcatcgaggagtcgaatgtgcagcctgtcaacagccctgtgacagtgtgtggtgacatccacgggcagtttcatgacctgatgaaactttttgcgactggagggcatgtccccgatacgaattacatatttatgggtgactttgtggatcgcggattcaacagcctagaggtcttcacaatccttttgctcctaagagcaaggtaccctgcccacataacccttctacgcgggaatcatgaaagcaggcagttgacacaggtgtatggtttttatgatgagtgtcagaggaagtatggaaatgccaatgcatggcgatattgtaccgatgtttttgattaccttactctttcagcaatcatcaatggcacggtcctttgtgttcatggtggcctttcacctgatgtacggactgttgatcagatacaagtcatcgatcgcaattgtgagattccccacgaagggcctttctgtgatctgatgtggagtgaccctgaagagatagatacatgggc

SEQ ID NO: 33375 - protein, 202 aa, Panicum virgatum
  misc_feature: Ceres CLONE 1950488
  misc_feature (43)..(198): Pfam Name: Metallophos Pfam Description: Calcineurin-like phosphoesterase
  misc_feature: SWISSPROT Homolog: EC 3.1.3.16 Phosphoprotein phosphatase
  misc_feature: The sequence is a functional homolog of SEQ ID NO 13 in US patent 7271316
MDLDLWIAKVKEGQHLAEHELQSLCEYVKEILIEESNVQPVNSPVTVCGDIHGQFHDLMKLFATGGHVPDTNYIFMGDFVDRGFNSLEVFTILLLLRARYPAHITLLRGNHESRQLTQVYGFYDECQRKYGNANAWRYCTDVFDYLTLSAIINGTVLCVHGGLSPDVRTVDQIQVIDRNCEIPHEGPFCDLMWSDPEEIDTW

SEQ ID NO: 33376 - DNA, 369 bp, Panicum virgatum
  misc_feature: Ceres CLONE 1950488-R
  misc_feature: Encodes the peptide sequence at SEQ ID NO. 33377
gtacatgtttgataaaggccttgtaactgtgtggtctgcgcctaattattgctacagatgtggcaatgttgcttctatactaagcttcagtgagaatatggaaagggaggtcaagttcttcacagagacagaggaaaataaccagatgcgagggccaaggagtgcagtcccatattttctttgaccctgtctgtacaatttttttttacctgtggatcttatttgtatgggctaaacggcattggataggtgttcatacttgtaggtttcagctcagaacgcaatctggtgcattgtatgtcaggttattttttcttgcctgtacaatagatattgaaagaaatactgctctttctcatgacctccatc

SEQ ID NO: 33377 - protein, 60 aa, Panicum virgatum
  misc_feature: Ceres CLONE 1950488-R
  misc_feature: SWISSPROT Homolog: EC 3.1.3.16 Phosphoprotein phosphatase
YMFDKGLVTVWSAPNYCYRCGNVASILSFSENMEREVKFFTETEENNQMRGPRSAVPYFL

SEQ ID NO: 33378 - DNA, 1095 bp, Panicum virgatum
  misc_feature: Ceres CLONE 1950493
  misc_feature: Encodes the peptide sequence at SEQ ID NO. 33379
aagcaaatcctatctcgaatctgtgaaccccaaccaaatgacgccgacggcgagcctcctcctcccggctccccccttcgtctccatctccgatgtgcgccgcctccagttcctcccgcgcggccgccaccgacctctcctctgctggagcggcgcggtgtggggctctgtgcggacccagatgctgtcttctttcgtcgggagcagaagatcgagccgcagaagcgttatctgcgcttccctgtttggggttggtgctcccgaagcattggtcattggagtggttgccttgttggtgttcggccccaagggtctagcagaggtagccaggaatttggggaagactttgcgtgctttccaaccaaccattagagagttacaggatgtatcaagggagttcaggagcacacttgaacgagaaattggaattgatgaggttcccccctccacgaattataggcccacaaccacgaataacaacgaacaacctgccgccaacccaaatgttaagcctgaagctgctccttatactagcgaggaactcatgaaagtaactgaagaacaaattgctgcatcagcggctgctgcctggaatactcaacctgccccatcacaagagcaagaagcagcaccccccaattcaaagtaccggcgctgctacatcaggaggtaatgatggtcccgcagctcctgctcctgcaaccgagtctggtccaagcgaagcaaatcagtctgagaaggtggaaagcgagcgaagcaaatcagtctgagaggcggaaagcgagcgataaagccagtggatgggaagagcaaatcagggcgaggaattttgctcagttttttttccctgaggcgggcgagggttgtatgaaatgcttatagtgcttaggcctattctgtttatcttgtgctgctgttgtagatgttgaagaaggctgtgtatatttcctggtagtgcgtctcacgctgccacggctgctgttgtgccgtcgtcagccttgtaacatttctgagcctgtcgtagccacgagagtttgttgtatggagcaatgagtttaatcatgactcaacggagaggcgattgattccgttctc

SEQ ID NO: 33379 - protein, 211 aa, Panicum virgatum
  misc_feature: Ceres CLONE 1950493
  misc_feature (72)..(154): Pfam Name: MttA_Hcf106 Pfam Description: mttA/Hcf106 family
MTPTASLLLPAPPFVSISDVRRLQFLPRGRHRPLLCWSGAVWGSVRTQMLSSFVGSRRSSRRSVICASLFGVGAPEALVIGVVALLVFGPKGLAEVARNLGKTLRAFQPTIRELQDVSREFRSTLEREIGIDEVPPSTNYRPTTTNNNEQPAANPNVKPEAAPYTSEELMKVTEEQIAASAAAAWNTQPAPSQEQEAAPPNSKYRRCYIRR

SEQ ID NO: 33380 - DNA, 982 bp, Panicum virgatum
  misc_feature: Ceres CLONE 1950499
  misc_feature: Encodes the peptide sequence at SEQ ID NO. 33381
attcctttttcctttctggagcagttccctttctggagctgctccgggcgtgctctcacttcttcattttcctctcggccacccttggaattggaagacgacctcacgcggggcttcgaatattccttgtcttctcggctcgcaagtgaagctggaggaagcggaggggctcgcgatggggtccgagggaccgtcggctccggtcgtcgttcccagaaacttcaggctgctagaagaactagaacgtggtgagaagggcattggtgaagggacagtgagctacgggatggatgatgctgatgacatttatatgcggtcctggacaggaactatcattggccctcccaatactgttcacgagggacgaatctatcaattaaagcttttctgtgatacagattatccagataaaccaccaactgttcgatttcagactcgaatcaatatgacatgtgtgaacaaagaaactggattggttgaaccaagtctatttcctatgcttggaaactggcaaagggaacatacaatggaggacatcctaaccagcttaaaaagggagatgtcgactcctcagaatcgcaggctgcaccagcctcaagaaggtaatgaagaccaaagagtagagcagaaagggctgcctcrtagatgtgtcatcatgtaacagatgtgcatkgcaatgtacagcttgagttgagtagcatgattgcttgggatgcagaagtgaggaaccttttcaggaaatcgtgttaattttgtgcaaactgcgcaagagttgcaataaagtatcgaggtctatgttgattggcgtgcgcaccatgtaacatgttaccccattcaggttcagtgaaggacaatgagcttcacatcgctcattttgcctgtttgtaaacagtatgtagtatgtaccgtcgggttatctgtgtaggcctgttgttttatacaggaacagggtattgataaatatcacagcctgattggttgt

SEQ ID NO: 33381 - protein, 161 aa, Panicum virgatum
  misc_feature: Ceres CLONE 1950499
  misc_feature (17)..(159): Pfam Name: UQ_con Pfam Description: Ubiquitin-conjugating enzyme
  misc_feature: SWISSPROT Homolog: EC 6.3.2.19 Ubiquitin--protein ligase
  misc_feature (156)..(156): Xaa is any aa, unknown, or other
MGSEGPSAPVVVPRNFRLLEELERGEKGIGEGTVSYGMDDADDIYMRSWTGTIIGPPNTVHEGRIYQLKLFCDTDYPDKPPTVRFQTRINMTCVNKETGLVEPSLFPMLGNWQREHTMEDILTSLKREMSTPQNRRLHQPQEGNEDQRVEQKGLPXRCVIM

SEQ ID NO: 33382 - DNA, 705 bp, Panicum virgatum
  misc_feature: Ceres CLONE 1950501
  misc_feature: Encodes the peptide sequence at SEQ ID NO. 33383
tttgcgctactgatcttgtaaatgagtatggtgcaactgtccaaagagcccatgacttcttgaaacattcccagcttatgtggaatcatcctggtgacctaagttactggcatcgtcatataacaaagggttcatgggctcattcaactgcagacaatggatggggtgtatctgataataccggagaagcactcaaggctacactcttactatcaatgatgaagagcagcattgttggtgatccaatacagagagataggttgcatgatgctgttgatttccttctatcaattatgaacaaagatggttccttttcaacgtacgaatgtgaaagaacttattcctggttagaggtaagttttgtatattacgttgcaacattacagcagagcatcttactctctaaccactatgcttttctttttcttctgtggagaacaactgatcgatgcctactttgaacagctaatgcctttcctgatttcgttctcgattgttccctccataggatgttgtaacttgtcaacgtaacgtaactaatcaattcagtcacctattcggtcatggtcagtctagactttgattctgtaagctgccaatactcaacagaccacaactgttatacatttatatgttacgtccatatataatagggatctagtttttttcaggtaatgtatagtacttcatgttattaatggcact

SEQ ID NO: 33383 - protein, 152 aa, Panicum virgatum
  misc_feature: Ceres CLONE 1950501
  misc_feature: SWISSPROT Homolog: EC 5.4.99.8 Cycloartenol synthase
  misc_feature: The sequence is a functional homolog of SEQ ID NO 15 in US patent 7186884
  misc_feature: The sequence is a functional homolog of SEQ ID NO 6 in US patent 7122717
CATDLVNEYGATVQRAHDFLKHSQLMWNHPGDLSYWHRHITKGSWAHSTADNGWGVSDNTGEALKATLLLSMMKSSIVGDPIQRDRLHDAVDFLLSIMNKDGSFSTYECERTYSWLEVSFVYYVATLQQSILLSNHYAFLFLLWRTTDRCLL

SEQ ID NO: 33384 - DNA, 682 bp, Panicum virgatum
  misc_feature: Ceres CLONE 1950504
  misc_feature: Encodes the peptide sequence at SEQ ID NO. 33385
ggcttgcctgaagatttggcaaagatatgtcttgcccttgttcctcgtagtcattttcctgttatgggtgcagtttccaagcggtggatgtcatttcttgagagcaaggagttaatagctgtaaggaaggaggttgggaaacttgaggagtgggtgtatgtcttaactccagaagcaggcacaaaggggtcccactggcagattttggagtgttcagggcaaacacaaagccctcttccgcgtatgcctggactaaccaaagctgggtttggtgtggttgttattggtgggaagctctttgttattgctggctatgctgctgaccatggaaaggaatatgtttcagatgaggtgtaccagtatgattcttgcctcaacaggtggactttgcttgctaagatgaatgtggctcgatgtgacttcgcctgcgcagagatcaatggggtgatatatgttgccggtggatttggtccaaatggtgacaatttgtctagtgtcgaagtttatgacccagaacagaatagatggacactgattgagagcctgcgcaggccaagatggggttgcttcgggtgcagcttcgaagggaagctttatgtcatgggtggccgttcaagcttcacaattggcaactcccgtttcgttgacgtgtacaatcctatcaaccatgcctggggtgagt

SEQ ID NO: 33385 - protein, 227 aa, Panicum virgatum
  misc_feature: Ceres CLONE 1950504
  misc_feature (86)..(135): Pfam Name: Kelch_1 Pfam Description: Kelch motif
  misc_feature (137)..(183): Pfam Name: Kelch_1 Pfam Description: Kelch motif
GLPEDLAKICLALVPRSHFPVMGAVSKRWMSFLESKELIAVRKEVGKLEEWVYVLTPEAGTKGSHWQILECSGQTQSPLPRMPGLTKAGFGVVVIGGKLFVIAGYAADHGKEYVSDEVYQYDSCLNRWTLLAKMNVARCDFACAEINGVIYVAGGFGPNGDNLSSVEVYDPEQNRWTLIESLRRPRWGCFGCSFEGKLYVMGGRSSFTIGNSRFVDVYNPINHAWGE

SEQ ID NO: 33386 - DNA, 253 bp, Panicum virgatum
  misc_feature: Ceres CLONE 1950504-R
tacaacttttatgggctcgttgcatcccaaacaataatttgacagttatgtgtcggttcattgaattgccatagcaccatgatgtgttcttacctcacttgtattgaactctagttctggccatagggccttccattgataattgtcattttgctgttcacccacgttataacagcaggcagctgtgttcgtagctgctgctcagttgtaatagttcatggttgcattgtggcaagcaaaatggttatcagtg

SEQ ID NO: 33387 - DNA, 572 bp, Panicum virgatum
  misc_feature: Ceres CLONE 1950519
  misc_feature: Encodes the peptide sequence at SEQ ID NO. 33388
atcccatcccatcgaatctaccagctagcaaggtaggaggggggtgattcgattgattgcctggcttccctcccctcaaatcgagatcgaaatccccatgctgatgttgctaggctaggagcctcgatgagattccccttcatcaatttcagttatctgcctgcttccccttcgtccgccggggtgcgcgcgacaagtatgtgccatgctacagcgccccgtgcaggttcccttcacttcacacatccaaccagttcttgacgagatacacctttcaagttttgaacaccgtgaaatgatcctctgatccgacatgggcctcaaggaacagcatccgcaacccaacaccactgatcaaactgatgccgatcactctcctactgctgatgaccaccacaatccagccatcccccgtgtatcaagctgcagcactgataacgattctggcctttcactttgccgggtctgtcattgcgacgagactgatttcagaggcgagtctgccctacgtttcttggacattgtgccgccttcgagagagccttccgacccaaagaccaacaatgatgcta

SEQ ID NO: 33388 - protein, 86 aa, Panicum virgatum
  misc_feature: Ceres CLONE 1950519
  misc_feature: Functional homolog of the protein sequence given in SEQ ID NO 50797
  misc_feature: Useful for making plants with modulated nitrogen use efficiency
MGLKEQHPQPNTTDQTDADHSPTADDHHNPAIPRVSSCSTDNDSGLSLCRVCHCDETDFRGESALRFLDIVPPSREPSDPKTNNDA

SEQ ID NO: 33389 - DNA, 604 bp, Panicum virgatum
  misc_feature: Ceres CLONE 1950523
  misc_feature: Encodes the peptide sequence at SEQ ID NO. 33390
aataagcagatctcatgcaagctgcagctgacgaacaagacagacaagcaggtcgcgttcaaggtcaagacaacgagcccgaagaagtactgcgtccggccaaacaatggcattgtggcaccccggtccacagccgatgttgttgttacaatgcaagcgcagcgggaggcgccaccggacatgcaatgcaaggacaaattccttgtgcaaagcgccattgtagccaaggagattgtgccaaaggaagtcaccggagacatgtttaccaaagaatcaggcaatgtggttgatgaagtgaaattgaaggtggtttatctcacgccgtccacccaaagcgagggatttgaggatggttctgcgggcagtttgaattatcaagagccatttgctttgatttcgaaactgatggaggagaagaattctgctgttgaactgaacaacaagcttcggcaagaattggaccttctgaggcgaaacatcagcaggcagcacggtggtttctcattagttttagtactggtggttgctattatgggaatactactaggtttcctcatgaagagatgagtgcataacgatttatcttgtttggcatttcttttca

SEQ ID NO: 33390 - protein, 188 aa, Panicum virgatum
  misc_feature: Ceres CLONE 1950523
  misc_feature (1)..(93): Pfam Name: Motile_Sperm Pfam Description: MSP (Major sperm protein) domain
NKQISCKLQLTNKTDKQVAFKVKTTSPKKYCVRPNNGIVAPRSTADVVVTMQAQREAPPDMQCKDKFLVQSAIVAKEIVPKEVTGDMFTKESGNVVDEVKLKVVYLTPSTQSEGFEDGSAGSLNYQEPFALISKLMEEKNSAVELNNKLRQELDLLRRNISRQHGGFSLVLVLVVAIMGILLGFLMKR

SEQ ID NO: 33391 - DNA, 1049 bp, Panicum virgatum
  misc_feature: Ceres CLONE 1950556
  misc_feature: Encodes the peptide sequence at SEQ ID NO. 33392
gttgtgccatctgtagctctataaattggtgcagctattggtcaccccgtatcaagtgatcattcgcactagcaaccttgcattgcattattagtacgtagagagcgatggccagagaaatggagaaggcaaggaaggccacttcttcccctaagacgtcaacgatgaatgctggtccaaagagcccagtaaggaatggaggaggttctccgcctcagaagaagaacacctctgagccacgaggacggaaaaatgagcagcaaatcgttcagaatggaggtcaagaccatgatgagggcaaacgccgatctccaacttcacaaacctcacccaagagatcaccaagactcggtcaacccctgagctactgtaggcttcacactgaggagcgagcaataaggcgagccggttacaattatcaggttgcaagcaagataaatacacaggaaattattcggagatttgaagagaagttagcacagttgatggaggagcgcgaaataaagctgatgaggaaggagatggttccgaaggcccagctcatgccatcgtttgacaaaccattccacccacaaaggtctacgaggccgctgacagtccccaaggagccgagcttcctgaagctgaaatgctgcatcggcggagagttccatcgccatttttgctacaacggatcagcagccaaggccatcaagtagtagcctatgcatgcgcctacaaagtacaagatgaagtatttttttgccgttgcctgatgaacctacatgcatatgtagaagtggttgctgatggatgtaaatttccccggccttagcttgccccttctttttctcctctttatcttttatatacttcctttcatctttttcttttcttttcctcttcttgtttttctcttccacgatgggatcatcacacagctgaaagcaaggtaggaattaaaccatgcaaaaggggccacttgatccgatccgatccggacgatgcatgcatgcgccatgtacgcctgtctgatggcagtaataaagcaaggttgcacatagagttcc

SEQ ID NO: 33392 - protein, 196 aa, Panicum virgatum
  misc_feature: Ceres CLONE 1950556
  misc_feature (90)..(146): Pfam Name: TPX2 Pfam Description: Targeting protein for Xklp2 (TPX2)
MAREMEKARKATSSPKTSTMNAGPKSPVRNGGGSPPQKKNTSEPRGRKNEQQIVQNGGQDHDEGKRRSPTSQTSPKRSPRLGQPLSYCRLHTEERAIRRAGYNYQVASKINTQEIIRRFEEKLAQLMEEREIKLMRKEMVPKAQLMPSFDKPFHPQRSTRPLTVPKEPSFLKLKCCIGGEFHRHFCYNGSAAKAIK

SEQ ID NO: 33393 - DNA, 1170 bp, Panicum virgatum
  misc_feature: Ceres CLONE 1950558
  misc_feature: Encodes the peptide sequence at SEQ ID NO. 33394
aaaacgagcgtgctcgacctcccccacctcgccactgctcctattttcttctcctgaacgctgcggaaagcatggcgtccgtcaccgcccgcgccccggtcgcggccctccgcccgtcgtcggcgtcgctcaggtcatccttcctcggccactctagacgcctcggccgcggggccgcggcgccgacaaggcggaccctcacggccgaggccaagggcgagtggctccccggcctcccctcacccgcctacctcgacggcagcctgccgggcgacaatgggttcgacccgctgggcctggcggaggacccggagaacctgcggtggttcgtgcaggcggagctggtgaacgggcggtgggcgatgctgggcgtggccgggatgctgatcccggaggtgctgaccaaggccgggctcatcagcgcgccgcagtggtacgacgccggcaagtcggagtacttcgcgtcgtcgtccacgctcttcgtcatcgagttcatcctcttccactacgtcgagatccggcggtggcaggacatcaagaaccccggcagcgtcaaccaggaccccatcttcaagagctacagcctgccgccccacgagtgcggataccccggcagcgtcttcaaccccctcaacttcgcccccacgctcgaggccaaggagaaggagctcgccaacgggaggctggcgatgctggcgttcctggggttcctgatccagcacgacgtcaccggcaaggggcccttcgacaacctgctgcagcacctgtccgacccatggcacaacaccatcatccagaacctctccggttgagtcgacgacggtgagcgatcgccaatttgacattgagacgacgcggtcgagtcgatcgatgtgagttccttcctgtggatcgatcatcagcgtgtgatgtgtgttcagtctggaggggagaattcagggcgtgtttgtaattgtcatgctggtgtgcatggtgaggaggagtatgaggagtgattgtggtatgtacattaatgacaggggaggttaagggtagaaattgtttgatcatcagtgtctatccgttctgggccttttacttgcttgtccgtaagtgcttaattctgtgtggaattaaacagatgtacaatagctacagctttgttggaagctagcaatcttagctttgttt

SEQ ID NO: 33394 - protein, 246 aa, Panicum virgatum
  misc_feature: Ceres CLONE 1950558
  misc_feature (56)..(218): Pfam Name: Chloroa_b-bind Pfam Description: Chlorophyll A-B binding protein
  misc_feature: Functional homolog of the protein sequence given in SEQ ID NO 50113
  misc_feature: Useful for making plants with modulated oxidative stress sensitivity
MASVTARAPVAALRPSSASLRSSFLGHSRRLGRGAAAPTRRTLTAEAKGEWLPGLPSPAYLDGSLPGDNGFDPLGLAEDPENLRWFVQAELVNGRWAMLGVAGMLIPEVLTKAGLISAPQWYDAGKSEYFASSSTLFVIEFILFHYVEIRRWQDIKNPGSVNQDPIFKSYSLPPHECGYPGSVFNPLNFAPTLEAKEKELANGRLAMLAFLGFLIQHDVTGKGPFDNLLQHLSDPWHNTIIQNLSG

SEQ ID NO: 33395 - DNA, 830 bp, Panicum virgatum
  misc_feature: Ceres CLONE 1950559-R
  misc_feature: Encodes the peptide sequence at SEQ ID NO. 33396
cgtcaggggcgtggaggctgtacctgctccagctccagcagcacccgcttcgcacaaagatgatcacggcggggtgcctcgccggcgtcagcgactccgtggcgcagaagctctccgggtaccagaagattgagaagcgcaggctgttcctcaagatgctctttggttttgcacatggtggcccatttggacattttttgcacaaaattctggattatatcttccaagggaagaaggataccaaaactatagctaagaaggttttgctggagcaagtgacatcttctccctggaacaatttgttgttcttgttctattatggatatgttgttgagaggaggcctttgaaggaggtgaccatcagggtgaagaaacagtatccttctgtgcaattgagtgcttggatgttttggccgattgttggctggataaaccatcagtacatgcctttgcaattccgtgtgatcttccacagctttgttgcatgttgttgggggatatttctcaacctccgtgcaagggctatgtctctgaagcaggcttagatggtattggaggagcaaaatagcagcgcagctccaacccgagtactaactggccaaagaccaaggatgctggactctatatcctgtactgtttagaaacaaaaatcttcttcaagccattctagtagttcaaggctttcgactatttatcctgcagtagtcggtttattcaattgtcaacacgtgcaaagacagattaagcttttgtgaaacgtgatggaaccgatgtatgacgaatttacctgcatttgagaacagctcattctctgttttttttttcttttc

SEQ ID NO: 33396 - protein, 180 aa, Panicum virgatum
  misc_feature: Ceres CLONE 1950559-R
  misc_feature (109)..(174): Pfam Name: Mpv17_PMP22 Pfam Description: Mpv17 / PMP22 family
SGAWRLYLLQLQQHPLRTKMITAGCLAGVSDSVAQKLSGYQKIEKRRLFLKMLFGFAHGGPFGHFLHKILDYIFQGKKDTKTIAKKVLLEQVTSSPWNNLLFLFYYGYVVERRPLKEVTIRVKKQYPSVQLSAWMFWPIVGWINHQYMPLQFRVIFHSFVACCWGIFLNLRARAMSLKQA

SEQ ID NO: 33397 - DNA, 459 bp, Panicum virgatum
  misc_feature: Ceres CLONE 1950559
gggaccgagacgccgacccaactacccgagcatcgcggaatccgccgctccccggaaaaaaaaaaatcaagcgagtacagtacaaagggcgcgtgcgcagtgctcggttgtggccctgtgggaggaggagtaggtgggtagatcgatcggagcggttcgggcggggtcggaggccggccgccatggcagcagcgggaggagcggggcgggggggaggggaaggaggaggaggggatgggatcgatctacttacctactcctcctcccagggggccactaccgagcactgcgcacgcgccctttgtactgtactcgcttgatttttttttttccggctcttgttctagtccgtgttgcataatctttcttgttttcagcatattgacaagcacaagatgttcctcaacatgctcttggattttgcagatggtggcccataaatacattcttctctgatgg

SEQ ID NO: 33398 - DNA, 1201 bp, Panicum virgatum
  misc_feature: Ceres CLONE 1950561
  misc_feature: Encodes the peptide sequence at SEQ ID NO. 33399
ctccctcggtgcttctcctctctcgaaccccctttgattcttccccttctaccttctgaatctgctatccggattatcccagcagctatcgccgtctggacactacaggcggccagggatcgcgcccctcgatccccctcttccccggatgtgatcgaggtttgcacttttctcaattttctgcaccggagccgctggatgtgaatgatggggtgcgtaccaacaaagcatgctggtcggtcaccgcattcactggatacacgggaagctgtggcccttgcttccgaaacatcttttacagtaagtgaagttgaggcactacatgacctcttcaggaaaataagtaattcaatcatcaaagataatctaattagcaaggaagaattccacgttgctctatttaggaataagacgaagcaaaatctctttgttgatagggtatttgacttgtttgatcaaaaacgaaatggtgttattgaatttggtgaatttgttcgatctcttagtgtgtttcatccagatgcacctgaagaacaaaaagttgcatttgcatttaagttgtatgacttaagacagactggctttattgaacggaatgagttaaaggagatggtgttggctctgctagacgaatcagatttggatattacagctgatgctgtcgagatgattgttgataggacatttgaccaggctgacacaaaaggtgatgggaggatcgatcaagaagaatggactgcatttgctaaagacaatccatatgtactaaggaatatgacccttccataccttaaggacatcaccatggtattcccaagctttgtggttcactcagaaatcagtgaagcagatatggctgcctaacctgaaaagtgagaagtaactgcaagcatgcaacacacatcctgatctaaatactgatgaaaggacatgctgcaagcttgatgaaatactgatgaaaggacatgctgcaagctttttcatcaagaaaaggtttgaaacacgtcattcaagcacccgttgtggttagaattgtggactggctgcaaatggtggaagtaggaaatgagttttgttgtcttacctacaagcaaaagagcaatgtagcatccaactccagcatcactgaccaaatgtcttaacatgcacaagacacagcaatttgtctatttctgcttttgttacgttggagaatgctcag

SEQ ID NO: 33399 - protein, 218 aa, Panicum virgatum
  misc_feature: Ceres CLONE 1950561
  misc_feature (155)..(183): Pfam Name: efhand Pfam Description: EF hand
  misc_feature: SWISSPROT Homolog: EC 2.7.11.17 Calcium/calmodulin-dependent protein kinase
  misc_feature: Functional homolog of the protein sequence given in SEQ ID NO 50528
  misc_feature: Useful for making plants with modulated salt sensitivity
  misc_feature: Functional homolog of the protein sequence given in SEQ ID NO 51003
  misc_feature: Useful for making plants with modulated drought sensitivity
  misc_feature: Functional homolog of the protein sequence given in SEQ ID NO 51004
  misc_feature: Useful for making plants with modulated water use efficiency
  misc_feature: The sequence is a functional homolog of SEQ ID NO 2 in US patent 7250555
MGCVPTKHAGRSPHSLDTREAVALASETSFTVSEVEALHDLFRKISNSIIKDNLISKEEFHVALFRNKTKQNLFVDRVFDLFDQKRNGVIEFGEFVRSLSVFHPDAPEEQKVAFAFKLYDLRQTGFIERNELKEMVLALLDESDLDITADAVEMIVDRTFDQADTKGDGRIDQEEWTAFAKDNPYVLRNMTLPYLKDITMVFPSFVVHSEISEADMAA

SEQ ID NO: 33400 - DNA, 619 bp, Panicum virgatum
  misc_feature: Ceres CLONE 1950575
  misc_feature: Encodes the peptide sequence at SEQ ID NO. 33401
ctatcagtttatctatgaaactgaaaagcacaatggaattgcagagctattggagattttgggaagtatcataaatggattcgcgttgcctcttaaggaagaacataaattgttccttgttcgagctttaattccacttcacaagccaaagtgcattgggatgtatcatcagcagttgtcttactgcatcacccagtttgttgaaaaggattgcaaacttgcagacacagttatcagaggcctattgaaatattggcccatcacaaacagctccaaggaggtgatgtttttgggagagttggaagagatattggaagctacgcaacctgcagagtttcagaaatgcatggtccctcttttccggcagattgcacggtgcctgaatagctcacactttcaggttgctgagcgagcattatttttgtggaacaacgaccatattgagagtttgatcaaacaaaatagtagggttatattgcctatcatatttcctgcactggagagaaataccaacgggcactggaaccaagctgttcaaagcctcactctaaatgtttgcaaacttttctccgaccatgatgctggtctattcgcggagtgtctgcggaaatatgaggaa

SEQ ID NO: 33401 - protein, 205 aa, Panicum virgatum
  misc_feature: Ceres CLONE 1950575
  misc_feature (1)..(205): Pfam Name: B56 Pfam Description: Protein phosphatase 2A regulatory B subunit (B56 family)
YQFIYETEKHNGIAELLEILGSIINGFALPLKEEHKLFLVRALIPLHKPKCIGMYHQQLSYCITQFVEKDCKLADTVIRGLLKYWPITNSSKEVMFLGELEEILEATQPAEFQKCMVPLFRQIARCLNSSHFQVAERALFLWNNDHIESLIKQNSRVILPIIFPALERNTNGHWNQAVQSLTLNVCKLFSDHDAGLFAECLRKYE

SEQ ID NO: 33402 - DNA, 325 bp, Panicum virgatum
  misc_feature: Ceres CLONE 1950575-R
ttgatcctgaggcttggcttcttttggcatgctaagatatgcagttgattgctgtaccatttagccttgtccgaagttggttacagtttctttcacctgctggttatgcatccttctcgtgggtagtcggtggatagaacccctagttaagagtctgaaaatgactcattgttgttgttattcttgagtctggcatgggccatcattattgtaaatggaagtacaatttttctctcctgagtacaatatgagcaagtatagctcgctgatcgcttcaagcgcattgcatactcgttattagaaatcctttcagtttcagttcatc

SEQ ID NO: 33403 - DNA, 904 bp, Panicum virgatum
  misc_feature: Ceres CLONE 1950578
  misc_feature: Encodes the peptide sequence at SEQ ID NO. 33404
aggggaagggaggaatagagagagatgtgctaacccatgaactgctcttatgcacgcgacagccataagcattgctattagggtttcatgcagggcaaagcagccggtttccgacgcctgatagccgccggaatctgcgagatctccacgagcagcgtcctcggataaggcagccggcacggcaatgccggttccccttgccccgtatccaactcctccggtgccattcacaccccccaatggggcccaaagccagcttgtctgcaccgggtgccggaatcttctcatgtatccagctggtgcgacgtctgtctgctgtgcagtttgcagcaccgtcaccgccgtgccggctccaggaactgagatggcacagttagtttgcggaggatgccacactctcctgatgtacatacgtggggcaacaagtgtacaatgttcttgctgccacactgttaatctggctatggaagcgaatcaagtcgcgcatgtaaattgcgggaactgccgtatgctgcttatgtaccagtatggcgctaggtctgtgaaatgtgcagtctgcaattttgtgacatcagttggggcctcacctggtgcagagcagaagcccagcagctgatgttcctgaaaatactgagatcacatatgaaggcagcttctgaaaaggatgctttgagtgcacatgtatagagttcttcgctgaagcaatttttccccctcctttatctccactcttcccatccattacgcgttccttcgatggacctggcgagcccgcggaataatgagagttttgggaaataattagtgctcaacttcgtcgacttgtctgtaaaactgaatgagacatacataaacatatggcgttttgtgtgtttctgaatttctgaatgttccttttgactgc

SEQ ID NO: 33404 - protein, 143 aa, Panicum virgatum
  misc_feature: Ceres CLONE 1950578
  misc_feature (104)..(128): Pfam Name: zf-LSD1 Pfam Description: LSD1 zinc finger
  misc_feature (66)..(90): Pfam Name: zf-LSD1 Pfam Description: LSD1 zinc finger
  misc_feature (27)..(51): Pfam Name: zf-LSD1 Pfam Description: LSD1 zinc finger
  misc_feature: Functional homolog of the protein sequence given in SEQ ID NO 50129
  misc_feature: Useful for making plants with modulated oxidative stress sensitivity
MPVPLAPYPTPPVPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGAEQKPSS

SEQ ID NO: 33405 - DNA, 1133 bp, Panicum virgatum
  misc_feature: Ceres CLONE 1950592
  misc_feature: Encodes the peptide sequence at SEQ ID NO. 33406
ataccgcaactccacccaaaaccataaaaaccagtgcagcaacaatgagagataaaccttccagactctgaattttcagcatgttggcgccagcatcagcccaggtgcctcacaccatacgaccaattgcaaactgctttgggcttcatcgacgatctgtgctgaatttggaccgatatcacagatggcgggggactggaaagaagatgatcctttccactcgtggtgtgctcgaatccagcaatggtgcaccgtctggtggccttgtgaagaaaagaaagattgtggagcacattattctgcttcgagccaagccaaacatctcagacgctgaagagaaagatatgctggattatctatatacatcacaataccagatgagagggatactcacaatctcgttgggccgcatagaggagccaaatagcgagaactttacgcatgctgtcttcatgcgttttcagcagaaagaagacattgcgaagttccagagtagtgcctactattccaaaattcttgatgaccacgtaaaacctgtttcctatggctcagtttctgtagatttcgagtctgaggtggaagatgacattattcccctctttygtaggggagaggattttaactacggtgttgagtttatgttgctgatatctttcttggaaactgcatctcgagaggcaatggaggatgcatcatcttctctgcagaggctgatcagccaatgcagttcatttattgtgcaggcaacctgtggccactgtttgaatccggaaaacggatataatcacgctgcactgatccgctttccatcatctgatgactttaagttgttcagggagagcatggagtacaaggatatgtgggcatcaaagttccatccgattgtggagaaatccctccagatacatttcaccgtcgaccccgtggggaaccagctgatgtagaccagtcatgcctcagcactcttcaccgatcttgctgggagttgaactccatctctgctcattctggttgaaaaggatggaaatgttttactgtagtttgcgcactccgtcccaaagtgtcactgcaaattgtgctccagctccacaacttgttgttcaatatatataaataggagaagcgtgcttctt

SEQ ID NO: 33406 - protein, 287 aa, Panicum virgatum
  misc_feature: Ceres CLONE 1950592
  misc_feature (69)..(164): Pfam Name: Dabb Pfam Description: Stress responsive A/B Barrel Domain
  misc_feature (184)..(279): Pfam Name: Dabb Pfam Description: Stress responsive A/B Barrel Domain
  misc_feature (175)..(175): Xaa is any aa, unknown, or other
MLAPASAQVPHTIRPIANCFGLHRRSVLNLDRYHRWRGTGKKMILSTRGVLESSNGAPSGGLVKKRKIVEHIILLRAKPNISDAEEKDMLDYLYTSQYQMRGILTISLGRIEEPNSENFTHAVFMRFQQKEDIAKFQSSAYYSKILDDHVKPVSYGSVSVDFESEVEDDIIPLFXRGEDFNYGVEFMLLISFLETASREAMEDASSSLQRLISQCSSFIVQATCGHCLNPENGYNHAALIRFPSSDDFKLFRESMEYKDMWASKFHPIVEKSLQIHFTVDPVGNQLM

SEQ ID NO: 33407 - DNA, 719 bp, Panicum virgatum
  misc_feature: Ceres CLONE 1950619
  misc_feature: Encodes the peptide sequence at SEQ ID NO. 33408
agtcgagccgagcgctcctcctcctcctcctcctctctctctctctcttccccctcttcggttacccacccacctgaggggcgtctcgctgagctgcttgagcgcgccgtaccggtcgaggtccacctgtgctccgtctccgctgctacctgaagaaactccttataagttcctgcttttctctgtgggcgcatctgccactgtattggtaaagatgggttgctgctttatgtttggaaagaaagctgaacaggccgttcagggcgatgatgatgtacatagtgtgaaagtcttctcttacaatgagttgagaaaggctacacaagatttcagtggtggaaataagattggcgagggtggttttggttctgtcttcaggggagtgcttaaagatgggacagtagttgcagtgaaagttctatctgctacatcaaggcaaggtatccgggagtttttgactgaacttacagcaatatctgacatcaagcacgaaaatctggtcactcttatcggttgctgcgctgaaggctctcacagaatccttgtttacaattaccttgagaacaacagccttgctcagacattgctaggaaccaggtatagtaacattcggttcaactggcggacacgcgtcaaaattgctatgggtgttgcccgtggacttgcatttctccctgaagaaatccgacctcccattatccaccggggacataaaggcg

SEQ ID NO: 33408 - protein, 168 aa, Panicum virgatum
  misc_feature: Ceres CLONE 1950619
  misc_feature (39)..(168): Pfam Name: Pkinase_Tyr Pfam Description: Protein tyrosine kinase
  misc_feature: SWISSPROT Homolog: EC 2.7.11.1 Non-specific serine/threonine protein kinase
MGCCFMFGKKAEQAVQGDDDVHSVKVFSYNELRKATQDFSGGNKIGEGGFGSVFRGVLKDGTVVAVKVLSATSRQGIREFLTELTAISDIKHENLVTLIGCCAEGSHRILVYNYLENNSLAQTLLGTRYSNIRFNWRTRVKIAMGVARGLAFLPEEIRPPIIHRGHKG

SEQ ID NO: 33409 - DNA, 603 bp, Panicum virgatum
  misc_feature: Ceres CLONE 1950622
  misc_feature: Encodes the peptide sequence at SEQ ID NO. 33410
gattgctcatgtcctttgattcccttccgtgtgctgccgaaattccccttcctaccaacattttccacctccaaaatcgatgctggcctccactggtcttctgatccaagccggctggaatcctccatctccttcctgcaagatctgatactcaaggggaatcgagtacaactgccttgcaatgaggccggagacgcggcttgaatcggcggtgttccagctcaccccgacccgcaccaggtgtgatttagttgtggtggcgaatggaaggaaggaaaagatagcctctggtttgctgaacccattcatcgctcatcttaaggttgcacaagagcagattaccaagggaggctattccatcacacttgagccagatccagagattgatgcatcatggtttaccaggggaacagtggagagatttgttcgttttgtcagtacaccggaggtcctggagcgagtcacaacaatagagtccgaaatattgcagattgaagatgccatttccgtccaggtcaatgaaagccttggtttgagatctgcacctgtggaagaccgaaatgggaaattggtggactgcatggaagagctcaactgcttaga

SEQ ID NO: 33410 - protein, 140 aa, Panicum virgatum
  misc_feature: Ceres CLONE 1950622
  misc_feature: Functional homolog of the protein sequence given in SEQ ID NO 51410
  misc_feature: Useful for making plants with altered cell wall content and/or composition
MRPETRLESAVFQLTPTRTRCDLVVVANGRKEKIASGLLNPFIAHLKVAQEQITKGGYSITLEPDPEIDASWFTRGTVERFVRFVSTPEVLERVTTIESEILQIEDAISVQVNESLGLRSAPVEDRNGKLVDCMEELNCL

SEQ ID NO: 33411 - DNA, 575 bp, Panicum virgatum
  misc_feature: Ceres CLONE 1950633
  misc_feature: Encodes the peptide sequence at SEQ ID NO. 33412
atccagctcatacttccagttcaaacatcgtcttcagttccaggcaaggcggagcagcaaggcgatcacgatcagaaaggctgccgttttgtgttctccggcacggcagaggcactgctcgacttcaagcacggcatcaccagcgatccgaatggagccttgaacaattggaccacgaggtcccacttctgtcactggaatggtgtcaagtgcaccttggagcaaccacggcgcgtcagggggctccaactgacaagccaaagtttgtcaggccaaatcagctcatctcttggcaaccttactttccttcattaccttgacctctcctataataactttgttggtcccttacctcatctcggccgcctccaacaactgcatattctttatttatacaacaacagtttgtctgggataattcctgatgcacttacaaactgctccaacttgaccgccatagatttatcttcaaacttgctagtgggttcaattcctccgaaattaggtctactatccaatctaggatatctcaacttgatgtcaaatcaactcaatggaagcattcctggtgagct

SEQ ID NO: 33412 - protein, 191 aa, Panicum virgatum
  misc_feature: Ceres CLONE 1950633
  misc_feature (32)..(72): Pfam Name: LRRNT_2 Pfam Description: Leucine rich repeat N-terminal domain
  misc_feature: SWISSPROT Homolog: EC 2.7.11.1 Non-specific serine/threonine protein kinase
IQLILPVQTSSSVPGKAEQQGDHDQKGCRFVFSGTAEALLDFKHGITSDPNGALNNWTTRSHFCHWNGVKCTLEQPRRVRGLQLTSQSLSGQISSSLGNLTFLHYLDLSYNNFVGPLPHLGRLQQLHILYLYNNSLSGIIPDALTNCSNLTAIDLSSNLLVGSIPPKLGLLSNLGYLNLMSNQLNGSIPGE

SEQ ID NO: 33413 - DNA, 238 bp, Panicum virgatum
  misc_feature: Ceres CLONE 1950633-R
ctctttgggaaaacttacgaatttgactgtcttaaaccttcaaaataaccagcttgtagcaagggacaaacaggactgggaattcttgaatgcattaagtaactgtagatcgctacaacggcttaagttgcgtggaaacagcctgtctgggcaagttccatagagtatagggaaacttagtgccttgatttggcttggacttggtgagaacaattttagtggtacaattgatggatgg

SEQ ID NO: 33414 - DNA, 618 bp, Panicum virgatum
  misc_feature: Ceres CLONE 1950637
  misc_feature: Encodes the peptide sequence at SEQ ID NO. 33415
atccagtccccaatccgtcgagaaattcctcccgagccatcgaaatcgaagcgaagcgaagcggcctcccccgatcctctcaagatctttgttaagaccctcaccgacaagaccatcactttggaggttgagtcgtctgacaccattgacaatgtgaaggccaagatccaggacaaggagggcatccctccggaccagcagcgtctgatcttcgctggcaagcggcttgaggatggccgcaccctagcagactacaacatccagaaggagtccaccctccacctggtgctccgcctgcgtggtggtatgcagatctttgtgaagaccctcactggcaagaccatcaccttggaggtggagtcttccgacaccatcgacaatgtgaaggcgaagatccaggacaaggagggcatccccccggaccagcagcgtctgatcttcgccggcaagcagctggaggatggccgcaccctggcggactacaacatccagaaggagtccaccctccacttggtactccgtctgcgtggtggtatgcagatctttgtgaagaccctcactggcaagaccatcacctttggaggtggagtcttctgacaccattgacaacgtgaaggc

SEQ ID NO: 33415 - protein, 198 aa, Panicum virgatum
  misc_feature: Ceres CLONE 1950637
  misc_feature (108)..(176): Pfam Name: ubiquitin Pfam Description: Ubiquitin family
  misc_feature (32)..(100): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
IQSPIRREIPPEPSKSKRSEAASPDPLKIFVKTLTDKTITLEVESSDTIDNVKAKIQDKEGIPPDQQRLIFAGKRLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITFGGGVF

SEQ ID NO: 33416 - DNA, 624 bp, Panicum virgatum
  misc_feature: Ceres CLONE 1950643
  misc_feature: Encodes the peptide sequence at SEQ ID NO. 33417
ttctacacaagcattcctgttttaactaccgtcctggacaaggatttatctaaaaagacagtgatgcaaaacccagagatattactttactgtcaagctggaaggcttctcaatccaagcacttttgctggttggtttggtcgatcattgtatcatgcaatcattattttcttgataaccattcatgcatatgcgaatgagaaaagtgatatggaggagctgtcaatggttgcactctcaggaagcatttggctgcaggcatttgttgtgacattggagatgaattccttcacttttgtccaactcctggccatatggggaaacttcattgccttctatgtcatcaacttcttcatcagcagtataccagcttcaggaatgtacacaatcatgtttcgcctttgcagacaaccatcatactggataacactggtgctgatcagtggagttggaatgggtcctgtattagctctgaagtatttcagatatacatacagacctagcgctatcaacattcttcagaaggccgagcgctcacggggcccaatgtacacccttgtgaatctggagtctcaactgaagtcagacaaagataatatggtatcgagttccacaatgccagtc

SEQ ID NO: 33417 - protein, 207 aa, Panicum virgatum
  misc_feature: Ceres CLONE 1950643
  misc_feature: SWISSPROT Homolog: EC 3.6.3.1 Phospholipid-translocating ATPase
FYTSIPVLTTVLDKDLSKKTVMQNPEILLYCQAGRLLNPSTFAGWFGRSLYHAIIIFLITIHAYANEKSDMEELSMVALSGSIWLQAFVVTLEMNSFTFVQLLAIWGNFIAFYVINFFISSIPASGMYTIMFRLCRQPSYWITLVLISGVGMGPVLALKYFRYTYRPSAINILQKAERSRGPMYTLVNLESQLKSDKDNMVSSSTMP

SEQ ID NO: 33418 - DNA, 148 bp, Panicum virgatum
  misc_feature: Ceres CLONE 1950643-R
ccggattccccgaaggccaaaaccaattgctttcagcggaattggtagttgggcagttttgttaaggtttctagatattgcccgaaaagataaactgaaaagacagaagtcttttgtattctacactgtattctttacaccttgtagc

SEQ ID NO: 33419 - DNA, 644 bp, Panicum virgatum
  misc_feature: Ceres CLONE 1950655
  misc_feature: Encodes the peptide sequence at SEQ ID NO. 33420
ccggcgccactcgctcgtgccccccgcgcctctctccggtccctactcgcgtctggatccctcctccgatctctcttctctcgggggagcagggaggaggaggatggaaggccctcccgtcgcgcttttcgacagcctcggggctgccaaaactttcttcttgctagctgggaccaatgtgattgaatcggaggagcgtgtcctgaagatggccaaacacattaaaagcatccccaccaagcttgggatcccacttgtgttcatatctagcttcgatgaacccaatcatacatcatcaaagtctttccgtggccctggtctggaagaaggactgaatatccttgataaggtgaaagcgacatatgaccttccagatgtcactgatgtgcatgacagccaccagtgtgaagctgttggaaaagttgctgacattatacagattccagctttcctctgtcgccagactgatcttctcgtgggtgctgctgagactggaaaaattatcgatatcaagaaaggacaattctgtgcaccctctgttatggtcaactctgcggagaaaataagacttgctggagatcctaatgtgatggtctgtgagcgtggtaccatgtttggctacaatgatctaattgttgacccac

SEQ ID NO: 33420 - protein, 180 aa, Panicum virgatum
  misc_feature: Ceres CLONE 1950655
  misc_feature (10)..(180): Pfam Name: DAHP_synth_1 Pfam Description: DAHP synthetase I family
  misc_feature: SWISSPROT Homolog: EC 2.5.1.55 3-deoxy-8-phosphooctulonate synthase
MEGPPVALFDSLGAAKTFFLLAGTNVIESEERVLKMAKHIKSIPTKLGIPLVFISSFDEPNHTSSKSFRGPGLEEGLNILDKVKATYDLPDVTDVHDSHQCEAVGKVADIIQIPAFLCRQTDLLVGAAETGKIIDIKKGQFCAPSVMVNSAEKIRLAGDPNVMVCERGTMFGYNDLIVDP

SEQ ID NO: 33421 - DNA, 424 bp, Panicum virgatum
  misc_feature: Ceres CLONE 1950655-R
  misc_feature: Encodes the peptide sequence at SEQ ID NO. 33422
ttggtgttgatggtattgtcatggaggtacatgtatgatcccttgaatgcgccatgtgatggcccaacccaatggccattgcgcaatttggaggagctattggaggaattgttagcaatcgttcgagttaccaagggaaagaagccgttcaagattgatctctcaccgttcctaggaatgatctggtttggtagattgagagcacaatgacactgtccagtggtttcaccagggcgtatttgtcattgttgtacttgttattgttttgggcatagctgccgtagacaagtgttatatatgacctatgtgaattgaatcctgtggttgctttgtgttgtttcattggttatcccaggttatgggacaatcaatatcatgcaaaataaatgtgattgcttgcggattaccagctttctgtttcggt

SEQ ID NO: 33422 - protein, 69 aa, Panicum virgatum
  misc_feature: Ceres CLONE 1950655-R
  misc_feature: SWISSPROT Homolog: EC 2.5.1.55 3-deoxy-8-phosphooctulonate synthase
LVLMVLSWRYMYDPLNAPCDGPTQWPLRNLEELLEELLAIVRVTKGKKPFKIDLSPFLGMIWFGRLRAQ

SEQ ID NO: 33423 - DNA, 652 bp, Panicum virgatum
  misc_feature: Ceres CLONE 1950657
  misc_feature: Encodes the peptide sequence at SEQ ID NO. 33424
aaggaacagcaagaacagaaaaccagaggagcaatcccagcaatggcagcaaggtgtgctctttctgccccatccagctgcttggttcgccaacccctctgcggcaacgagctcgccaagaaactcactccatgcctgctgccgtcgccaagagccgtgagggtgagagtgaatgctgcaaagcttcctccaggggttgaggtgcccagggtgcagccgaagttgagcgagcccttcttggggttcacccagactgccgagatctggaactccagggcctgcacgatgggactcatcggcaccttcatcgtggagctggtgctgaacaaggggattcttcagataattggggtggaggtggggaagggcctcgaccttcctctttaattgccaatctgatggcaaccttactctctctgtttttttttctttttgaaacctagctactatatatttctctaaacattattctgtcgaatgaagatactcatgcaattctgttgtgtaaccatatgacagagttttttaagttctcaaagctatctgtgctgcacttgagaaaatcaaaagtattagaatatgagtcctaaacagcatagaaagggttttcaatactttagttatcctcggagcatggatcatctggaagcac

SEQ ID NO: 33424 - protein, 114 aa, Panicum virgatum
  misc_feature: Ceres CLONE 1950657
  misc_feature: SWISSPROT Homolog: EC 4.99.1.1 Ferrochelatase
MAARCALSAPSSCLVRQPLCGNELAKKLTPCLLPSPRAVRVRVNAAKLPPGVEVPRVQPKLSEPFLGFTQTAEIWNSRACTMGLIGTFIVELVLNKGILQIIGVEVGKGLDLPL

SEQ ID NO: 33425 - DNA, 311 bp, Panicum virgatum
  misc_feature: Ceres CLONE 1950657-R
gaacagttgcatttttttatggatctgcccctaccctccagaatgccctgcaggcctttcaaagtaaagcacttctttggcaatttgcaggagcaaaagggcttgccgccctaggtcttggccgtgtaggatagtggagccattagtgtgtttggctgtggtcagatcctagatcttttcttttttgtaatagtttctcttttggtgaggttgttttttttccccccccccatttggttccagggggggagtggttttattgtaattggactatctcttctccttaatacaaagatacgcagctctcatgt

SEQ ID NO: 33426 - DNA, 724 bp, Panicum virgatum
  misc_feature: Ceres CLONE 1950659
  misc_feature: Encodes the peptide sequence at SEQ ID NO. 33427
atataccgcaactccacccaaaaccataaaaaccagtgcagcaacaatgagagataaaccttccagactctgaattttcagcatgttggcgccagcatcagcccaggtgcctcacaccatacgaccaattgcaaactgctttgggcttcatcgacgatctgtgctgaatttggaccgatatcacagatggcgggggactggaaagaagatgatcctttccactcgtggtgtgctcgaatccagcaatggtgcaccgtctggtggccttgtgaagaaaagaaagattgtggagcacattattctgcttcgagccaagccaaacatctcagacgctgaagagaaagatatgctggattatctatatacatcacaataccagatgagagggatactcacaatctcgttggaggagccaaatagcgagaactttacgcatgctgtcttcatgcgttttcagcagaaagaagacattgcgaagttccagagtagtgcctactattccaaaattcttgatgaccacgtaaaacctgtttcctatggctcagtttctgtagatttcgagtctgaggtggaagatgacattattcccctctttcgtaggggagaggtatctcaagctgccttattctggcgcaaattggtaccattctttactatgtaaaatacccattgcatttcaacagaaaagctggtccttgtgtcaggattttaactacggtggtga

SEQ ID NO: 33427 - protein, 192 aa, Panicum virgatum
  misc_feature: Ceres CLONE 1950659
  misc_feature (69)..(161): Pfam Name: Dabb Pfam Description: Stress responsive A/B Barrel Domain
MLAPASAQVPHTIRPIANCFGLHRRSVLNLDRYHRWRGTGKKMILSTRGVLESSNGAPSGGLVKKRKIVEHIILLRAKPNISDAEEKDMLDYLYTSQYQMRGILTISLEEPNSENFTHAVFMRFQQKEDIAKFQSSAYYSKILDDHVKPVSYGSVSVDFESEVEDDIIPLFRRGEVSQAALFWRKLVPFFTM

SEQ ID NO: 33428 - DNA, 361 bp, Panicum virgatum
  misc_feature: Ceres CLONE 1950659-R
ggaaaacggatatatcccggggccatgatccgctttccattcttctgatgactttaagttgttcagggagagcatggagtacaaggatatgtgggcatcaaagttccatccgattgtggagaaatccctccagatacatttcaccgtcgaccccgtggggaaccagctgatgtagaccagtcatgcctcagcactcttcaccgatcttgctgggagttgaactccatctctgctcattctggttgaaaaggatggaaatgttttactgtagtttgcgcagtccgtcccaaagtgtcactgcaaattgtgctccagctccacaacttgttcaatatatataaataggagaagcgtgcttctt

SEQ ID NO: 33429 - DNA, 1018 bp, Panicum virgatum
  misc_feature: Ceres CLONE 1950693
  misc_feature: Encodes the peptide sequence at SEQ ID NO. 33430
acggttagttgatctgtggccagttggtcgcgcggccttgctgtgcctcgatttgtttgattccgttcctcgctgctcctcggtttgatttgattgattccgagaggttggtggtgataaggaaagcggaaaacgcacaccatgggatccaaagaacctctctttctcttgctcctctcgctgcttgtcgtctcggtgcttgcacaagccagggatgctgataacggcccagtctacaaggaacaaatctcttcaaccaagattcctgtccatcgcaagagtagtagcccaatatgctcagcctgcggaaacttcacgactcaagctctcagttatctcaatgagaagcaaacacaagataagatcagggaattccttcatgatgcttgttgtcagtcattctccttggaacggaagtgtgtagagttgatggactcttatgcaactatactgttttccaagattacggatatcaatccaaaagagttttgcaaacagtatggcctgtgcagggacatagcccttttctctggtgtgacaagtgacagcacttgtgtgttttgccatcacctgcttgatgaaattgtgtccaaactgaaagatccagacgcagagtttgagatcattcaaattctcattaaggagtgcaataagattgaaggtcatgtccagcagggcaagagactggtcgtgcaatacattcctctcatcgtggggaatggtgagaagtttgaagagaaggagggaggggtgcttgtttatacaagcgtgtccggccagcgaagtcttggaaggggtgttgctcagtgatgcttgaaggttgaaagaacgcgcgaagtatgtagcaatggtgcaaatagtgtgtacaaactagggcgagttgtacataataaggtcatgaatggatgaaggatgggtgtctcgtgtttctgcattcttttcatcttgtatcgtgaacacattgtattaagtaaactttcatatacatccagaaagtgcagatcgtgcagcattagtc

SEQ ID NO: 33430 - protein, 222 aa, Panicum virgatum
  misc_feature: Ceres CLONE 1950693
  misc_feature (135)..(173): Pfam Name: SapB_1 Pfam Description: Saposin-like type B, region 1
  misc_feature (49)..(88): Pfam Name: SapB_1 Pfam Description: Saposin-like type B, region 1
MGSKEPLFLLLLSLLVVSVLAQARDADNGPVYKEQISSTKIPVHRKSSSPICSACGNFTTQALSYLNEKQTQDKIREFLHDACCQSFSLERKCVELMDSYATILFSKITDINPKEFCKQYGLCRDIALFSGVTSDSTCVFCHHLLDEIVSKLKDPDAEFEIIQILIKECNKIEGHVQQGKRLVVQYIPLIVGNGEKFEEKEGGVLVYTSVSGQRSLGRGVAQ

SEQ ID NO: 33431 - DNA, 1170 bp, Panicum virgatum
  misc_feature: Ceres CLONE 1950698
  misc_feature: Encodes the peptide sequence at SEQ ID NO. 33432
gccttcgtgctgaacagatgccccgttctggagaagctcctgattgtcggcagccggtggccggtttgccttcgcgttcggagccacagcctacggttggtggaggtgtgccagggtcttgtgccagaaatcactgtgctgcacgctccacgcctggagaggctcttgttgtggcaagcttggggtggtgatgatttatgcaacatgtcctccaagatcatgattgtccatgccccgaagctatgtttcctaggattcttggtgcccggaatgcacaaactggagattgggaacaccattatcaaggctcagagtaaggcaagcccaagcaccactgttccgagtgtgcagatgctggcagttcagctcaaacttgaaacccgcattgaagcgaggttgttgccgagtttcctcagatgctttcccaatgttgagacactctacatccagtccgagaatgatgacctcaagttctggggacctcaatgcactggtgctggcaaattaaatttgaagttctggaaggaggcagggtccattgaatgtgttcagcgccatatcaagaaggtggttctccgtgagttccgtgggacgagaagcgagcttgacttcctcaagttcatagctgagcaagcacaagttcttgaaaagatggtgattgtgttgacccatggtcattccccttctgatccartaggtacaaacctgargaccaaaatggtttttgcaaagtgggccaatgcacgctgtgagctgatgatttttcagactccatttcatcaagaaggtacagcttggtgcttcctatctgcatttgatctttctaacccagatccttttgatgtttcaaaatgtctggatgggaaatgtcaaaatcattagtgtgctgttcctgtatccatatgcaagacactgttttcaattgttggcaatgtgttttctgaagattggtaagcgttcagtgactttaagtgtagaacctatttagcctcatatggcttcgagaagacttgcgttgcttatgtaatctgttttctgcttcaagtgatatttcagtggacagcttgtggctaatgtttgctgatgggaaaatttatgcttcgcttgccatatgccagtttgtattagtgtcttccttacaaagaaatatattccatttggcatcgcgtc

SEQ ID NO: 33432 - protein, 293 aa, Panicum virgatum
  misc_feature: Ceres CLONE 1950698
  misc_feature (173)..(222): Pfam Name: FBD Pfam Description: FBD
  misc_feature (232)..(232): Xaa is any aa, unknown, or other
  misc_feature (237)..(237): Xaa is any aa, unknown, or other
AFVLNRCPVLEKLLIVGSRWPVCLRVRSHSLRLVEVCQGLVPEITVLHAPRLERLLLWQAWGGDDLCNMSSKIMIVHAPKLCFLGFLVPGMHKLEIGNTIIKAQSKASPSTTVPSVQMLAVQLKLETRIEARLLPSFLRCFPNVETLYIQSENDDLKFWGPQCTGAGKLNLKFWKEAGSIECVQRHIKKVVLREFRGTRSELDFLKFIAEQAQVLEKMVIVLTHGHSPSDPXGTNLXTKMVFAKWANARCELMIFQTPFHQEGTAWCFLSAFDLSNPDPFDVSKCLDGKCQNH

SEQ ID NO: 33433 - DNA, 713 bp, Panicum virgatum
  misc_feature: Ceres CLONE 1950711
  misc_feature: Encodes the peptide sequence at SEQ ID NO. 33434
gtaccaattgctctcacgagttatttttgacaaaggagctcttctcttcaccacagtaggaaacaatgcgactttccagcctaatccgaactctgtttatcaaacagagcacctttcttatttcaagtttgttggtcgagtggttgctaaagcattatttgatggtcaattgttggatgtccactttacccgttccttttacaaacacatcctcggtgctaaagtaacatatcatgatatagaggctatcgatcctgattactacaaaaatttgaagtggatgctggagaatgatgtaagtgaccttcctgatttaacattcagcatggatcctgacgaggaaaaacatattctctatgagaagactgaggtaactgattatgagctaaaacccggcggaagaaacatcagggtcacggaggaaacaaagcaagaatatgttgaccttgtagctgaacatatactgaccacagcaattcgtcctcaaattaatgcttttcttgagggcttcacagagttagttccaagggacctaatagccctatttaatgataaagaacttgaactactgatcagtggtcttcctgaaattgacctgaatgatctgaaggctaatgcggaatatatcggatattctgctgcatctcctgtcatccagtggttctggcaagttgttaaagctttcagcaaggaggacatggccagactactgc

SEQ ID NO: 33434 - protein, 237 aa, Panicum virgatum
  misc_feature: Ceres CLONE 1950711
  misc_feature (2)..(237): Pfam Name: HECT Pfam Description: HECT-domain (ubiquitin-transferase)
YQLLSRVIFDKGALLFTTVGNNATFQPNPNSVYQTEHLSYFKFVGRVVAKALFDGQLLDVHFTRSFYKHILGAKVTYHDIEAIDPDYYKNLKWMLENDVSDLPDLTFSMDPDEEKHILYEKTEVTDYELKPGGRNIRVTEETKQEYVDLVAEHILTTAIRPQINAFLEGFTELVPRDLIALFNDKELELLISGLPEIDLNDLKANAEYIGYSAASPVIQWFWQVVKAFSKEDMARLL

SEQ ID NO: 33435 - DNA, 578 bp, Panicum virgatum
  misc_feature: Ceres CLONE 1950711-R
gctttggctgatctgttgctccatggagtgctaaagagcgcactggtcattgtttttctgcttgccatgtacagattttgaaggcaattgagatggtcacagatgctatatataacatagatcgagccaaggagcgagcgttttgggaatgctcaggttgaagttgggatccaaaattttcttggaacagtcaatcaggatgtggggcgggtacagtattagagctctgcgacaacaagaatgctggtgtaactaagcttccatttgccttcaagttaaatagtcgaatgtaaattcgtttaatgctttataccaatcgttctggtcatttttgtactgcttcctccgattctgggagccagggcaggttctgcaaataaataagccatctggtaatgccatggctctatgtttatttaatcagctttttatgttttatctattattttttaaaagctcacgtattctgttatagcctcgtgcaaaaatgccttggaaggttctgcaattgaataccagctttcaagctcttaaacttgaataggaaggttatgtagttggtgtttttcagtcgattt

SEQ ID NO: 33436 - DNA, 1221 bp, Panicum virgatum
  misc_feature: Ceres CLONE 1950713
  misc_feature: Encodes the peptide sequence at SEQ ID NO. 33437
gttcaccgccgcctccaccgacctgttcctgacgccgcccgccgttcccctcccttcttctccgctgccggctgaagccacctgctcggcggctcccaactgagcggccaggatgcgggttaagaagcgttcgaagcaccgcaaagcggtcaagttctattccacctgcttcggcttccgcgagccttacaaggtcctcatcgacggcaccttcgtccaccacctcatcacccagcgcctctgcccggccgatgaggcactccgcgacctcctatcggcctccaggacgccagccctcttcacctccaagtgtatcgtcgcagagctcaggcgactcggcaagtcgcatgccgaatccttcgacgccgctcagcttctcgccacaaccaactgtgagcatgacaaggttgtcagtgcagtgaattgtgtcccaacactgataggtgataagaatcctgagcatttctttgttgccacccaagacgctgatctccgggaaaagctaagagagattcctggggttcctgtaatatatggactgaagaactccttatttatagagcaaccctctgttcagcaacgcaagtttgctcaattggacgaggagaagcgtctcaatatggatatatctgagtataagaagttaatgaaggcttcatcagaaggaaagacaacagctagtgaaaatggaagtgacggagaacaacatgagaggcctttcagttcccttgtaaaaaatgcacttggtgttgcagataaaagcaagtttaaaaggaacagagcaaagggtccaaacccactctcctgcaagaaaaagaaaccaaagccccagccctcagctattcaaaatcagggggctatggttgatggcgaggcaaagagaaagagggttcgtaagcggaagagaagccagaaagatgacaaacaagcagagacgacgagctaaatgagcttgtatactaagtttcagttctcttgctgcgtctccatcttgacccctgaggacctgaacaagaactaagtcaactaggggagacttcacttgggagaaaaagaactttgaagacgtatatcccacaagattcaggatgccatgccatgctccttatatgctgacaatgttatgccatgccatgccgaactcctatgctgacgatgttccttgcgatgtactagtacttgattgtttgcagtaatcatgatctctagaggctgtagctg

SEQ ID NO: 33437 - protein, 277 aa, Panicum virgatum
  misc_feature: Ceres CLONE 1950713
  misc_feature (51)..(152): Pfam Name: Fcf1 Pfam Description: Fcf1
MRVKKRSKHRKAVKFYSTCFGFREPYKVLIDGTFVHHLITQRLCPADEALRDLLSASRTPALFTSKCIVAELRRLGKSHAESFDAAQLLATTNCEHDKVVSAVNCVPTLIGDKNPEHFFVATQDADLREKLREIPGVPVIYGLKNSLFIEQPSVQQRKFAQLDEEKRLNMDISEYKKLMKASSEGKTTASENGSDGEQHERPFSSLVKNALGVADKSKFKRNRAKGPNPLSCKKKKPKPQPSAIQNQGAMVDGEAKRKRVRKRKRSQKDDKQAETTS

SEQ ID NO: 33438 - DNA, 316 bp, Panicum virgatum
  misc_feature: Ceres CLONE 1950725
  misc_feature: Encodes the peptide sequence at SEQ ID NO. 33439
attccagtccccaatccgtcgagaaattctcgcgagcgatcgaaatctaagcgaagcgaagaggcctccccagatcctctcaagatgcagatctttgtgaagaccctcaccggcaagaccatcaccatggaggtggagtcatctgacaccattgacaatgtgaaggccaagatccaggacaaggagggcatccccccggaccagcagcgtctgatcttcgctggcaagcagctggaggatggccgcaccctggcggactacaacatccagaaggagtccaccctccacttggtgctccgtctgcgtggtggtatgc

SEQ ID NO: 33439 - protein, 77 aa, Panicum virgatum
  misc_feature: Ceres CLONE 1950725
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITMEVESSDTIDNVKAKIQDKEGIPPDQQRLIFAGKQLEDGRTLADYNIQKESTLHLVLRLRGGM

SEQ ID NO: 33440 - DNA, 543 bp, Panicum virgatum
  misc_feature: Ceres CLONE 1950725-R
  misc_feature: Encodes the peptide sequence at SEQ ID NO. 33441
aagcagctggaggatggccgcaccctggcggactacaacatccagaaggagtccaccctccatctggtgctccgcgtgcgtggtggtatgcagatctttgtgaagaccctcaccggcaagaccatcaccttggaggtggagtcttctgacaccatcgacaatgtgaaggcgaagatccaggacaaggagggcatcccaccggaccagcagcgtctgatcttcgccggcaagcagctggaggatggccgcaccctggcagactacaacatccagaaggagtccaccctctacctggtgctccgtctccgtggtggacagtaagtccatggagctgctgttgtccctgggttcacaagtctggtgccttgccttgtctctccaatggtgattgcctgcgtgtcctgtggtcgtgtccttgtcatgcctgtctgatgcgagttttatgtcgtctggttgtgttttgtgaacacttgctgctgtgcagcaatttggttgaactatgtaatgaataagtgagccatgaagttactatggtaatcttgc

SEQ ID NO: 33441 - protein, 106 aa, Panicum virgatum
  misc_feature: Ceres CLONE 1950725-R
  misc_feature (35)..(103): Pfam Name: ubiquitin Pfam Description: Ubiquitin family
  misc_feature: SWISSPROT Homolog: EC 3.1.2.15 Ubiquitin thiolesterase
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
KQLEDGRTLADYNIQKESTLHLVLRVRGGMQIFVKTLTGKTITLEVESSDTIDNVKAKIQDKEGIPPDQQRLIFAGKQLEDGRTLADYNIQKESTLYLVLRLRGGQ

SEQ ID NO: 33442 - DNA, 695 bp, Panicum virgatum
  misc_feature: Ceres CLONE 1950740
  misc_feature: Encodes the peptide sequence at SEQ ID NO. 33443
aggctcagatcagattccgatcacccgtgttccgcccccaatctcctcgtgttcgctcgtgtcgctgtttccagggacgcctccggctcgtcgctccacagagatctccgcctcccacaagatgcagatctttgttaagaccctgactggcaagaccatcactcttgaggtcgagagctcagacaccattgacaatgtcaaagccaagatccaggacaaggagggcatccccccggaccagcagaggctcattttcgctgggaagcagctagaggatggtcgcaccctggctgactacaacatccaaaaggagtctactctccaccttgtcctgcgtctgaggggtggcatgcagatttttgtgaagactctcactgggaagaccatcactctcgaggtcgagagctccgacaccatcgacaatgtcaaggccaagattcaggataaggagggcatccccccggaccagcagaggctcatctttgctggcaagcagcttgaggatggtcgtacgctagctgactataacatccagaaggagtccaccctccaccttgtcctgcgtctgaggggtggcatgcagatatttgtgaagaccctcaccgggaagaccataactcttgaggttgagagctccgacaccatcgacaatgtcaaggcaaagattcaggaaaaaaagggaatcccacctgatc

SEQ ID NO: 33443 - protein, 191 aa, Panicum virgatum
  misc_feature: Ceres CLONE 1950740
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQEKKGIPPD

SEQ ID NO: 33444 - DNA, 768 bp, Panicum virgatum
  misc_feature: Ceres CLONE 1950745
  misc_feature: Encodes the peptide sequence at SEQ ID NO. 33445
gaaagtgtcctcgtccttcagttccagcctccgaatctctctgcatctctgtgatcgaggaagagaggaggtgccaacaaacatggtgcacgggaagctggaggttctccttgtctccgccaagggccttgaggacaccgattttctcaataacatggacccctacgtgatccttacatgccgcacccaggagcagaaaagcagcgttgcaaatggagcaggaagtgaccctgaatggaacgaaaccttcatcttcactgtctctgacgataccccgcagcttagcctcaagatcatggacagcgacgtcaccaacgatgatttcgttggtgaagcaagcatcccgctggaggctgtgtttcaggaaggcagccttcccccgacagttcacccagtcgtcaaggaggataaatactgtggagagatcaagcttgcactcaccttcactccagcagtggaaactcgccgccctgacaacgagggtacttacagcagctggaattgatctgcccgatgtgtgcactgagcaatagcataatttactgaagagttactactgttatgcaacattattttgctttgtcatgaactgaatatttgcatgtaactttcagcattgtgataactattcagaattgttggtttgcgcacctcacggggcgtcgcctgcagaattaccatcttttgaggaaaaaagttataactctgaaaggatgtacaatactaaattttcaaacagcaacataattacagtcttatcagttcagc

SEQ ID NO: 33445 - protein, 140 aa, Panicum virgatum
  misc_feature: Ceres CLONE 1950745
  misc_feature (6)..(86): Pfam Name: C2 Pfam Description: C2 domain
  misc_feature: SWISSPROT Homolog: EC 2.7.11.13 Protein kinase C
  misc_feature: Functional homolog of the protein sequence given in SEQ ID NO 50618
  misc_feature: Useful for making plants with modulated nitrogen use efficiency
MVHGKLEVLLVSAKGLEDTDFLNNMDPYVILTCRTQEQKSSVANGAGSDPEWNETFIFTVSDDTPQLSLKIMDSDVTNDDFVGEASIPLEAVFQEGSLPPTVHPVVKEDKYCGEIKLALTFTPAVETRRPDNEGTYSSWN

SEQ ID NO: 33446 - DNA, 145 bp, Panicum virgatum
  misc_feature: Ceres CLONE 1950758-R
  misc_feature: Encodes the peptide sequence at SEQ ID NO. 33447
ttttctctacccttgggcaaagagtttcgacgttttgggtgtatccgtttttattgaagctttcatttttgtgcttatcctagttgttggtttagtttatgcatggcgaaaaggagccttggaatggtcttaactgaatattcag

SEQ ID NO: 33447 - protein, 43 aa, Panicum virgatum
  misc_feature: Ceres CLONE 1950758-R
  misc_feature: SWISSPROT Homolog: EC 1.6.99.5 NADH dehydrogenase (quinone)
FLYPWAKSFDVLGVSVFIEAFIFVLILVVGLVYAWRKGALEWS

SEQ ID NO: 33448 - DNA, 647 bp, Panicum virgatum
  misc_feature: Ceres CLONE 1950758
atacattatctaaatcgatccactttaaataaaatagaaaaaatcgaaagaaaaaaaaaaaagaaagagtaaataataaaactagatattctgtttcataattctgaaatagagttctttttttttagtattactcctcattaggatgcatacattagttatcctattttaattaggttctaatctaatttagtagtaagtagtttcttttttatttaatagtctctgactatcattaaataaagggtggagcaattcttttttctaaagattttagagaaagcgagacaaagtgaagcgaaagagttttctttgtataagaattaggtctatatcatatctaaatagaagagaaataaaaaaaaaagggaatggggattccattggatgaatccttaaggagagacatgttacaaaagaaacaaaggctaaagtaagccgctttttgcctttagtttgagcgtattcttgtttcaccgaggaaaagagagaagttctggataaattgacaatgtcatgtcaacttgaattgattaattcagttccggctattccacattaatgggagtacatttatgtttctgctttacgaatatgatattttttggacatttctaataatggcaagccttattcctattttggta

SEQ ID NO: 33449 - DNA, 1143 bp, Panicum virgatum
  misc_feature: Ceres CLONE 1950791
  misc_feature: Encodes the peptide sequence at SEQ ID NO. 33450
tggtccgccattcccctgcgcatctggagctgttctgtctaaacccacaaaccctagccgctgcgccgccggcgccgccgccgcagccatgaacgccttcaggttcctcggggacatgacccacctcttctccgtcctcgtcctcctcctcaagatctacgccaccaagtcctgctcaggggtgtcgaggaagacgcaagagctgtacatgttggtgttcgtctcgaggtacctggacctcttcacggactacatctcgctctacaactccgtgatgaaggtggtgttcatcaccagctcggcggcgatcgtatggtgcatgcgccgccacccgcaggtgcgccgaacgtacgacaaagagcaggacaccttccgccatgtggtgatcgtcgccgccgcattcctgctcgcgctggtattcaatgagcggttcaccttccgggagatatgttgggcattttcaatctatttggaagcagtggcaattctcccacagttagtgttgctccagagaagcagaaatgtggataacttgactgggcaatatgttttcttccttggggcctaccgcgcgctctacattctaaactggatttaccgttatttcacggagggtcatcacagcagatggatcccttggcttgctggtttggtgcaaacagctctgtatgcagatttcttttactaatatttcttaagttggaagaacaacgtgaagctcgagttgcctgcttgatgtgccaaaagactgcacactacgcgactctagtgttctagagattagctgattatatgggcagggagagacttggtaatgaggtggagcagttgcaattgataccatatcctgggtcttgcctgcgagaattgatctttgtgtttcccatggcaaagtctatacgtttcggaagctaacggttgctgctgcacagaagtagactagtcccttttttgtatctgctaccttcgatttgaaaaatcacattcacatacatttcagctgctctgttgtttacttgctctgtttcacttctcggaaacaaaaacttatgattccagtgcccatccagttttttgtagaacagatgtgctgattcggttgcgtatatgcgtttgatggtggtccgagttgtgcgattggac

SEQ ID NO: 33450 - protein, 199 aa, Panicum virgatum
  misc_feature: Ceres CLONE 1950791
  misc_feature (1)..(199): Pfam Name: ER_lumen_recept Pfam Description: ER lumen protein retaining receptor
MNAFRFLGDMTHLFSVLVLLLKIYATKSCSGVSRKTQELYMLVFVSRYLDLFTDYISLYNSVMKVVFITSSAAIVWCMRRHPQVRRTYDKEQDTFRHVVIVAAAFLLALVFNERFTFREICWAFSIYLEAVAILPQLVLLQRSRNVDNLTGQYVFFLGAYRALYILNWIYRYFTEGHHSRWIPWLAGLVQTALYADFFY

SEQ ID NO: 33451 - DNA, 540 bp, Panicum virgatum
  misc_feature: Ceres CLONE 1950801
  misc_feature: Encodes the peptide sequence at SEQ ID NO. 33452
caaacctgagccaaaacctctaaccggagccactccaaaacctgaacctaaacccttgtccgagcctaagccggagcccaaacctgatccaaagccggagcccaaacctgactccatttcctgatccttaacctgagccatagcccgaaccatagccaatgcccgaacccattcctgatccaaagcccgaaccaaaaccgcctaagcctgaacctaaaccggaacctatgcccgatccgaagcctgaacctgagccaaagcccgaaccagagcctaacccttattctgaaccctagcccgaacctgatccgaagcctgagcctttaccggaacctaatccggaacctaatcctgagccgaagccctaacccaaaccgaagccggaacctaatcctgagcccaaaccaaatccatagctcgaacctaagcctatacccgatcctgatcccgagcccatagcgaaaccggacccacctcatatcccacctgcagctgactgctgatgaagtgaccgctagctattttgtatgacgttgcaga

SEQ ID NO: 33452 - protein, 45 aa, Panicum virgatum
  misc_feature: Ceres CLONE 1950801
  misc_feature: Functional homolog of the protein sequence given in SEQ ID NO 50619
  misc_feature: Useful for making plants with altered lignin content
  misc_feature: Functional homolog of the protein sequence given in SEQ ID NO 50172
  misc_feature: Useful for making plants with modulated biomass
  misc_feature: Useful for making plants with modulated flowering time
  misc_feature: Functional homolog of the protein sequence given in SEQ ID NO 50191
  misc_feature: Useful for making plants with modulated salt sensitivity
  misc_feature: Functional homolog of the protein sequence given in SEQ ID NO 50776
  misc_feature: Useful for making plants with altered carbohydrate content
MPEPIPDPKPEPKPPKPEPKPEPMPDPKPEPEPKPEPEPNPYSEP

SEQ ID NO: 33453 - DNA, 429 bp, Panicum virgatum
  misc_feature: Ceres CLONE 1950801-R
  misc_feature: Encodes the peptide sequence at SEQ ID NO. 33454
gatatggcggtggctatggtggtggttatggaggaggatatggtagtggcagcgggtatggtggaggtgggggctatggagggggatctggaggaggtggacaccatggtggatggaattaagtggtagagctaggcacgtttctagatgtcaaataattaagaaacacattgtgatgataggtttgaatgttgcatggcactttggtgatacaaatcatgtttacgtatggtataaaacatggtgatggatgtacggttgtgtacattagatggatttaatcctgttttgcatgaagtgtggtaataagagctaggcagctagccatgtatggcagtgtgcactagctggcttttagaaccggtacctcatcatgtatggacctatgtatacatataaataaatgactatcctttaaagtcgggtatc

SEQ ID NO: 33454 - protein, 39 aa, Panicum virgatum
  misc_feature: Ceres CLONE 1950801-R
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Functional homolog of the protein sequence given in SEQ ID NO 50178
  misc_feature: Useful for making plants with modulated nitrogen use efficiency
  misc_feature: Functional homolog of the protein sequence given in SEQ ID NO 50142
  misc_feature: Useful for making plants with altered lignin content
  misc_feature: Functional homolog of the protein sequence given in SEQ ID NO 50143
  misc_feature: Useful for making plants with altered alkaloid content
  misc_feature: Functional homolog of the protein sequence given in SEQ ID NO 50144
  misc_feature: Useful for making plants with altered terpenoid content
  misc_feature: Functional homolog of the protein sequence given in SEQ ID NO 50179
  misc_feature: Useful for making plants with modulated phosphate use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50210
  misc_feature: Useful for making plants with modulated biomass
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 791 in the 10/374,780 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: Functional homolog of the protein sequence given in SEQ ID NO 50268
  misc_feature: Useful for making plants with modulated heat sensitivity
  misc_feature: Useful for making plants with modulated low light sensitivity
  misc_feature: The sequence is a functional homolog of SEQ ID NO 1844 in the 10/374,780 US patent application
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1391 in the 10/374,780 US patent application
  misc_feature: The sequence is a functional homolog of SEQ ID NO 12 in US patent 7087810
  misc_feature: The sequence is a functional homolog of SEQ ID NO 644 in the 10/666,642 US patent application
  misc_feature: Functional homolog of the protein sequence given in SEQ ID NO 51438
  misc_feature: Useful for making plants with modulated time to senescence
  misc_feature: The sequence is a functional homolog of SEQ ID NO 2854 in the 10/374,780 US patent application
  misc_feature: The sequence is a functional homolog of SEQ ID NO 464 in the 10/225,066 US patent application
  misc_feature: The sequence is a functional homolog of SEQ ID NO 1091 in the 10/412,699 US patent application
  misc_feature: The sequence is a functional homolog of SEQ ID NO 1279 in the 10/666,642 US patent application
  misc_feature: The sequence is a functional homolog of SEQ ID NO 636 in the 10/374,780 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 2318 in the 10/374,780 US patent application
  misc_feature: The sequence is a functional homolog of SEQ ID NO 240 in the 10/225,066 US patent application
  misc_feature: The sequence is a functional homolog of SEQ ID NO 124 in the 10/714,887 US patent application
  misc_feature: The sequence is a functional homolog of SEQ ID NO 124 in the 11/435,388 US patent application
  misc_feature: The sequence is a functional homolog of SEQ ID NO 795 in the 10/374,780 US patent application
YGGGYGGGYGGGYGSGSGYGGGGGYGGGSGGGGHHGGWN

SEQ ID NO: 33455 - DNA, 893 bp, Panicum virgatum
  misc_feature: Ceres CLONE 1950813
  misc_feature: Encodes the peptide sequence at SEQ ID NO. 33456
gagcttatcgcttatcatctgcgcctccccatctctcccctgctcctccgcttcctcgtgatccatccaaaccagcttgctgagatctggggaatcgaggttaattctcggatcttgttgtttgggtttgttgcaggggtagctatgtcgaattccgaggagcaccacttcgagtcgaaggccgacgctggggcgtccaagacctacccgcagcaggctggtaccatccgcaagaacggcttcatcgtcatcaagggccgcccctgcaaggtggtggaggtttctacctcaaagactggtaagcacggtcatgctaaatgccactttgttgctatcgacatattcaatgggaaaaagcttgaagatattgtcccgtcttcccataattgtgatgtgccacatgtgaaccgcactgagtaccagctgattgacatatctgaggatggatttgtgagccttcttacttctgatggcaacaccaaggacgatcttagactcccaactgatgagactctcctgggtcagatcaaagaaggatttgacagcgggaaggaccttgtggtgactgtccagtcctccatgggggaggagcagatctgcgcgctgaaggatgttggccccaagtagcttccctaaagaaggcctggaacagagggagcaactgtatctcaaaacttaaatcgaaaaaggcgtgtatcgccacgaaggattggtaccgagacattcaccctagcttgagctggcttttgctgtagtaaactcaagtgcagtgattgctgggcgtggcatcgtatctgactatcattatctgtggttacatttgggaccctgtattttctatggttttatgccctctgcttagtatcaataataaatattggtttggaacggtc

SEQ ID NO: 33456 - protein, 160 aa, Panicum virgatum
  misc_feature: Ceres CLONE 1950813
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSNSEEHHFESKADAGASKTYPQQAGTIRKNGFIVIKGRPCKVVEVSTSKTGKHGHAKCHFVAIDIFNGKKLEDIVPSSHNCDVPHVNRTEYQLIDISEDGFVSLLTSDGNTKDDLRLPTDETLLGQIKEGFDSGKDLVVTVQSSMGEEQICALKDVGPK

SEQ ID NO: 33457 - DNA, 1512 bp, Panicum virgatum
  misc_feature: Ceres CLONE 1950818
  misc_feature: Encodes the peptide sequence at SEQ ID NO. 33458
gcagaggcaaagaatattgaagtatcatatcaaaagagcaaggttagatttgctgggcaggatgaaaaagaagaaaatgattggggggaggagggttctataattgagcagataacagaaagcctggtgattgatgacaatgttgaggccaagggagtattattgaaaaagactgtcccaaggagtaaggatttcagatcagacttttcaagagggcatcatgtatcaaaccagcgaataagatttcagagaaggaacagaccatgtcgatatgacatagatcgattcacacctagtttcttgtcaatttttgaatcattggtcccctcagaggaggaaatcgcaaggcagaagcaactgttaacatctttaagcagaataataaacaaggaatggcctaattcaaaactatacctctatggatcatgtgccaattctttcggtttctcaaatagtgatattgatctttgtctctcaatcgatgacaagggaatgagcaaggttgatattatattgaaactggcagacattctacaagctggaaatcttcagaatattcagccattaactcgagcaagggtcccaatagtgaagcttacggatccggaaacagggctttcctgtgatatatgtgtcaataatcttttggcagttgttaacacgaaacttctacgagattatgcacaaatagatagaaggttacaacagttggcatttattgtgaagcattgggctaaatctcggcgtgtaaatgaaacttaccaagggacactttctagttatgcctatgtaataatgtgcatccacctcctacagttgcgaagaatactcccatgcctacaggaaatggaggccacttattttgtcacggtggatgaaaataactgtgcttatttcgaccaagtggacaagctaagtaactacggtgctcacagcagagacaccgtatcacggctgctctgggcctttttccattactgggcatacgagcatgattacacaagggatgtcatatcaattcgtactggaaggattattagtaaggagaggaaggattggacgagacgggttggaaatgacaggcatctcatatgcatcgaagatccatttgagctctcccatgatctcggtcgcgtcgttgacaagttcaccatcaagatacttcgggaggaatttgagcgagctgcaaatatattacagtttgatccgaaccccagcgccacgctctttgagccatacgtgccccctccaataccgaacctgatgcaagaaggaactgtgaatgccgcagaagttgacctatgatcacagtatctggtgcttcatgatgttgtatgttctgaagtaatgtcgtaatatgtttcgtgcatagctgtacaacagagagttattggctgtgtaggtccaggtggttgacagtacttggctgcctcataggatggcagattagcgaagtatgttgtgcgggaggtccatatcaacctttgctagtgtttatttaacttcattttt

SEQ ID NO: 33458 - protein, 434 aa, Panicum virgatum
  misc_feature: Ceres CLONE 1950818
  misc_feature (315)..(374): Pfam Name: PAP_assoc Pfam Description: Poly(A) polymerase
  misc_feature (121)..(235): Pfam Name: NTP_transf_2 Pfam Description: Nucleotidyltransferase domain
  misc_feature: SWISSPROT Homolog: EC 2.7.7.19 Polynucleotide adenylyltransferase
AEAKNIEVSYQKSKVRFAGQDEKEENDWGEEGSIIEQITESLVIDDNVEAKGVLLKKTVPRSKDFRSDFSRGHHVSNQRIRFQRRNRPCRYDIDRFTPSFLSIFESLVPSEEEIARQKQLLTSLSRIINKEWPNSKLYLYGSCANSFGFSNSDIDLCLSIDDKGMSKVDIILKLADILQAGNLQNIQPLTRARVPIVKLTDPETGLSCDICVNNLLAVVNTKLLRDYAQIDRRLQQLAFIVKHWAKSRRVNETYQGTLSSYAYVIMCIHLLQLRRILPCLQEMEATYFVTVDENNCAYFDQVDKLSNYGAHSRDTVSRLLWAFFHYWAYEHDYTRDVISIRTGRIISKERKDWTRRVGNDRHLICIEDPFELSHDLGRVVDKFTIKILREEFERAANILQFDPNPSATLFEPYVPPPIPNLMQEGTVNAAEVDL

SEQ ID NO: 33459 - DNA, 636 bp, Panicum virgatum
  misc_feature: Ceres CLONE 1950820
  misc_feature: Encodes the peptide sequence at SEQ ID NO. 33460
atccaactcacctcacggtacacacatcccttcatccagcgaagggagcaggaaaggctgctgtgttgggcgctcatcagggcaagctcaggttcctattctttgttcttcagactactgatactactagccttaagatcttttatattatgcttttttgttaccttctctcaagttgccgcacttatttttgccagtgaaaaacatgttacaaagttaagcctttatgtcgcttggcacaagcttttgccccatttagggctgtagcaatgcactaagtttattaaatctgtactagctccctgtgaatacgccgcaaaagtttttactctatattgtgcaggttacaaaggctgctatgttttccgagcgacctgttaccatgcttgtactgctcgcgtggctgctgctgtctctggatggtagcatgatcaactgcgcaacgaccccagataacagcaccgatgtgctttcactgcaagattttaagcatgagatctccggcgatccaaccagggttttggactcttggaactccaccatctcccactgcatgtggcagggtgtcagatgcagcctagcgcatccacgacgcgtagtggctctggagctccccggcctaaacttggttggcca

SEQ ID NO: 33460 - protein, 84 aa, Panicum virgatum
  misc_feature: Ceres CLONE 1950820
  misc_feature (25)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
MLVLLAWLLLSLDGSMINCATTPDNSTDVLSLQDFKHEISGDPTRVLDSWNSTISHCMWQGVRCSLAHPRRVVALELPGLNLVG

SEQ ID NO: 33461 - DNA, 654 bp, Panicum virgatum
  misc_feature: Ceres CLONE 1950820-R
  misc_feature: Encodes the peptide sequence at SEQ ID NO. 33462
caaaattagcacctccattggaaacttgaccttccttaagacactgaacctgtccgcgaacattttatctggtcaattaccgcctttcaaccatctgcaaagactgcaaatcctggacctgagctccaactctctgcatgataatatcccagatgctctcgccaactgttcctacttaagggggctgtccctccggaagaataatctatttggtgaaattccaccaaaactaggcctcttgtctaacctctcagttttaaggatttcttataataatctcactggaagcatccctccaagtctcggcaacatcacacgcatagacacaataaatattgcatctaatatgctcaccggaagcattccagatgagcttgcaaaattagcaaacatatcgacgttattcttaggtgataatagactattaggtaagtttccgcgtgctctgtataatttatcctctcttgaaaacctagggttggagataaatgacctaggtggcagattaccaaataatattggtgatctcctccctaatctccaatggcttttgttgaatcaaaacaagtttgacggacatatcccagcttccctaggcaatatttcagggatttacagcttggatttgaataataataatttcactgggattcc

SEQ ID NO: 33462 - protein, 217 aa, Panicum virgatum
  misc_feature: Ceres CLONE 1950820-R
  misc_feature: SWISSPROT Homolog: EC 2.7.11.1 Non-specific serine/threonine protein kinase
KISTSIGNLTFLKTLNLSANILSGQLPPFNHLQRLQILDLSSNSLHDNIPDALANCSYLRGLSLRKNNLFGEIPPKLGLLSNLSVLRISYNNLTGSIPPSLGNITRIDTINIASNMLTGSIPDELAKLANISTLFLGDNRLLGKFPRALYNLSSLENLGLEINDLGGRLPNNIGDLLPNLQWLLLNQNKFDGHIPASLGNISGIYSLDLNNNNFTGI

SEQ ID NO: 33463 - DNA, 878 bp, Panicum virgatum
  misc_feature: Ceres CLONE 1950824
  misc_feature: Encodes the peptide sequence at SEQ ID NO. 33464
agccacaccagcgcaaagcaactcgcataaataaaaaatagaaaaaagaaaacccccgcagccacagaggaagaataatccattcgccttgcttgcgcctcccgtctgcgtgcgatcgacgcagagaaggcgcgggcgctcaacgccaccgccaccctccggctccgatccgatggccttcatgcgctcgcactcaaatgcatcttccggcatgggagttgctcctaacatcagggagacattcgtcgagcttcagatgaagaaggcattccgatatgttatcttcaaaatcgaggaaaagcaaaagcaggtggttgttgagaagaccggtgctactactgaaagctatgatgactttttggcctccctcccagaaaatgattgcagatacgctctgtatgattttgatttcgtcactggggagaatgtgcagaaaagcaagatatttttcattgcctggtccccatcgacttcccgcattcgtgcaaagatgctgtactccacctccaaggaccgcatcaagcatgagcttgatgggttccactacgagatccaggcaaccgacccatcagaggtggacatcgaagtcctcagggagcgggctcactgaagctggtttacctatgaaggggacctgtggagggccttggaacttcagccagattcaaattctatattcaatgatgctccagccatggtatttgttaataagttcatgtaagcatatgatttagtcgtgatgcgtgactctagctggtgaagcgctatcgaaggtctttctgtatgagatcttgagcctgtaaacggagcaatttgcaaactcatggtattgtggtaatgatactggttactggaagtactggttgtggattatttgg

SEQ ID NO: 33464 - protein, 145 aa, Panicum virgatum; identical to SEQ ID NO: 10146
  misc_feature: Ceres CLONE 1950824
  misc_feature (18)..(145): Pfam Name: Cofilin_ADF Pfam Description: Cofilin/tropomyosin-type actin-binding protein
  misc_feature: Functional homolog of the protein sequence given in SEQ ID NO 50159
  misc_feature: Useful for making plants with modulated time to senescence

SEQ ID NO: 33465 - DNA, 405 bp, Panicum virgatum
  misc_feature: Ceres CLONE 1950841
  misc_feature: Encodes the peptide sequence at SEQ ID NO. 33466
gctatcccgaggttcgccgccgcatgctaagtcactgccataccctcgcttcccatgccttctcgaagctccccgtcgccgcctccacccgctccgatggccaaggaaccgatgcgcgtgctcgtcaccggcgccgcatgacaaatcggatatgcgcttgttcccatgattgctagaggagttatgcttggtacagaccatcctgttattctgcacatgctcgacattccgccagcggctgaagctcttaatggtgttaagatggagttggttgatgctgcatttcctcttcttaagggtgttgttgcaagaactgatgttggggaggcttgcactggtgtgaatgtggcggccatggttggtggattccccaagaaggagggaatggaaaggaaggatgttatg

SEQ ID NO: 33466 - protein, 79 aa, Panicum virgatum
  misc_feature: Ceres CLONE 1950841
  misc_feature: SWISSPROT Homolog: EC 1.1.1.37 Malate dehydrogenase
MIARGVMLGTDHPVILHMLDIPPAAEALNGVKMELVDAAFPLLKGVVARTDVGEACTGVNVAAMVGGFPKKEGMERKDV

SEQ ID NO: 33467 - DNA, 251 bp, Panicum virgatum
  misc_feature: Ceres CLONE 1950841-R
gacgggattgctcaggagcagtcagaggagaagggaatggtttactcatgcttagggtaatctctaaccatagtctgagcatttgctgcttataggttaagaattaaggaaaatttcagtgtcaatgtatcgattctttcactcggaagcattgcaccttggcggtgcaggtggttggcttctcctcagtgtgtaagaggcttgtaacccaaattgcatgatgatacgcaggacatttagagaaacttgcg

SEQ ID NO: 33468 - DNA, 397 bp, Panicum virgatum
  misc_feature: Ceres CLONE 1950857
  misc_feature: Encodes the peptide sequence at SEQ ID NO. 33469
agagagagagagagagagagaagtttgcttcagtcccatgcggtggtggtggtgtggctgtggcagcagctgcccctgctgctggtggagctgctcccgcagctgaggccaagaaagaagagaaggtggaggagaaggaagagagtgatgatgatatgggcttcagcctcttcgactaagctgtgcggtcaccagagttgtgtcttttcggcaggaaaaccagagtcgccatgtttggagtttaaccttgttttatgttgcaaagcacccgaaaagactgctacagtctggatatgtagtgattcagccataggtggctacactggttgttggtgtttactggtgaaccagagtttatgcatcatatattaagaatcagttacctagttcgttgatg

SEQ ID NO: 33469 - protein, 58 aa, Panicum virgatum
  misc_feature: Ceres CLONE 1950857
  misc_feature (1)..(57): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass
REREREKFASVPCGGGGVAVAAAAPAAGGAAPAAEAKKEEKVEEKEESDDDMGFSLFD

SEQ ID NO: 33470 - DNA, 1594 bp, Panicum virgatum
  misc_feature: Ceres CLONE 1950861
  misc_feature: Encodes the peptide sequence at SEQ ID NO. 33471
gcaggttccggctgcttccatcccaccacggagtcccgaaccttctcgagcaccccctctccggctctccccaccccttccacgcagaaaacaatgagcaggcgcaacagccgcaccatctatgtaggtaacctccctggggacatccgtgagagggaagttgaggacctcttctacaagtatggtcgaattttggatattgacctgaagatacctccaagacctcctggatatgctttcgttgagttcgaggacccacgtgatgctgatgacgcaatttatgggcgtgatggatataactttgatggctacaggttgcgggttgaattagctcatggtggaagaggtcagtcttactcttatgatcgttctagcagctatagcagcgctcgccgtggaggtgtttctaggcgctctgattaccgtgttatggtcacgggtttaccttcatcggcatcgtggcaagatctgaaggaccacatgcggcgcgccggtgatgtttgtttctctgatgtataccgtgaggctggagaaactattggaattgtggattacacaaactatgacgacatgaaatatgcgatcaggaagcttgatgactcactgttcaagaatgcattttctagggcgtatatcagagtgagggagtatgatgctagatcacaaagcagaagccgtagccgctcgtactcgagaagctccagttacagcaggagcaggagtccaaaatctgtttctcggtcaccatcacctgtggatgaaagatctggccatgccggcgatctggggactgcattgatagattattggatgtattgagaatcgaagtggatggtttgggactttggatagtagagctggattgtgatgcatgtatgacaagtgggctacaaccagtcctaggagcaagataggactgacagtaaggatatgtggatctcgtggtgtgtcgactatattgtgcttcaatttcaatggctcaatataacatcaacatcaacatcaacaaagccttttaatcccgagcaagttggggtaggctagagttgaaacccaacaaagaccattatttatggttctggcacgtgaatcgcggctttccaagcactcctatccaaggacaaatctttagatcactatcaagatcccgatcccctgtctcttctccttctggtggaagatctgcgagcagaagcccgaggagcagaagcgcatcccgttctcattctcctgtgagatctgattgaactaggggacccttgaagcggtgagcaactgtaaccagagagaaggaagctgagaacatgcattaccatctcaatgacctgaatgattctgttgttgccactgcaccccctcattttggaggtttcctcttatttagtatttaataattacattatattgctaaagagacttattatgcctagcgcagtggtgtaaactgaacttttgtgtactgggttcccggcactcaggtttcatctactctccggtagcctgtttttaattgacacttctctttcaattggtcgcttgtaatattgcatagttgaggggtcgatgtattcggttatttggttgctgtgtccgg

SEQ ID NO: 33471 - protein, 241 aa, Panicum virgatum
  misc_feature: Ceres CLONE 1950861
  misc_feature (9)..(77): Pfam Name: RRM_1 Pfam Description: RNA recognition motif. (a.k.a. RRM, RBD, or RNP domain)
  misc_feature (112)..(179): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 51213
  misc_feature: Useful for making plants with altered alkaloid content
  misc_feature: Useful for making plants with altered lignin content
MSRRNSRTIYVGNLPGDIREREVEDLFYKYGRILDIDLKIPPRPPGYAFVEFEDPRDADDAIYGRDGYNFDGYRLRVELAHGGRGQSYSYDRSSSYSSARRGGVSRRSDYRVMVTGLPSSASWQDLKDHMRRAGDVCFSDVYREAGETIGIVDYTNYDDMKYAIRKLDDSLFKNAFSRAYIRVREYDARSQSRSRSRSYSRSSSYSRSRSPKSVSRSPSPVDERSGHAGDLGTALIDYWMY

SEQ ID NO: 33472 - DNA, 1114 bp, Panicum virgatum
  misc_feature: Ceres CLONE 1950865
  misc_feature: Encodes the peptide sequence at SEQ ID NO. 33473
ggctcaagaaaaggagaagccttcgccggtttgcccctgcctctgcctttgcgttgcttctccgcctgcagtttcctctgcacttcttctccttccgccgaactccatcatcgaattcgaatcgaagtcgccggccgccatgagcagcaacagcatcgagtacgattacctcttcaagctgctcctcatcggcgactcatccgtcggcaagtcctgcctcctcctccggttcgctgacgattcgtatgttgacacttacatcagtaccatcggtgttgatttcaaaattcgaactgtcgagctcgatggaaagacagtcaagctacagatttgggacacagcaggccaagaaaggttcaggacaatcacaagcagttactaccgaggagctcatggaatcattattgtatatgacgttacggacatggacagcttcaataacatcaagcagtggctgagtgagattgataggtatgccaatgacagtgtatgcaagctgctagttgggaacaagtgtgatttggtcgatagtaaggttgttgataccgaaacagcaaaggcttttgcggattcattaggaattccctttattgagacaagtgcaaaggaatccatcaatgttgaggaagctttcctaaccatgtcatcagaaataaagaaaaggatggcaacccaaccgagcgtggagagaagacccaccgtccacgttcacatgaaagggcagccaatacagcagaagagcagctgctgctcgtcataaacagtcaaaggcttccagaaagcaagggagggtatacctgcagacctgcagtgctccattcctatcatctgggggggacttcaagtttggtgagtggttggatggatgctgcaagactttgttcagtcaagattatattggaaaaggcactggatggaatggatactaaatgtgtgtcattttagcggtatatagatgtctatccttagacagattagcattaattgcacagtttgtatcagtattaagctgcaaaatgtaccaactaatcttaaaacctgcagttaattgcatgatatacggtgtgagtgctggttgctgtttgtttaatatgataattgagcttgtctatcc

SEQ ID NO: 33473 - protein, 206 aa, Panicum virgatum
  misc_feature: Ceres CLONE 1950865
  misc_feature (13)..(174): Pfam Name: Ras Pfam Description: Ras family
  misc_feature (13)..(127): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50630
  misc_feature: Useful for making plants with altered lignin content
  misc_feature: Functional homolog of the protein sequence given in SEQ ID NO 50522
  misc_feature: Useful for making plants with modulated oxidative stress sensitivity
  misc_feature: Functional homolog of the protein sequence given in SEQ ID NO 50163
  misc_feature: Useful for making plants with altered alkaloid content
MSSNSIEYDYLFKLLLIGDSSVGKSCLLLRFADDSYVDTYISTIGVDFKIRTVELDGKTVKLQIWDTAGQERFRTITSSYYRGAHGIIIVYDVTDMDSFNNIKQWLSEIDRYANDSVCKLLVGNKCDLVDSKVVDTETAKAFADSLGIPFIETSAKESINVEEAFLTMSSEIKKRMATQPSVERRPTVHVHMKGQPIQQKSSCCSS

SEQ ID NO: 33474 - DNA, 1109 bp, Panicum virgatum
  misc_feature: Ceres CLONE 1950870
  misc_feature: Encodes the peptide sequence at SEQ ID NO. 33475
actcgttttcttgaatcgtccgcaacctcaagctcttgtcgccggcagtctcaagggacgagagtctgagattacctgtggctctctttctatctgcaagatccaccagaatcacacgctcacgcagccacacgacaaaatccaggaaaggaacaatcttgggttctggaacccactggtagccatcggtcctccttgattaatactaagcgcacagggcggcgctcacaaatcgacagccaagcgaggtagctcccagttccgcagttcccgttccacgctcggcatggctccgcaggcgtggattgtggaggagaagggcgagggcctccaaggccccaaggagttcctgcccctctccaagcttgaagatattggtgtgctttattggcagttggatcctaagaagtctgaaagcaaagaagagcttgcaaaaatccgcaaagaaagaggatacagttacatggaccttattgagatatgtcctgacaaactggagaactatgaggagaagctgaagaacttcttcactgagcacatgcacgctgacgaggagatccgctactgcttggaaggcagtgggtactttgatgtccgtgacaaggatgacaagtggattaggatttggataaaagaaggagacatgatcatcctgcctgctggaatttatcatctgttcaccctcgacagcacaaattatgtgaagctcatgaggctcttcatcggggaaccagtctggactgcgctgaaccggcctcaggagggccaccccgcaagacaggagtacgtgaagaatgtgatgggaaacactggattcgctctagcagcacactgaacctgccgttgccgttcgttcagcgagatacaaacatacaatttcttgaactcttttacatcacggcatatatggaccaagagtcggatgcgaaaacattgctgtgttgtgatggaacatcatgccgcacttgcttgtacacgtagaagatactgcatctgcatcctatgggaacgtacgatgtaccagtattttccgttgtgtttgcttgatacagatacccttggatgtacgtggttgcagcagcagctgccaacaatgctttatttatgtg

SEQ ID NO: 33475 - protein, 182 aa, Panicum virgatum
  misc_feature: Ceres CLONE 1950870
  misc_feature (4)..(153): Pfam Name: ARD Pfam Description: ARD/ARD' family
MAPQAWIVEEKGEGLQGPKEFLPLSKLEDIGVLYWQLDPKKSESKEELAKIRKERGYSYMDLIEICPDKLENYEEKLKNFFTEHMHADEEIRYCLEGSGYFDVRDKDDKWIRIWIKEGDMIILPAGIYHLFTLDSTNYVKLMRLFIGEPVWTALNRPQEGHPARQEYVKNVMGNTGFALAAH

SEQ ID NO: 33476 - DNA, 603 bp, Panicum virgatum
  misc_feature: Ceres CLONE 1950885
  misc_feature: Encodes the peptide sequence at SEQ ID NO. 33477
gactcgagactttcaggtcacatctcctctcttttttttttttgcgagggacatctcctccctctgtttctcccttctctcggactctctccctggctctttcttccctgtcggcgacgactgggcgagcggcggcgccgtttgtcacgtcttcgccaagccttttgccggcgacgagcatcccccaggctgagataagttgaagcaaagttcaaggcaaaatgttttacggtggatatgcgtaccatggcaatacgtttgagcaaacgtaccgttgttatccagcatccttctttgataagccacacctggaaggtggtgacaaagtaataatgccaccatctgcccttgattgcctggcttccctccacatcgagtacccaatgctatttgaactgcacaatgatgcaactcaacggatttcacactctggtgttttggagtttgtggcagaagaaggcatgatcatcatgccctactggatgatgcaaaacatgcttcttcaagagggtgacactgtccgtgtgaaaaacgccacacttcccaagggtacatatgtgaagttgcaacctcacacaactgattttctggacatctcgaatc

SEQ ID NO: 33477 - protein, 127 aa, Panicum virgatum
  misc_feature: Ceres CLONE 1950885
  misc_feature (10)..(127): Pfam Name: UFD1 Pfam Description: Ubiquitin fusion degradation protein UFD1
MFYGGYAYHGNTFEQTYRCYPASFFDKPHLEGGDKVIMPPSALDCLASLHIEYPMLFELHNDATQRISHSGVLEFVAEEGMIIMPYWMMQNMLLQEGDTVRVKNATLPKGTYVKLQPHTTDFLDISN

SEQ ID NO: 33478 - DNA, 417 bp, Panicum virgatum
  misc_feature: Ceres CLONE 1950885-R
gatggtaaagcctcaaaactacaagcatccgaggttccatccagtgcaagttctgttccctcagattcaaacaaaagatcaaatcagcaagcatctgcacccgcaacttctggaactagcaattccactcgtcagaaaacaggaaagcttttttttggttcaagtgcaagcaacaataaagaaccacaaaaggctcctgctaaagaggaggaacccccgaagaaggacgagcccaagttccaagcttttagtgggaagagctactccttgaaacgttagctgcccattactggagtttagcgtatcatgttcagtggtagctgtagaccactgtgtcttaagtgtccaccagcatgtagatataatttgaattatgtaaatgtttatcttcatggaaatatggccatctttctattt

SEQ ID NO: 33479 - DNA, 1024 bp, Panicum virgatum
  misc_feature: Ceres CLONE 1950892
  misc_feature: Encodes the peptide sequence at SEQ ID NO. 33480
agaggatcatgttccgactgcagaggatctgattccctcagctcagggcctcaggttatgtctgtttcttgaaccctctccggctttcccttctctcggactctctcgtccttgctcttccttccctggcggcgacgactgggcgagcggcggcgacatttgtcacttcttcgcccagccctttgccggcgacgagcatccaccagattcaccatgagtaatgccagcactggattgctgaaaggcttgaggatggtcttgcaacagcaaaagatttcagccgttttctgcagacgatctcaagcttggagttctactgtctctttttctgaccttgatgagaagggtgatattgactttgacgatgattatacagattcaaagagagagctacagccccagagcgtagatcccaaaaagggctggggatcccgcggcgtccacagggccatcatctgcggcaaagttggacaagtgcctgtgcaaaaaattttaaggaatgggcgtacagtaaccgtttttaccgttggaaccggtggcatgtttgaccagagggtaattgggcctgaggatttaccgaagccagctcagtggcatcgaatagctgttcataatgaccacctaggtgcttatgctgttcagaagctggtgaagaattctgcagtctatgttgagggtgatattgaaacgagggtctacaatgacagcattaatgatcaagtcagaaacatacctgagatatgtgtacgacgtgatggcaagattcgtctgattaaatctggggacagtgctgctagcatatcattagatgagctcagacaagggctgttctagttatagttaaggatgtcagtgcaagcagatcatgaggttgcttcttgcttgaggcaagtttgagtatgtttattcttactattataagcagtgctaatttaagtgttatgcttgcatactattctgactggattttcattcgtttgaactatgccttatagtaccaaattccaaatttacaaatcctcgg

SEQ ID NO: 33480 - protein, 206 aa, Panicum virgatum
  misc_feature: Ceres CLONE 1950892
  misc_feature (76)..(187): Pfam Name: SSB Pfam Description: Single-strand binding protein family
MSNASTGLLKGLRMVLQQQKISAVFCRRSQAWSSTVSFSDLDEKGDIDFDDDYTDSKRELQPQSVDPKKGWGSRGVHRAIICGKVGQVPVQKILRNGRTVTVFTVGTGGMFDQRVIGPEDLPKPAQWHRIAVHNDHLGAYAVQKLVKNSAVYVEGDIETRVYNDSINDQVRNIPEICVRRDGKIRLIKSGDSAASISLDELRQGLF

SEQ ID NO: 33481 - DNA, 1089 bp, Panicum virgatum
  misc_feature: Ceres CLONE 1950893
  misc_feature: Encodes the peptide sequence at SEQ ID NO. 33482
cttttccgcaggctccaccaagcagccagcaggaggcttagcagcagaagagcagaagcctcccctaccttcgctatgcagcccatcaaggtgtacgccgaccggcggtcgcagccctcccgaaccgtcatcatcttctgcagggtgaatcagatcgatttcgaggagatcacggtggatctgttcaagtctcagcacctcactgccgaattcagaaaaataaacccgacgggacaagtgcctgcaattgttgatggaagattcaaactatatgagagtcatgctattttgaggtatcttgcgtccgtgttccccggagttgcagatcactggtatcctgctgacttgttcactagagccaaaattgagtcaatcttggattggcatcactcaaatttgcgtcgtggtgcagcaacccttgtaatgcacacagcactggctccctttcttggtcttgcaacaagtcctgatgctgtaaaacaagcagaaaaacttctaatgcagtcactaggaaggattgaatcagtgtggctgaaggatgatgcaaagttcttgctaggtagcccccaaccatcaattgcagatctaagccttgtttgtgaaataatgcagttggagatccttggcaatgacgtacgtgaccgatttctgggagctcatgagaagatcctcatctggatggataatgtgaagaaagccaccagccctcattttgtggaagcccatgagctccttttccaagtggaggccagcaggctaaacaatgctgctgcagcaaaccagacttccgagccaagcacgaagctcaaaattgtgtcaaagctctgagctgtagaggggaagatactgttgcaacttgcaagtataaatagaacattgcaataagcgttgggaagagatgatgggcgctgtgaagattgtggagctttgcatagatcagcaagtaacccccaccatactaagtggttccttgcggatcatattgtgttgtccgtgaggaaagtttaaaataaaactggacttgtatgaaaactgcttatctacgctgtacatgatccttactagtgaatccattgcctgaattgactt

SEQ ID NO: 33482 - protein, 250 aa, Panicum virgatum
  misc_feature: Ceres CLONE 1950893
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
MQPIKVYADRRSQPSRTVIIFCRVNQIDFEEITVDLFKSQHLTAEFRKINPTGQVPAIVDGRFKLYESHAILRYLASVFPGVADHWYPADLFTRAKIESILDWHHSNLRRGAATLVMHTALAPFLGLATSPDAVKQAEKLLMQSLGRIESVWLKDDAKFLLGSPQPSIADLSLVCEIMQLEILGNDVRDRFLGAHEKILIWMDNVKKATSPHFVEAHELLFQVEASRLNNAAAANQTSEPSTKLKIVSKL

SEQ ID NO: 33483 - DNA, 1110 bp, Panicum virgatum
  misc_feature: Ceres CLONE 1950905
  misc_feature: Encodes the peptide sequence at SEQ ID NO. 33484
aaaaaaaggacggcggctctctcttctctctctcggccttctttcctagcggcgacgccagggcgagtggcgtggcggccggcggctctctcttctctttctcacgccttctctctctccgtctctcggccttcttctttccttgccagctcttcttcgtcgggagcttcgccggccgacaaggagttggcttccattatcctccgccgctgatgtcgaggctgcgtgctttgtggcaagcttccttcaacgcctccaagagagctcttgtatggagttcagatgatctaatgccaccaagcgaaaggtatatcttcaatttcaactcaaaagatgagctgaagaggtggcatttgtactcagattcagagtacggaggtttgtcttctgcatcattggagataactgatagcactgctggtgcagatacttcattgactggtgtgttttctggtaatctttcatcggatatgtctgaggactcaacatggaggatcaggcgctatggattctgcggaatgcgatcaaagaagtttgatggtttcattgaccttgatgcatatgatacaatagcaatgaagatcaaaggggatggaagatgctacatatctaccatatacacagagaattgggtgaattcaccaggacaacaagaagataattcatggcaggcttttgtgcacacacctcaggacagatggcaaatactgaaaatccctcttgatcactatttacctacatggagaggaaatgtgattgaggcaaagttggaaatgaatcctgctcgtattgtgggaatgtctctctctgtaaatgcagaaggtggtgttcctggtgccaagactgggactggtgattttaggctagaagttgattggatcaaggcattgagaacagtgtgaggtccactggcattttcttactcttctgtttcacgcggcgctgccattgctggaattttgtcagcgaccaatacctgatgactacacgagtaaacagtagttcagagtgccccactcctgtatgtacttttaggtgtatgaaatgtttgctggtaaacatggaaggctgctgcagttcggcaccaatgaataataaatactgttttcc

SEQ ID NO: 33484 - protein, 229 aa, Panicum virgatum
  misc_feature: Ceres CLONE 1950905
  misc_feature (35)..(225): Pfam Name: CIA30 Pfam Description: Complex I intermediate-associated protein 30 (CIA30)
MSRLRALWQASFNASKRALVWSSDDLMPPSERYIFNFNSKDELKRWHLYSDSEYGGLSSASLEITDSTAGADTSLTGVFSGNLSSDMSEDSTWRIRRYGFCGMRSKKFDGFIDLDAYDTIAMKIKGDGRCYISTIYTENWVNSPGQQEDNSWQAFVHTPQDRWQILKIPLDHYLPTWRGNVIEAKLEMNPARIVGMSLSVNAEGGVPGAKTGTGDFRLEVDWIKALRTV

SEQ ID NO: 33485 - DNA, 966 bp, Panicum virgatum
  misc_feature: Ceres CLONE 1950907
  misc_feature: Encodes the peptide sequence at SEQ ID NO. 33486
gaaactcattcagaagagcatatgccctcattccccagttcaacagatgttaaacaggattcgcctcttgctccccaccctccttccccgcctacccccgaagaacctgtggaagaagcacctaaaacatatgcttcagtgttgcgaacaaaagcgaaggccacaatggggactgcagagtcacaacaggctcaacagttggctcagcaggtgcaaactgtcccggtgcatgaaaaatctaactcggacaacaaccgggttgttagcacccctgatgatgaagaagagtttatttcagtttatgttgggaatctttcgccatctacttcagtctttgatcttgagaaggtgtttcaggcttttggaagaattaaacctgacggagttgctatccgaagccgcaaggaggctggagtcttctttggctttgttgagtttgaagacatgtctggtattcagaatgctttaaatgcatcgccgatagaattgaacggtcgtttagtacatgttgaggagaggaggcctaactgtggattcccaagtgccagaagacggggtcgaggaaaggaccaagctggtggacgatatgacggggagtatcctactcgatcgaagggaaccgggtaccagaaaaagggtggacgccagtatgacagctactactagttttgtacttgctctgctggtggatggccatgtgccgttggtgttatctacctggtgcggttctggccatagttttgccgaaagtcacaatggtgtggggactagcatttctgcttttgctgacattgagcagaatcgtttttggggatgggcttctgttgccgttttgttgcgtcatagtagtttttgcgcctcagctacagtgacctgttaaaatgttgatcatgctgtcgccccgattggtgtcttttgaaaacacattagaagttttgacaaatgttagcgaacagtttcagtgtc

SEQ ID NO: 33486 - protein, 221 aa, Panicum virgatum
  misc_feature: Ceres CLONE 1950907
  misc_feature (100)..(170): Pfam Name: RRM_1 Pfam Description: RNA recognition motif. (a.k.a. RRM, RBD, or RNP domain)
ETHSEEHMPSFPSSTDVKQDSPLAPHPPSPPTPEEPVEEAPKTYASVLRTKAKATMGTAESQQAQQLAQQVQTVPVHEKSNSDNNRVVSTPDDEEEFISVYVGNLSPSTSVFDLEKVFQAFGRIKPDGVAIRSRKEAGVFFGFVEFEDMSGIQNALNASPIELNGRLVHVEERRPNCGFPSARRRGRGKDQAGGRYDGEYPTRSKGTGYQKKGGRQYDSYY

SEQ ID NO: 33487 - DNA, 1021 bp, Panicum virgatum
  misc_feature: Ceres CLONE 1950933
  misc_feature: Encodes the peptide sequence at SEQ ID NO. 33488
aaggatcgtcaagcctgcccggattgaggggaagtagtagggggtgtgtccgagcagggctttccctgttagcaggaagtacaacagtcaagacagtaccaagaatcatgagtgaaacagggtacacagtacaagtcactaacctctctagcagggtatctgaaaacgatcttcatgaattcttttcgttctctggtcctattgagtatatagaacttatcagatcgggagaatatggctctactgcttatgtgacattcaaggaacgctatgccttggaaactgcagcattgcttagtggggctactattgtggatcagccagtatgcataacttattggggacaacctgaggagagttttaatttctgggataggccaagttgggaggttgaggaggaaatcgaatacaggaactaccaagcatgccagttcaacactactccacaggaagctttgacagtggctcaagatgttgtgaagacgatgttagcaaggggatatgtgctaagcaaggatgctttggctaaggctagagccttcgatgagtcccgtgggttaacagcatcagctacagccaaggccgcagagctgagcaagagatttggtttaactgacagggtcaatgctggtgttagtgcaatcaatgctggtgttggtgcaatgcgatcagtggacgagacataccgcgtatctgagacgacgaagactgttgcgactgccaccggaagaacagcagctaaggtggcaaacagcatcgtcactagcagctacttctctgcaggagccatgatggtgtctgacgcttttactagggctgccaaggcggcagcagatttggctgctcatggtaggcagagttaagtgaaaataaacagtcaatgcatcctttcagttattaaacatgtggacaaacaccaaaatatgatgcttcaaatgttcgatgtatattataacagacaacaatattgtaaaaggagacgaacttgtttgtgaccgtgcagtcatgtttgtgatcgtgt

SEQ ID NO: 33488 - protein, 251 aa, Panicum virgatum
  misc_feature: Ceres CLONE 1950933
  misc_feature: Functional homolog of the protein sequence given in SEQ ID NO 50372
  misc_feature: Useful for making plants with modulated biomass
MSETGYTVQVTNLSSRVSENDLHEFFSFSGPIEYIELIRSGEYGSTAYVTFKERYALETAALLSGATIVDQPVCITYWGQPEESFNFWDRPSWEVEEEIEYRNYQACQFNTTPQEALTVAQDVVKTMLARGYVLSKDALAKARAFDESRGLTASATAKAAELSKRFGLTDRVNAGVSAINAGVGAMRSVDETYRVSETTKTVATATGRTAAKVANSIVTSSYFSAGAMMVSDAFTRAAKAAADLAAHGRQS

SEQ ID NO: 33489 - DNA, 667 bp, Panicum virgatum
  misc_feature: Ceres CLONE 1950936
  misc_feature: Encodes the peptide sequence at SEQ ID NO. 33490
caaataaagtttacaatgatcaaggaattccagcagcattcagagttcctgcaggtgctgtgattccatttggatctatggaggattccctaaaaaaaagtggatcattagaatcctacacaaagcttctagagaggattgaagccgctcaaattgaaaatggtgaacttgatagactaacatcagagcttcaagcaatggtttcccttctttctccatccaaagaaatcattgaatctttgaaaaatacattcgatcagaatgttcgactaattgtcagatctactgctaacgtggaggatttggctggtatgtcagccgctgggctatatgaatcaattcctaatgtcagcctctctgacccaagttcctttggagctgcggttggacgggtttgggcatcattatacacaaggagagcagtccttagccgccgagcggctggtgtccctcagaaagatgcaaagatggccattcttgttcaagaaatgctgcagccagatctctcctttgtgcttcacactgttagcccatctgatcatgatcccaagttggtcgaggccgaggttgcccctggactgggagaaacccttgcttctggaacccgtggcaccccttggagactctcgtgtgacaaatttgatggcggagtcaccactctagcttt

SEQ ID NO: 33490 - protein, 221 aa, Panicum virgatum
  misc_feature: Ceres CLONE 1950936
  misc_feature (4)..(221): Pfam Name: PPDK_N Pfam Description: Pyruvate phosphate dikinase, PEP/pyruvate binding domain
  misc_feature: SWISSPROT Homolog: EC 2.7.9.5 Phosphoglucan, water dikinase
NKVYNDQGIPAAFRVPAGAVIPFGSMEDSLKKSGSLESYTKLLERIEAAQIENGELDRLTSELQAMVSLLSPSKEIIESLKNTFDQNVRLIVRSTANVEDLAGMSAAGLYESIPNVSLSDPSSFGAAVGRVWASLYTRRAVLSRRAAGVPQKDAKMAILVQEMLQPDLSFVLHTVSPSDHDPKLVEAEVAPGLGETLASGTRGTPWRLSCDKFDGGVTTLA

SEQ ID NO: 33491 - DNA, 355 bp, Panicum virgatum
  misc_feature: Ceres CLONE 1950936-R
ccatagtaaataaagttttgttaagatgagtgtgattacttggttaggtgaataaaaatggatgcatggctgaagaaatttatgggttctgaagcacacatagcagttattcaagtccttttaaacatcttgcctgaagtaaaataatgagttgggccaggtccagccatgctcttggatgaattttgcgaacagcaaacttgagtataatgtaacgtcttgtagtgacctcgtttggatgtaataatcataatctacaggacatgtaatgtaatatctagctagagatgagaacatatccatcattatcgtagctgcttacagcgagcaaccgtagaaaaaggtacttcaatcc

SEQ ID NO: 33492 - DNA, 517 bp, Panicum virgatum
  misc_feature: Ceres CLONE 1952554
  misc_feature: Encodes the peptide sequence at SEQ ID NO. 33493
ctattcatgaagacagcatttgctgcatttccatgttggaagcttgattcttgatactttctgctgaaatgtaagaaaggtgacaggcatatcgtacctcttgagtattaatttgcatgataacaacactcacaccaattcttcaggtaactgtcaacaacactatgtatcacaagagctgcttcaagtgctgccatggaggatgcaccatcagcccttcgaactacatcgcgcacgaggggaagctctactgcaagcatcatcacatccagctgatcaaggagaaggggaacttcagccagctcgagaatgatcatgagaagacatcacaggctggatcgctggaggacgaagaagcagagtactaatctttgagcatttccacagatgaataatgaatctccttgcatttgctcgagagcaatatacctttctatggcacggtttggtttcagttttaccaatggaggtcatgagcactcagagaacaatgatacgtcgtcttgtatcttcatgt

SEQ ID NO: 33493 - protein, 83 aa, Panicum virgatum
  misc_feature: Ceres CLONE 1952554
  misc_feature (6)..(54): Pfam Name: LIM Pfam Description: LIM domain
  misc_feature: Functional homolog of the protein sequence given in SEQ ID NO 50126
  misc_feature: Useful for making plants with altered carbohydrate content
  misc_feature: Functional homolog of the protein sequence given in SEQ ID NO 50127
  misc_feature: Useful for making plants with modulated heat sensitivity
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
MITTLTPILQVTVNNTMYHKSCFKCCHGGCTISPSNYIAHEGKLYCKHHHIQLIKEKGNFSQLENDHEKTSQAGSLEDEEAEY

SEQ ID NO: 33494 - DNA, 1232 bp, Panicum virgatum
  misc_feature: Ceres CLONE 1952561
  misc_feature: Encodes the peptide sequence at SEQ ID NO. 33495
gcatcggctgcagcaaggaggcaggccacaccccttgtagtgcgcgcttctcgcctgcgccatagccaccggcacagtgacccccgtgcaccacctcgccgccgcggcagcagcagcagcagcgacgggagcgaggcggaggctaggctagagagagagagagagagagagagagagacgtacgggtagccgccgcgaggtagaccgagaagtgaggaaggagaagcagagggaggtgagcggccatgacgatgaggcagtcgaggttcaagaggatctgcgtcttctgcggcagcagccagggcaagaagcggagctaccacgacgccgccattgagctcggcaacgagctggtggcgcggagcatcgacctggtgtacggcggcggcagcatcgggctgatggggctcgtctcccaggccgtctacgacggcggccgccacgtcatcggggtcattcccaagacgctcatgacaccggagatcagcggcgagacggtcggggaggtgcgtccggtggccgacatgcaccagaggaaggcggagatggcgcgccagtccgacgcattcatcgccctgcccggagggtacgggacgctggaggagctgctcgaggtcatcacgtgggcgcagctgggcatccaccacaagccggtcgggctgctgaacgtggacggctactacaacgcgctgctgaccttcatcgacaaggccgtggaggaggggttcatcaaccccagcgcccgccgcatcatcgtgctcgcgcccaccgcgcaggagctcatggacaagctcgaggagtacgtgccgtaccacgacagggtggcgtccacgctcaactgggagatgggccacctaggctactgacgtggcgtctgaagcaatcatcaagaacggggcaggcgattggaaccattgatcggtgaaggaaggaggaggaggaggagaagaagcttagctagccgtcggattgggattttaatttttctccctatttaacttgacgcgtgcagatcggtttggagtgttggtttgtatatgatggtggccttgtgtttgcttccactgggggtgcaatgctgtagcagcgaaaaggacttgaccggtttcctctccccgcccctgctgctgtatggtctagtagtagtattagcagctagtgcctgcctatgtatgttagtttcaagaagctgaattcgattgactacagcaactcagcaagtgtgttatact

SEQ ID NO: 33495 - protein, 206 aa, Panicum virgatum
  misc_feature: Ceres CLONE 1952561
  misc_feature (53)..(186): Pfam Name: Lysine_decarbox Pfam Description: Possible lysine decarboxylase
MTMRQSRFKRICVFCGSSQGKKRSYHDAAIELGNELVARSIDLVYGGGSIGLMGLVSQAVYDGGRHVIGVIPKTLMTPEISGETVGEVRPVADMHQRKAEMARQSDAFIALPGGYGTLEELLEVITWAQLGIHHKPVGLLNVDGYYNALLTFIDKAVEEGFINPSARRIIVLAPTAQELMDKLEEYVPYHDRVASTLNWEMGHLGY

SEQ ID NO: 33496 - DNA, 1210 bp, Panicum virgatum
  misc_feature: Ceres CLONE 1952569
  misc_feature: Encodes the peptide sequence at SEQ ID NO. 33497
accatcgcaactcctacccagtctcagctcgtcccggcaacctcccttcccacccccacaatgtcgggcaacatcgccttcggccggttcgatgactccttcagcgcggcctctctcaaggcctacatcgccgagttcatctccaccctcatcttcgtcttcgctggcgtcggctccgccatcgcctacaccaagttgtccggcggcgcacctcttgacccttcgggtctgatctccgtggcggtgtgccacgggttcgggctcttcgtcgcggtcgccatcggcgccaacatctccggcggccacgtcaaccccgccgtcaccttcggcctcgccctcggcggccagatcaccatcctcaccggcatcttctactggatcgcccagctcctcggcgccatcgtcggcgccgtcctcgtccagttctccaccggcgtggcgaccccgacccacggcctctccggcatcggcgcgttcgagggcgtcgtgatggagatcatcgtcaccttcggcctcgtctacaccgtgtacgccaccgcggccgaccccaagaagggctccctcggcaccatcgcccccatcgccatcggattcatcgtcggcgccaacatcctcgtcgccgggcccttctccggcgggtccatgaacccggcccgctccttcggccccgccgtggccagcggcgacttcaccaacatctggatctactgggtcggcccgctcatcggcggcggcctcgccggcatcgtctaccggtacatctacatgtgcggcgaccatgcccccgtcgccggcagcgacttctaagcgcccccaagaagaggcgccgttgcattgttgtttggtttctctcaatcctagtgttggcagcataaagtgagggtcaggctgtgatgggcagcatcgcagcttgtcgttgtttggtttagatcaaagccccagagtctatgcacatgcgtttggatatgattggtcatgtttctccatttgctccgtttttgtaacgtggttagtgtgaagttggtggggttccagaaccagagcgttcctgttgattcttattgcgagatttgcaataactttattcggtctctacattcttcgtcgtctgtttggatagattaaagttagatgttaaattttagtatatattaagcactcctacctttactaaattttcttagtcttatcaaaagtcccgatcatctcg

SEQ ID NO: 33497 - protein, 248 aa, Panicum virgatum
  misc_feature: Ceres CLONE 1952569
  misc_feature (12)..(231): Pfam Name: MIP Pfam Description: Major intrinsic protein
  misc_feature: SWISSPROT Homolog: EC 1.9.3.1 Cytochrome-c oxidase
MSGNIAFGRFDDSFSAASLKAYIAEFISTLIFVFAGVGSAIAYTKLSGGAPLDPSGLISVAVCHGFGLFVAVAIGANISGGHVNPAVTFGLALGGQITILTGIFYWIAQLLGAIVGAVLVQFSTGVATPTHGLSGIGAFEGVVMEIIVTFGLVYTVYATAADPKKGSLGTIAPIAIGFIVGANILVAGPFSGGSMNPARSFGPAVASGDFTNIWIYWVGPLIGGGLAGIVYRYIYMCGDHAPVAGSDF

SEQ ID NO: 33498 - DNA, 635 bp, Panicum virgatum
  misc_feature: Ceres CLONE 1952570
  misc_feature: Encodes the peptide sequence at SEQ ID NO. 33499
ggtggctttgtttcaaacttgccaggagatgttcctcgggtatgtggtcagttggctgtctccagagcttttggagacaggaatctaaaatcactattgagatcagagcccgatataaaagtcgaagacatagatcacactgcggagctacttgtcctcgcgagcgatggcctttggaaggtgatgaacaatcaggaggttgttgatttggccaaaaggtacaaggatccatatgcagctgccaggcaattaaccgccgaagcgctaaaaagggagagtaaagatgacatatcatgcattgttgttcggttcaaggcgtaaatggatcgcaggcgactcacggagaatctccgtggagagaagaaaactagtaagttaggctgcctgacaacaatattggtaatcaaatggatgaataatcacagggggcgttggttgtaaatgatttgttggctccattgtataaatatgctaggattattttggtttggcgatttcgaaggtataggtgtgagggcccgagagctatctaaatatagctatcatctgtaaataatggttgcagatagtggaagttgacaggtgctccactgtgaatttgtgagagtacgtttagcagacatttcatagttgcc

SEQ ID NO: 33499 - protein, 106 aa, Panicum virgatum
  misc_feature: Ceres CLONE 1952570
  misc_feature: SWISSPROT Homolog: EC 3.1.3.16 Phosphoprotein phosphatase
GGFVSNLPGDVPRVCGQLAVSRAFGDRNLKSLLRSEPDIKVEDIDHTAELLVLASDGLWKVMNNQEVVDLAKRYKDPYAAARQLTAEALKRESKDDISCIVVRFKA

SEQ ID NO: 33500 - DNA, 528 bp, Panicum virgatum
  misc_feature: Ceres CLONE 1952591
  misc_feature: Encodes the peptide sequence at SEQ ID NO. 33501
acgctcgctcgaacacgagcactgcaccctctcatctgccggtgctagctcctcctagctttctcccccacttcagccggtagcctcttcttgagagaagctagcaggaagagggatcgagcaagatgatgagcggcaaggctctccttgtcgccgtgctcttggtgggcgtcgcctcccggtgctccggcagcaggggcctgcagggggatcacatcgctgagcagaagtacggtggcggtggctacggtggcggaggcggcggatacggcggtggcggcggccgccgcgcaggccgccatgttcaagaaggccaactacgcctgccactactgatccatcgatgacgacgaagctgcttcttccatcatttcgtcggcgtagacgcgtagtatctagcgcttgtgttaaataaataagacgtgtgtacgtgactgtgtgtgtgtccgatccccagcgtcgccttcgttcgtttcagcgcgtcgtcgtcttcccatgactcccatgaatacatgatgatgcatgacc

SEQ ID NO: 33501 - protein, 73 aa, Panicum virgatum
  misc_feature: Ceres CLONE 1952591
  misc_feature: Functional homolog of the protein sequence given in SEQ ID NO 50210
  misc_feature: Useful for making plants with altered lignin content
  misc_feature: Useful for making plants with modulated biomass
  misc_feature: Useful for making plants with modulated nitrogen use efficiency
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Functional homolog of the protein sequence given in SEQ ID NO 50185
  misc_feature: Useful for making plants with modulated flowering time
  misc_feature: The sequence is a functional homolog of SEQ ID NO 1001 in the 10/412,699 US patent application
  misc_feature: The sequence is a functional homolog of SEQ ID NO 502 in the 10/374,780 US patent application
MMSGKALLVAVLLVGVASRCSGSRGLQGDHIAEQKYGGGGYGGGGGGYGGGGGRRAGRHVQEGQLRLPLLIHR

SEQ ID NO: 33502 - DNA, 1196 bp, Panicum virgatum
  misc_feature: Ceres CLONE 1952598
  misc_feature: Encodes the peptide sequence at SEQ ID NO. 33503
aagccgaagcggcggccggtggctctgcgcttcgacgtcgccgcagcaacaccaccagacaggcttcttgccagttgccatggggggccttgctgctcctgtatcctgaactaaatcgatctaatctgcccagattccatcatctgaagctttcgtcaatggcggcgcgcggcggcgcgctctgcttctcatcctcgtccgccgccgccgtcacgtgcaggagggcgggtggctgcaggccggaaccgccgcgtttcttggtcgtcagctgcgacgccaggacagcggacgtctactcctccctgcccctggccgcgaagctgctgggtcctcccacgaccttcaacgcggcgaagctcaaggtggagttcgccggggaggatccgctgctgcggggcaagaagcagcctttccccagagcctacaccctgacccactgcgacttgacggccaacctgacgctcgccgtgaccggggggcccatgaccagcgagcagctgcggagctggcagtcgacgctgcagcgggacgacgtggtggccgagtggaaggaggcggccgccggcgccggggagatggcgctgcacgtgcattgcttcgtcagcggcgccaacctcctgcaggagctggcggcgggtttcagatactacgtcttctccaaggagctgccgctggtcctcaaggctgtggttcacggcgacgcggcgctcttctcggagcggtcggagctgatggaggccaaggtgtgggtgcacttccactccagctcccgcaagtacaaccggatagagtgctgggggccgctcagggaggccaccaagaggaacctgcacctgctggatgggcggctggacgaactgcagagcgcaatcaccaggagcaggaggcgacgcaagtgggcgagcccagacacaatcttcaacgccctggtggcactactgctttgacagatcgagcaagggatgagcattcctttgcaaccctttgctctgctgctgaatactgatacgggcatgtgcattcttcaattctgctctgctctgcttgacaccccagttgccatttgcaatgtgggtgctttctccctttttcaggactggtgattgcttggcttgctgctccagtccagtagtagttgtcaacatcaagtttggcaagcgaatcctgtagtaatgtacaataccaagaaattcagc

SEQ ID NO: 33503 - protein, 262 aa, Panicum virgatum
  misc_feature: Ceres CLONE 1952598
  misc_feature: Functional homolog of the protein sequence given in SEQ ID NO 51397
  misc_feature: Useful for making plants with modulated time to senescence
  misc_feature: Functional homolog of the protein sequence given in SEQ ID NO 51398
  misc_feature: Useful for making plants with modulated abscission
MAARGGALCFSSSSAAAVTCRRAGGCRPEPPRFLVVSCDARTADVYSSLPLAAKLLGPPTTFNAAKLKVEFAGEDPLLRGKKQPFPRAYTLTHCDLTANLTLAVTGGPMTSEQLRSWQSTLQRDDVVAEWKEAAAGAGEMALHVHCFVSGANLLQELAAGFRYYVFSKELPLVLKAVVHGDAALFSERSELMEAKVWVHFHSSSRKYNRIECWGPLREATKRNLHLLDGRLDELQSAITRSRRRRKWASPDTIFNALVALLL

SEQ ID NO: 33504 - DNA, 671 bp, Panicum virgatum
  misc_feature: Ceres CLONE 1952622
  misc_feature: Encodes the peptide sequence at SEQ ID NO. 33505
gtcccggccatatcctccgccgacgatcgagctgctagtagagcctagagctagtaattacgcaccgcagcaatggcctgcggccactccgcctccgcgctcgtgctgctggtggcggtggtggtggccgcctccgctgcctgccgctgctgcctcgccgcgccggcgggggcgctggtgacgcgcgtgccggggttcgctcagcagcagctgccgtcgaagcactacgccgggtacgtgacggtggacgaggcgcacgggcggcgcctcttctactacctggtggagtcggaacgcgaccccgccggggaccccctcgtgctctggctcaacggcggcccgggctgctccagcttcgacggcttcgtctacgagcacggaccattcaactttgagtcaggagggtcagctggaagcctgccaaagcttcatctaaatccatatagctggtccaaggtgtctagtgtgatatacttggactcccctgctggtgttgggctgtcatactcgaagaatgtttcagattatgacaccggcgatcttaagactgctgctgattcacattcttttcttctcaagtggtttcagctctaccctgagttcctgaaaaatccattttacatagctggagaatcgtatgccggggtttatgttcctacccctttcacatg

SEQ ID NO: 33505 - protein, 199 aa, Panicum virgatum
  misc_feature: Ceres CLONE 1952622
  misc_feature (40)..(199): Pfam Name: Peptidase_S10 Pfam Description: Serine carboxypeptidase
  misc_feature: SWISSPROT Homolog: EC 3.4.16.5 Carboxypeptidase C
MACGHSASALVLLVAVVVAASAACRCCLAAPAGALVTRVPGFAQQQLPSKHYAGYVTVDEAHGRRLFYYLVESERDPAGDPLVLWLNGGPGCSSFDGFVYEHGPFNFESGGSAGSLPKLHLNPYSWSKVSSVIYLDSPAGVGLSYSKNVSDYDTGDLKTAADSHSFLLKWFQLYPEFLKNPFYIAGESYAGVYVPTPFT

SEQ ID NO: 33506 - DNA, 606 bp, Panicum virgatum
  misc_feature: Ceres CLONE 1952622-R
  misc_feature: Encodes the peptide sequence at SEQ ID NO. 33507
catcatgatgctgggagtatgatcagttatcacaagaaccttacaagccagggctaccgtgctctcatttacagtggcgaccatgatatgtgtgtaccttacactgggagtgaagcatggaccgtatcattaggttatggagtcgttgattcgtggcgaccgtggttcaccaatgaacaagtttctgggtacacccagggatatgaaaagggcctcacttttgcaactattaagggtgctggccacactgttcctgagtataaaccacaggaatcattggctttctacagccgttggcttgctggttctaaattgtgaagctcttgagtcatgaatgctgctgctgatgggaggcatatttccgtgcaacaaagcacaacatgaagaaattggataacccatggaacaataaggccgtcagaggatcaaagttcctagcgccaaccttggacagtgttgtattcttttctgcaaatattacatcaacgcagctgttttatttacatgcatttttcatgccttcgcggtgacaaacatttgtgaaaaaaatcgttaacattttgaaatcccaaaggtatcaatgtatactattttgttttgatccgc

SEQ ID NO: 33507 - protein, 105 aa, Panicum virgatum
  misc_feature: Ceres CLONE 1952622-R
  misc_feature: SWISSPROT Homolog: EC 3.4.16.5 Carboxypeptidase C
  misc_feature: Functional homolog of the protein sequence given in SEQ ID NO 50513
  misc_feature: Useful for biocontainment applications
  misc_feature: Useful for making plants with modulated biomass
  misc_feature: Useful for making plants with modulated flowering time
HHDAGSMISYHKNLTSQGYRALIYSGDHDMCVPYTGSEAWTVSLGYGVVDSWRPWFTNEQVSGYTQGYEKGLTFATIKGAGHTVPEYKPQESLAFYSRWLAGSKL

SEQ ID NO: 33508 - DNA, 675 bp, Panicum virgatum
  misc_feature: Ceres CLONE 1952656-R
  misc_feature: Encodes the peptide sequence at SEQ ID NO. 33509
tcccccgacttacacgcggtcgccgaagccgaagcggacgccacccacctacacgccgacccccaagcccactcccccgacctacacgccgtcgccgaagccgaagccgacgccgcccacctacacgccgacccccaagcccactcccccgacctacaccccgtcaccgaagccgaagccgacccccaccccgaagccgactcctccgacctacaagccgacccccaagcccactcctccgccctacactccaacccccaagccgacgccgccgccgacctacaagcctgcccccaagccgacgccgccgacctacaagcctgctcccaagccgacgccgccggtgtcctacacccccagcccgccgccgccctactacaagtgagatctctgctactctgctgtgtcaagctcggagcataggaaggtgatggaagagtttgcgccagcaaaccggccggccaagagataagctgaagatgagaggcccttccttgatcctcctcttacgttcgctgccgtctatatcatctatcctagctagagaggagggaataatgcacgcagagctctgcagcgccctgctatgttttctgttgtccgtttagttcgtgttcgtcgtctgtctttgcagccgtattgtgtgtgggtaatggtattgctactattggtgtc

SEQ ID NO: 33509 - protein, 127 aa, Panicum virgatum
  misc_feature: Ceres CLONE 1952656-R
  misc_feature: Functional homolog of the protein sequence given in SEQ ID NO 50776
  misc_feature: Useful for making plants with altered carbohydrate content
PPTYTRSPKPKRTPPTYTPTPKPTPPTYTPSPKPKPTPPTYTPTPKPTPPTYTPSPKPKPTPTPKPTPPTYKPTPKPTPPPYTPTPKPTPPPTYKPAPKPTPPTYKPAPKPTPPVSYTPSPPPPYYK

SEQ ID NO: 33510 - DNA, 653 bp, Panicum virgatum
  misc_feature: Ceres CLONE 1952656
agaccatcagccacactgaccagagcttggagtgtgagtgagggagagtgccagtgagagagggagcgagaggatgggtggcaaggcagctctgctgctggccctggtggccgtgagcctggccgtcgagatccacgccgacgccggctacggctacggcggcgggtacgggccgacgccggccaccccgaccccgaagccggagaagccacccaagggcggcaagccgcccaaggagcacaggcccaagccggagaagccgcccaaggagcacaagcctcccacctacaccccaagcccgaagccgacgccgcccacgtacactcccactcccaagcccgctccgccgacgcccaagccgacgccgccgacctacactcccacgcccaagcccgctcccccgacgtacaccccgacgcccaagccaccggcgaccaagccgccgacacccatgccgaccccgccgacgtacactccctcgccgaagcccacgccgccgacctacaccccgacacccaagccgccgacctacaccccgaagcccaagcccactccgccaacgtacaccccgaagccgaagccccctcccccgacttacacgccgtcgccaaagccgaaaccgacgccacccacctacacgccgaacccccaag

SEQ ID NO: 33511 - DNA, 596 bp, Panicum virgatum
  misc_feature: Ceres CLONE 1952664-R
  misc_feature: Encodes the peptide sequence at SEQ ID NO. 33512
agacgaggatctgtaacaagtgggagatgactgggtactgcccgttcgggagcaagtgccactttgctcatggagcagctgaacttcacaagtatggtgggggacttgtcgacatagacagcagggatgccgcgtccactcccgactcgaagcaagctggtgcttctgcaaaagctcctgcagattctgctgctgcatccaccgcgatgccccctcacgcagacgtgtaccatctaggcatccagtcgcagcgttccaccatcgtcagccagaggtctgggcacgtgcaaaggcccattcagaagtggaagggtcctgacaagatcagcaggatctatggtgattggatagacgagaatgagtaggaaggcaagccctcgcttagtacctggctgccttcatctcagctggtgcaagccgcttagaagctgtagatggcactgcaaaccctagtcccagaagaatgtgcagtgttggtatgaatattatgttgctgcaggtcatgttgtctctgttgtatgcatgcttaagagaagatcaactctaagacctatattgggaaggaaaactgcaagaacatagcatggttgttgttc

SEQ ID NO: 33512 - protein, 120 aa, Panicum virgatum
  misc_feature: Ceres CLONE 1952664-R
  misc_feature (1)..(25): Pfam Name: zf-CCCH Pfam Description: Zinc finger C-x8-C-x5-C-x3-H type (and similar)
  misc_feature: The sequence is a functional homolog of SEQ ID NO 644 in the 10/666,642 US patent application
TRICNKWEMTGYCPFGSKCHFAHGAAELHKYGGGLVDIDSRDAASTPDSKQAGASAKAPADSAAASTAMPPHADVYHLGIQSQRSTIVSQRSGHVQRPIQKWKGPDKISRIYGDWIDENE

SEQ ID NO: 33513 - DNA, 300 bp, Panicum virgatum
  misc_feature: Ceres CLONE 1952664
accgtacccctcctccacccacacccacacacaccaaaacgtcacccccgacagcccaagttcccaagctcagaatttccagcatgttggagcccgcatcgcccgaggagcctcacaccatacgacctgttacaaactgctttgggctacatcgacgatgtgacccatctcactgatggcaagggactggaaaaaagatgattctttacactcgtggggtgctcgaatcaagaagaggtgcaccaacccgcggccttgaaaaaaaaaaaaagattgtggaacaacattattctgcttata

SEQ ID NO: 33514 - DNA, 1154 bp, Panicum virgatum
  misc_feature: Ceres CLONE 1952681
  misc_feature: Encodes the peptide sequence at SEQ ID NO. 33515
ctagagacacccagcgccgcagcccgcagccactccacctcccgagcccccaggcggccaggcaccaggtgcggcggcggcggcggcggcggcggcaagatggcggtgggcaagaacaagcggatcagcaaagggaagaagggcggcaagaagaagaccgtcgatccattcgcgaagaaggattggtatgatatcaaggcgccctctatcttctccgtgcgcaacattggaaagacactcgtgtccaggacacagggtactaagattgcttctgagggtctgaagcaccgtgtcttcgaggtctccctagctgatcttcagagtgatgaagaccaagcctacaggaagatcaggctccgtgctgaagacgtccagggtcgtaatgtccttaccaacttctggggaatggattttacgacagacaagctccggtcgcttgtcaggaagtggcagactttgattgaggcccatgttgatgttaagaccactgataactacatgctgcggctcttctgcattgggtttacaaagaggagacccaaccaagtgaagcgcacttgctacgcacaggcctcccagatccgccagatacgccgtaagatggttgagatcatggccaaccaggcctctacctgtgacctgaaggagttggtttccaagtttattcctgaggtcataggcaaggagattgaaaaggctacctcaagcatcttcccgttgcaaaatgtcttcatccggaaggtcaagattctcaaggcccccaagttcgaccttgggaaactgatggaggtccatggggattacacaaaggaggatgttggtgtgaagcttgagaggcctgctgagggtgatgaggccgtggttggccaggaggctgctgcagctgagtaggatagtttatgatcactattttgctacttaatatatttgaaggatatatgtactgttacctttctgtctgagaacaagggcggctttatttcggcgatctggtagtatgtctgaaaacaggtcattcgtttgtggttatttggattttggatcgcaagttctggtatcatccacgtggtgtttaccttgttgcctgagggttagtttggtgattactgtccatgctaggttctgtgtggtgaatgcctttatcttgtttgagt

SEQ ID NO: 33515 - protein, 263 aa, Panicum virgatum
  misc_feature: Ceres CLONE 1952681
  misc_feature (11)..(222): Pfam Name: Ribosomal_S3Ae Pfam Description: Ribosomal S3Ae family
MAVGKNKRISKGKKGGKKKTVDPFAKKDWYDIKAPSIFSVRNIGKTLVSRTQGTKIASEGLKHRVFEVSLADLQSDEDQAYRKIRLRAEDVQGRNVLTNFWGMDFTTDKLRSLVRKWQTLIEAHVDVKTTDNYMLRLFCIGFTKRRPNQVKRTCYAQASQIRQIRRKMVEIMANQASTCDLKELVSKFIPEVIGKEIEKATSSIFPLQNVFIRKVKILKAPKFDLGKLMEVHGDYTKEDVGVKLERPAEGDEAVVGQEAAAAE

SEQ ID NO: 33516 - DNA, 590 bp, Panicum virgatum
  misc_feature: Ceres CLONE 1952690
  misc_feature: Encodes the peptide sequence at SEQ ID NO. 33517
gtaagaatcctgggaaaccatcagaagaatttgctgcgtacattaggcagagaggttatgaccttcatgatgtgaaggcttatgggcagatgcttgagaatgctggttttcatgacgtcatcgcggaagaccgcactgaacagttccttagtgttctacggagggagctagctgaggttgaaaagaacaaagaggctttcctagcagacttcagccaggaggactacgacgacatcgtgaacggctggaacgcgaagctgaaacggagctctgccggtgagcagaggtggggtctgttcattgctaccaagtgattcagcctgcctggcaccggatggggctctatcttccgaataagaatggctgtggttgtggcttctgcttctagatcggcgattcgtcctagaagtagaggatcttcagaataaaaatgggtgctgctcgtgttgttgttgttgtgtctacgctactagaacatcagttaggtgatttgtgctgtgcaaccagggttgcagaacgcgtgctgcgcgttccagttcatgtggtgcgtgtactgcgagctactattatcagagagtcgatttcaccag

SEQ ID NO: 33517 - protein, 103 aa, Panicum virgatum
  misc_feature: Ceres CLONE 1952690
  misc_feature: SWISSPROT Homolog: EC 2.1.1.103 Phosphoethanolamine N-methyltransferase
  misc_feature: The sequence is a functional homolog of SEQ ID NO 40 in US patent 7151202
KNPGKPSEEFAAYIRQRGYDLHDVKAYGQMLENAGFHDVIAEDRTEQFLSVLRRELAEVEKNKEAFLADFSQEDYDDIVNGWNAKLKRSSAGEQRWGLFIATK

SEQ ID NO: 33518 - DNA, 603 bp, Panicum virgatum
  misc_feature: Ceres CLONE 1952694
  misc_feature: Encodes the peptide sequence at SEQ ID NO. 33519
aactagcaaatcagctctaccagaagaaattctctggcccgagatgggaggctttggccaagaaaggtgccaagaaacagaggttattgtgggcatccactggcgtcaagaatcctgcttaccctgacaccctttacgtggacagtttgattggacctgacacggtcaacacgatgcccgacaatgcgttgcaggcattcatcgaccacggcactgtttcacggacagtggatgctaatgtatctgaggcggaaggtgtatacagtgcactggagaagcttggcattgactgggatgaggtcgggaagcagcttgagctggaaggtgtggactcgttcaagaagagcttcgatagccttcttgtgagcctgcaggagaagggcaacagcctcaagacggcagtgtagaactgaaatgatttggtactgtcaggtgaacgattactaaataaaatgctggcttgctggctctccgttttgtgactgtacggttgctctcggttttctgaatcggctttgtattctaggcttgccttgctgtcattgtgtaaccaatgttcatggcttgtaattgctatgcgtatccgattaataatttttgagc

SEQ ID NO: 33519 - protein, 134 aa, Panicum virgatum
  misc_feature: Ceres CLONE 1952694
  misc_feature: SWISSPROT Homolog: EC 2.2.1.2 Transaldolase
LANQLYQKKFSGPRWEALAKKGAKKQRLLWASTGVKNPAYPDTLYVDSLIGPDTVNTMPDNALQAFIDHGTVSRTVDANVSEAEGVYSALEKLGIDWDEVGKQLELEGVDSFKKSFDSLLVSLQEKGNSLKTAV

SEQ ID NO: 33520 - DNA, 565 bp, Panicum virgatum
  misc_feature: Ceres CLONE 1952695-R
  misc_feature: Encodes the peptide sequence at SEQ ID NO. 33521
cagcactcacaagagagatgtcattcggggatcaaacggtgtcccccgctgcagctgagaggcctgctgccatgaggattgacagcgagacgcttgtacagaacagggacagcgggatgcagcggtacagggagaagaggaagaatcgcaggtatgagaagcacatccgctacgaatcgaggaagctgagggcggacacgaggaagcgggtgaaagggcggtttgtcaagtcgaccgaagcaaatgccgtcaatggcggatgaaccaagggcctttgaagatcgagctcggtgcgttgcgtttagtaggatggagctactaacatccgaaggtggtggtacggtgctacacctatgcatgatgctattgttggattgccgcgcagccgagccaaattttgcgttgaagcaatcgtggccattggtcaatcaatgctagagaatgcacggtacgcttgtagttgtaagaaacgacacccctttttgctgctgccatcagaacagaaataggtagcttacagtacttgtttaccatgatggttttagtacgagcgaatggtgatgcg

SEQ ID NO: 33521 - protein, 86 aa, Panicum virgatum
  misc_feature: Ceres CLONE 1952695-R
  misc_feature (35)..(79): Pfam Name: CCT Pfam Description: CCT motif
  misc_feature: The sequence is a functional homolog of SEQ ID NO 226 in the 10/412,699 US patent application
  misc_feature: The sequence is a functional homolog of SEQ ID NO 458 in the 11/479,226 US patent application
  misc_feature: The sequence is a functional homolog of SEQ ID NO 486 in the 11/435,388 US patent application
ALTREMSFGDQTVSPAAAERPAAMRIDSETLVQNRDSGMQRYREKRKNRRYEKHIRYESRKLRADTRKRVKGRFVKSTEANAVNGG

SEQ ID NO: 33522 - DNA, 631 bp, Panicum virgatum
  misc_feature: Ceres CLONE 1952695
tgcataattagataaagatcttttcttgtaaagggctattcatgaaaaagtgggctcagtggtcccatacggtatgaacatgccgagctgttttcagtcaccaggatagttatgggccaccatacttatccttgttgcgtccccctctggtccacaagtcatgggacgcatcttgtttctttattagacattaaaggctgattttgtcactgccaaaaagatcccaatacaatgccccaccacgtgttcttggttttgcatcgttgtggagaagtaccaaggctgtatttagatccgtaaaaaggtggtaaaaagagacacatcggacactgtagcacactgtagcacttttcgtttgcttgtggtaattgttgtcctaccatgacctaactaggctcaaaagattcgtctcgtcgtgtacatcaaaactatgcaattagtttttttatttatctacatttaatactccatacatgaggcaaaagatttgatgtgatagatgaatagtgaagtttggagagagaaattttggaactaaacacagcccaagtttctatggctatctatggctatgcagtaaaactttcagcattgccaagctgctgatatgtatctgaattttcctgttctc

SEQ ID NO: 33523 - DNA, 501 bp, Panicum virgatum
  misc_feature: Ceres CLONE 1952697
  misc_feature: Encodes the peptide sequence at SEQ ID NO. 33524
aaccccactccgccgccgccgccgagttctccgcggttccattcgcatcggcagcgcgtcttctacccgagccgccaccatgccgaagcagatccacgagatcaaggacttcctgctgacggcgcggaggaaggacgcgcggtcggtgcggatcaagcgggccaagggcgccgtcaagttcaaggttcgctgctccaggtacctctacaccctctgcgtccacgacgccgacaaggccaccaagctcaagcagtcgctcccgccaggtttgagcgttcaggagatttaagtagcaagccgaacttacgcctttcggtgtcagagatgtttgccctccagtatttctttagtacaatgcataggtggcttaatccatgttaagtttgagtttgattgaaaagtgtaatgttggaagtgaaacagtattggacctatgatcctgtagtgtaatggtactcccttgcggagaagataaccgccaatcaatattgttttgagtct

SEQ ID NO: 33524 - protein, 69 aa, Panicum virgatum
  misc_feature: Ceres CLONE 1952697
  misc_feature (2)..(69): Pfam Name: Ribosomal_L38e Pfam Description: Ribosomal L38e protein family
MPKQIHEIKDFLLTARRKDARSVRIKRAKGAVKFKVRCSRYLYTLCVHDADKATKLKQSLPPGLSVQEI

SEQ ID NO: 33525 - DNA, 670 bp, Panicum virgatum
  misc_feature: Ceres CLONE 1952702
  misc_feature: Encodes the peptide sequence at SEQ ID NO. 33526
accgagacgcgcgagaccggcaggcaggggggagcagcagcccgtccgagccccttcctcctccgggttcgcgtgaggccgcgtgccaccgccgccgggaggagggcgaggcgagatggaggcggagaagaagccgccggcggtgtccgacgttggcgcctgggcgatgaacgttgtcagctccgtcggcatcatcatggccaacaagcagctcatgtcctcgtccggctacgccttcgccttcgccaccacgctgaccgggttccacttcaccgtcacggcgctcgtcgggtggatctccaacgccacgggctactccgtctccaagcacgtcccgctctgggagctcgtctggttctcgctcgtcgccaacacctccatcaccgggatgaacctcagcctcatgctcaactccgtcggcttctaccagatctccaaactgagcatgattccggtggtctgcctcatggaatgggtgctgaacagcaagcactacaccaccaaggttatttccgcggtggtcgttgtggcggccggcgtcgggatttgcacggtcacggatgtcgaggtcaatgccaagggattcctttgcgcgtgtgtggctgtgttctgcacgtcgctgcagcagattaccattggctcctttcagaagaagtacaacttggggtca

SEQ ID NO: 33526 - protein, 184 aa, Panicum virgatum
  misc_feature: Ceres CLONE 1952702
  misc_feature: Functional homolog of the protein sequence given in SEQ ID NO 50263
  misc_feature: Useful for making plants with altered cell wall content and/or composition
MEAEKKPPAVSDVGAWAMNVVSSVGIIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFLCACVAVFCTSLQQITIGSFQKKYNLG

SEQ ID NO: 33527 - DNA, 574 bp, Panicum virgatum
  misc_feature: Ceres CLONE 1952702-R
  misc_feature: Encodes the peptide sequence at SEQ ID NO. 33528
ctgagcaaaactgcaccaattcaagcaatttcacttattatactaggcccctttgtggattactacctcaatgggcgatcattgttgaactacaatttttcaggaggggccactttcttcatactgctttcatgctccctggcggtcttctgcaacatgagccagtacctctgcatcgggcggttctctgcgacctcgttccaggtcctgggccacatgaaaaccgtgttcgtgctgatcctcggctggatcctgttcgactcggccctcaccgtgaagaacatcctggggatgctgctcgccgtgatgggcatggtggtctacagctgggccgtggagtccgagaagaaggcggccaccccgatcccccggaacaagagtgacatgctggacggcgaggacgttcccctgaaggccagggtgagcggcctgccctcggtcgacctggaggaaggcgagatgaagagctagccggccgtggcagctgtgaagattcattgatttcttcttgttctttttgtgattgtacgcgctcgcctcgatccaagctgctccttcgaagctatcgacgccg

SEQ ID NO: 33528 - protein, 156 aa, Panicum virgatum
  misc_feature: Ceres CLONE 1952702-R
  misc_feature (1)..(110): Pfam Name: TPT Pfam Description: Triose-phosphate Transporter family
  misc_feature: Functional homolog of the protein sequence given in SEQ ID NO 50263
  misc_feature: Useful for making plants with altered cell wall content and/or composition
LSKTAPIQAISLIILGPFVDYYLNGRSLLNYNFSGGATFFILLSCSLAVFCNMSQYLCIGRFSATSFQVLGHMKTVFVLILGWILFDSALTVKNILGMLLAVMGMVVYSWAVESEKKAATPIPRNKSDMLDGEDVPLKARVSGLPSVDLEEGEMKS

SEQ ID NO: 33529 - DNA, 499 bp, Panicum virgatum
  misc_feature: Ceres CLONE 1952707
  misc_feature: Encodes the peptide sequence at SEQ ID NO. 33530
acatcgctccctctccctctcccccacagcaggctagctagggttttctggggtttgcgagggggctgctccggtccggcgggaggggggagatggcggcggacccggctcaggggacagtgaagtgggtcaacgggacccaggggttccgcttcatcagccccgaagaaggcggccagaacctcctcctccacccctcctccgtcaaggccgacggcttccccaacctcaaggacggtgacgccgtctagttcaccgccggcgcctactacgacggccgcccccaggccatcgacgtctccgcgcccggcggaggggcgctccccggcggggagcaccctgaccaccgctaccgtggacgcggtggccgccgctactgtcgaggaggtgaacgcgaataccggggaggcggacaccctccctacggaggaggcggtgaccgaggctactggggacgaggcgaacgctgatacagacgacgctgccaccgccgctacag

SEQ ID NO: 33530 - protein, 52 aa, Panicum virgatum
  misc_feature: Ceres CLONE 1952707
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
MAADPAQGTVKWVNGTQGFRFISPEEGGQNLLLHPSSVKADGFPNLKDGDAV

SEQ ID NO: 33531 - DNA, 453 bp, Panicum virgatum
  misc_feature: Ceres CLONE 1952707-R
  misc_feature: Encodes the peptide sequence at SEQ ID NO. 33532
ggcgggacacatcgcatgtcactgttcacgaggcggcggcggttacggcggagtcggctacggcggaggccgcgcctttggttgctaccactgcggagaggacggccacatttcccgcgagtgccccaacaaggggctttgggcacgtcgcctccacgagggacgcgttccggctccaacctcggggctctttcatcaagtcagggccatctatctatcagtagtggtagtctttcgttgtcgttcttgttctcgtcgttcgctcgtgttgtagtaggaagaagaagaaggcgtgtggagaactggtgatgaggtggatccgcctgtttcggagtagcaatctatgtttttgtttggcatcagctgtgaggcttccatgatcatggatggcactgccgatataccaaattatctatctatcaatggtatggaatggagtagtaatctattggc

SEQ ID NO: 33532 - protein, 90 aa, Panicum virgatum
  misc_feature: Ceres CLONE 1952707-R
  misc_feature (26)..(43): Pfam Name: zf-CCHC Pfam Description: Zinc knuckle
AGHIACHCSRGGGGYGGVGYGGGRAFGCYHCGEDGHISRECPNKGLWARRLHEGRVPAPTSGLFHQVRAIYLSVVVVFRCRSCSRRSLVL

SEQ ID NO: 33533 - DNA, 1283 bp, Panicum virgatum
  misc_feature: Ceres CLONE 1952714
  misc_feature: Encodes the peptide sequence at SEQ ID NO. 33534
atgaattattttctggagacattatgagcattgaatctgaagaagttaggatctcctcctgccgaacgcagcatggatatttcagctctggagaaggcattgagattcattaatataagaaaagatggtcttccagctgctgtccactctattgtgatccgcgcaccttcaggaatagcacgtactcatagatttgctacccagaatgtagaactccctgctcgagaaggagaaagagtaaccatttcgttggcagccccatccaatatttatcgtgaagtgggtcccctcaagattgccgcacgctcacaaggatttaaaccaggcgaacctatgtgtctgactaatcacagaaatggacaaatctcaaagttgctaagagctccatcaaagaatgaaggatcatttttccttagcccatatttattggtcggtgctcttgctttgcttgcttctggagatgctgcttccgtattcattgacccaagtcttcctagacttattacagcaactgcagttgcatcagctgccatcggaacaactctaaatcaagtggtcctgccagatattcaaaagcttccacaaaaggcggtggatatagttgctgtacggcagcagcttttgtctcagtatgacattcttcagagccgtcttaaggaactgaaacagtttgcacaaaaagaggtgtggatgctcgcaaggatgtgtcaattggacaacaaaatactagcagtgggcgaaccatcttatcgtgctagacgaggtagagtaaagagggtacgggaaagcttggaaagcacactctctgcaaggattgagctaatggaaagttatgcaaaattgtgttcaatgattgaaattgaaattgagatggactctgatgttattgctgctgaagcggcaagcagtgcagagaggatatctgagcaaatacaacaattaatggagatcgatagtcttgaagagcaatggcgtatacaagctgaagctaatgatgaagctgaaaggcttctgagttctgattcttcagaaacattgcctgctggacatatgtaatgcaattttggtaatgcgcaagcattattctcctatttcctatttagatatttatatctctgcaattttaatgttctttaccaaattacaaacaaatttctagtttaggattttgaaggaaaatattgctacagaacattagaaaaaacgaaccgtatgataacagtgagatgacatcatgaatcctgcaacagaataatacagaatattgattggaaccgtgtagc

SEQ ID NO: 33534 - protein, 327 aa, Panicum virgatum
  misc_feature: Ceres CLONE 1952714
  misc_feature: Functional homolog of the protein sequence given in SEQ ID NO 51009
  misc_feature: Useful for making plants with altered lignin content
MDISALEKALRFINIRKDGLPAAVHSIVIRAPSGIARTHRFATQNVELPAREGERVTISLAAPSNIYREVGPLKIAARSQGFKPGEPMCLTNHRNGQISKLLRAPSKNEGSFFLSPYLLVGALALLASGDAASVFIDPSLPRLITATAVASAAIGTTLNQVVLPDIQKLPQKAVDIVAVRQQLLSQYDILQSRLKELKQFAQKEVWMLARMCQLDNKILAVGEPSYRARRGRVKRVRESLESTLSARIELMESYAKLCSMIEIEIEMDSDVIAAEAASSAERISEQIQQLMEIDSLEEQWRIQAEANDEAERLLSSDSSETLPAGHM

SEQ ID NO: 33535 - DNA, 828 bp, Panicum virgatum
  misc_feature: Ceres CLONE 1952722
  misc_feature: Encodes the peptide sequence at SEQ ID NO. 33536
aaagacgaccccaaccccaatcatcatcgtcgtcaacgaccgatcacgcgagcaacttggggcgacggagcgcagccgccgtaaaacctagcacgggatcccgaaccgcggccggcgagatgcagatcttcgtgaagacgctggcggggaagaccatcacgctcgaggtcgagagcagcgacaccatcgacaatgtcaaggccaagatccaggacaaggagggcattcccccagaccagcaaaggctgatttttgctggtaagcaattggaagatgggagaacattagctgattacaacattcagaaggagtcgacacttcatttggtcctgaggctcaggggtggaactatgatcaaggtgaagacacttacagggaaggaaattgagattgacattgatcccactgacacaattgataggatcaaggagcgtgttgaggagaaagagggtatcccacctgttcagcagaggtactctttctgcccacacaagctgaatgggctcatttatgctggcaagcaacttgctgatgacaaaactgccaaggattacaacatcgaaggtggttcggtgctccatcttgtgcttgctctgaggggtggccagtagattcaacttctacccgtagcttatgttattgcgatttctacctatagttggttgagactttaagccttgtattgggtggttgattgaagtggattagtggactaagagtcaggtgtcatctgtgctggatatgaaatgcttgaactatgtttatcagctgtcatctgattgcccaaatactcctttcatgggttcactttgataaatcatggttccc

SEQ ID NO: 33536 - protein, 163 aa, Panicum virgatum
  misc_feature: Ceres CLONE 1952722
  misc_feature (6)..(74): Pfam Name: ubiquitin Pfam Description: Ubiquitin family
  misc_feature (82)..(160): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLAGKTITLEVESSDTIDNVKAKIQDKEGIPPDQQRLIFAGKQLEDGRTLADYNIQKESTLHLVLRLRGGTMIKVKTLTGKEIEIDIDPTDTIDRIKERVEEKEGIPPVQQRYSFCPHKLNGLIYAGKQLADDKTAKDYNIEGGSVLHLVLALRGGQ

SEQ ID NO: 33537 - DNA, 632 bp, Panicum virgatum
  misc_feature: Ceres CLONE 1952730
  misc_feature: Encodes the peptide sequence at SEQ ID NO. 33538
tacaagggagtgaccagaaacggagatgatgttgctgtgaagttattgcttcccaattccagtctagactatgggcagttaaaaaatgagttctataacctcaggaagattaatcatcagaacattgtacaggttctgggatattgttttgaaacagagcaaaacccttttatcatgcccgatggaagtaaggtgtttgttaatgagatacgtggagcgctatgcttggagtatatgcacaatggcagccttcaacgacttctgctttctgatgagtttcctagacttgaatggcacacacggttcagaataatcaaggggacttgtgagggtctaaagtatattcatgaggagctggaagaacctatttaccacttggacctaaaacctgacaacatattgctagataaggacatggtaccaaagattgcagattttggtttgtccaggatcttttgtgaagaaccaacacgattcacacaaaatccttatggaacactagggtatcagccaccagaatatatcgacaaaggtgaaatatcaggaaaatttgacatatttagcttgggtgtcgtaatgataaggattgtgtcaagaccccagggctaccccaaatgtctagatatgtcttc

SEQ ID NO: 33538 - protein, 210 aa, Panicum virgatum
  misc_feature: Ceres CLONE 1952730
  misc_feature (1)..(209): Pfam Name: Pkinase Pfam Description: Protein kinase domain
  misc_feature: SWISSPROT Homolog: EC 2.7.11.1 Non-specific serine/threonine protein kinase
YKGVTRNGDDVAVKLLLPNSSLDYGQLKNEFYNLRKINHQNIVQVLGYCFETEQNPFIMPDGSKVFVNEIRGALCLEYMHNGSLQRLLLSDEFPRLEWHTRFRIIKGTCEGLKYIHEELEEPIYHLDLKPDNILLDKDMVPKIADFGLSRIFCEEPTRFTQNPYGTLGYQPPEYIDKGEISGKFDIFSLGVVMIRIVSRPQGYPKCLDMS

SEQ ID NO: 33539 - DNA, 480 bp, Panicum virgatum
  misc_feature: Ceres CLONE 1952730-R
gtggaagcatattgccaccaagtaaagacatgcattcaaatagcattgttatgtgtgttggaagatagccagaataggcccaacatagggaagatcactgagaagctgaatgagattgaaactaccattggcgagcttccccagaaaggatgtctcaaaaaagtttctagaatagcaatgcataataacaagaatatagatatgagaaaggaatcagaggacaacaaaggtcgacaccagaatattaatttgatgacaggccctagttgcagtgagctggaatttgttgacgcaccagaagcatcgtcagatgtagtagaaaaactcattgttgggaggacagaagagaaagggaaaataattgcttctttacttgagggtatgtcagaaaagatcatcatccttcctatatatggtattggaggcattggcaagacaacttttgcaagattgatttacaatgatccaaatttcaaaagg

SEQ ID NO: 33540 - DNA, 412 bp, Panicum virgatum
  misc_feature: Ceres CLONE 1952744
  misc_feature: Encodes the peptide sequence at SEQ ID NO. 33541
gaatttggctcatgacatgggcctcaagacgaccacaccataccgggtttggttcgagggccagcaggttggaggatggactcaggtgtatggcggcggcacgctatccttcgccaccatcaggggggcctcccacgaggcgccgttctcgcagcccgggcggtcgttggtgctcttcagagccttcctgcagggccagcctctgcctgaaaccttctcatgatccatgaatgaggtgcttcgtttgcaatgcaatgccggttcctgcttctgcaaggggttttgtactgtaactgtaagaatgtgtttgctgcatttgcctcctgctggtagcgtttcttcaggttttttgctccctgtttcctctgtatcctcgtctcggcaattgtctaaagaagttgaaagaattgtc

SEQ ID NO: 33541 - protein, 73 aa, Panicum virgatum
  misc_feature: Ceres CLONE 1952744
  misc_feature: SWISSPROT Homolog: EC 3.4.16.6 Carboxypeptidase D
NLAHDMGLKTTTPYRVWFEGQQVGGWTQVYGGGTLSFATIRGASHEAPFSQPGRSLVLFRAFLQGQPLPETFS

SEQ ID NO: 33542 - DNA, 868 bp, Panicum virgatum
  misc_feature: Ceres CLONE 1952750
  misc_feature: Encodes the peptide sequence at SEQ ID NO. 33543
tcgaagaggcgggccacccgctcgcaaaaccctagccttgagtccgaggacgaggaggaggcgcggcgggtcaaggaggagatcgccgaggacctcaacggcgagcccgcggaggaggaggacgatgaggaggtggttgtggaggatgaggaggtgctcatcccctccgacgacgaggaagacggcggcgccgacgaccaagcccgaggcccctgcgcccgcgccccctgccaaggccaccgccccggcgcccgctgcggcgccccccgccgcggccgcgccgcccgcgcccgtgcccgaggtcccggccgccgcgccggcgccggakaccaagcccgccgaggcgcccgcccccgccaagaagaagaagccgtcgtcgccgccgcccaagagcaagaagaagaagaaggcggccgcgcccgccccggccgccgaggcccccgtcgccaagaagcacaaggccgccgacgcgccctcaaccgacgccgaggccccagggcccagcggcgacgccgccgccgccgacaccgcgagcgccgcagggaggaccagggggcgggcggcgggcgcgatcgcgtcggccgtcgcggttgcgctggccgcggcggcgctgctcgcctagatcccggatgcttttgctctgtgcctgtgaccccacaggatccgatgctgctactggccgtgctacccttttcccgctttttcctcttttgtgtaatttgtgactagtgtagtagggctctcacatggcattgattcacttgtgcggatgcattcttttgctttaggttagagatggtaggggtgtgcttgcctgtgtattgttcagatttatttataactctttatatatcattgttattgcttc

SEQ ID NO: 33543 - protein, 165 aa, Panicum virgatum
  misc_feature: Ceres CLONE 1952750
  misc_feature: Functional homolog of the protein sequence given in SEQ ID NO 50275
  misc_feature: Useful for making plants with altered carbohydrate content
  misc_feature (68)..(68): Xaa is any aa, unknown, or other
MRRWLWRMRRCSSPPTTRKTAAPTTKPEAPAPAPPAKATAPAPAAAPPAAAAPPAPVPEVPAAAPAPXTKPAEAPAPAKKKKPSSPPPKSKKKKKAAAPAPAAEAPVAKKHKAADAPSTDAEAPGPSGDAAAADTASAAGRTRGRAAGAIASAVAVALAAAALLA

SEQ ID NO: 33544 - DNA, 1295 bp, Panicum virgatum
  misc_feature: Ceres CLONE 1952778
  misc_feature: Encodes the peptide sequence at SEQ ID NO. 33545
aggcaagctctcggattctttcccttcttcttcttataacgcaagaaagaaaacggagaaatcgaaagggaaacctgaaaaagcctcactcgattcatcgcctccgcctctctcccagcagcgcacatcgccggcgacgccatggtcatgaagctggacatgtccgcgctcgagaccaacttcgccgtcccctgcggcgacgacggcgacggcacgtacttctccgccgaggcccccgacgtgccgtccatggtgctccccacctgcgccgacttcgacgggttccaggcggcgaccaaggagatggtgaagaataagaaggggacgaccacgctcgccttcatcttcgataagggcgtcatcgtcgctgccgactccagggccagcatgggcggctacatatcctcacaaactgtgaggaaaattattgaaataaatccctacatgctgggaacgatggctggaggagctgctgattgccaattttggcataggaaccttggaaccaagtgccggctccatgagctttcaaacaagcgaaggatctctattgctggtgcttccaaactgttggctaatatcctttattcatatcgtgggatgggactgtcaattggtacaatgattgcgggatgggatgagaagggtcctggcttgtactatgttgacagtgagggtgcaaggcytgtgggacacaggttctctgttggctctggttccctctatgcttatggtatcttggatgaaggttaccgcttcaacatgtcagtcgaggaagctggtgagttagctcgaagggctatttatggggcaaccttccgtgatgcagcaagtggtggttgtgttagtgtttatcacgttggccctgatggttggaagaagctttctggagatgatgtcggggagctgcactaccattactacccagttcagaaaacaccggttgaacaggagatgaccgatgcagctactgcttctgcttaaacccgtcgtttagaggtgcatgtatccagggaaccgtgaattgtcaaagcgccttgtttatgaacttggacatgtttgtctcacaatgttagatcacttttgtgtcctgttgatgtttctgagtgactttgcgcaattattaaattcttgacccaccgatatagatgttttctttgaggtttcacttgtgccccagtctgtgtgtgatcccttggtcttttatatgttttgcgtctgcttgtaatcagctctggtataccaaagcacatccacagaactgcatttcacagaatcgcatttgctcagacagc

SEQ ID NO: 33545 - protein, 280 aa, Panicum virgatum
  misc_feature: Ceres CLONE 1952778
  misc_feature (58)..(240): Pfam Name: Proteasome Pfam Description: Proteasome A-type and B-type
  misc_feature: SWISSPROT Homolog: EC 3.4.25.1 Proteasome endopeptidase complex
  misc_feature (182)..(182): Xaa is any aa, unknown, or other
MVMKLDMSALETNFAVPCGDDGDGTYFSAEAPDVPSMVLPTCADFDGFQAATKEMVKNKKGTTTLAFIFDKGVIVAADSRASMGGYISSQTVRKIIEINPYMLGTMAGGAADCQFWHRNLGTKCRLHELSNKRRISIAGASKLLANILYSYRGMGLSIGTMIAGWDEKGPGLYYVDSEGARXVGHRFSVGSGSLYAYGILDEGYRFNMSVEEAGELARRAIYGATFRDAASGGCVSVYHVGPDGWKKLSGDDVGELHYHYYPVQKTPVEQEMTDAATASA

SEQ ID NO: 33546 - DNA, 1199 bp, Panicum virgatum
  misc_feature: Ceres CLONE 1952785
  misc_feature: Encodes the peptide sequence at SEQ ID NO. 33547
atcgccttcccacacctccccagccccccaccccacccaccgcccccgccgctccaggccccgaaatgtcggtcgaaggcggcgccggcgagccgctcagtgacagccagaagcgggagatcgccgtctggttcctcaccaacgcgcccgccggcgagatccactacgtcgccaaagatgtgcgcgctctgctgggggacgacgcggtgtacgaggccgccgccgcggaggccttcccggagtacaacaaggcccacctcgtgtccctcgagctccccgaccgcagtggcgacataatcatcgcaacttacggggagcttgacaggaacaattatctggaccccaggactgctcaagttgctactgttgatcacattaaacagacttgtacaaaattgaggcctgctgcagatgaggagcttccgtcagcttacattgaagagtttaggagtgctttagatgtggaattatcaaaatatgttgccgaagcttatcccaaaggggtctgtgctgtttattgtactagtggaaaggatatagagggaccaggagcagattttggttttgcagtagttatttctgctgctaaacgtagcccacagaacttctgcaatggcagctggcgttcaatttggactatggatttcaattatgagttgcaatttgttgatataaagggaaagatacaggtagatgctcactattttgaagagggaaatgtccagctggatactaacattgattgcaaggactccaccataatgcagtcacctgacgattgtgcagtttcaataactaacatcattcgacatcatgagtctgagtatttgtcgtctcttgaggaatcatacttgaatttgtttgatgcaactttcaaggatcttcggaggaaacttccagttaccaggacccttttcccatggcataacacattagccttcagtctcacaagagacctcgccaaagaactagcgcttggaaaatgaagtctgcaggctatgtcactggatagcttcaagtggattttttttttttttatctccatgccatgtgctgttctgtagattgtactattcatatgatgtaaccaagactactttgatcttttgatatgtgagcttcatcgtcccagtcattgtaaatcaagaacacagacttctgttgagaattgcatttcctgaaaatatacatccattcac

SEQ ID NO: 33547 - protein, 306 aa, Panicum virgatum
  misc_feature: Ceres CLONE 1952785
  misc_feature (15)..(297): Pfam Name: F-actin_cap_A Pfam Description: F-actin capping protein alpha subunit
MSVEGGAGEPLSDSQKREIAVWFLTNAPAGEIHYVAKDVRALLGDDAVYEAAAAEAFPEYNKAHLVSLELPDRSGDIIIATYGELDRNNYLDPRTAQVATVDHIKQTCTKLRPAADEELPSAYIEEFRSALDVELSKYVAEAYPKGVCAVYCTSGKDIEGPGADFGFAVVISAAKRSPQNFCNGSWRSIWTMDFNYELQFVDIKGKIQVDAHYFEEGNVQLDTNIDCKDSTIMQSPDDCAVSITNIIRHHESEYLSSLEESYLNLFDATFKDLRRKLPVTRTLFPWHNTLAFSLTRDLAKELALGK

SEQ ID NO: 33548 - DNA, 458 bp, Panicum virgatum
  misc_feature: Ceres CLONE 1952803
  misc_feature: Encodes the peptide sequence at SEQ ID NO. 33549
atggagagatccatgcaaccataaaccaaaaggatggcatggtcagctttcacgaagaccctgaacaatataaaagtgttgagatggtggagcatatcgactcttctattcaaaggttgacggctctgtccaagaagttggcttcaattgatgagaacatggcatgcgatcctgcatatttacagaaggtcagttcaactggacgggatcgtggaagattcgactacgaggacttcgacactgttccacacaagtacaacttttgagatgatccaagcccttgcggctcgaaagtacaatcgtcaagctagggtgccattccttattattaattcgatccatctatggctttttgaaaattgatgagatgctgtaaattttggtttgaagaacgggtccgtcggagaaggcagatgcttctgttccagttatttatcgtgtcaaggatgtttgcgagc

SEQ ID NO: 33549 - protein, 87 aa, Panicum virgatum
  misc_feature: Ceres CLONE 1952803
  misc_feature: Functional homolog of the protein sequence given in SEQ ID NO 50753
  misc_feature: Useful for making plants with modulated light quality sensitivity
  misc_feature: Useful for making plants with modulated low light sensitivity
GEIHATINQKDGMVSFHEDPEQYKSVEMVEHIDSSIQRLTALSKKLASIDENMACDPAYLQKVSSTGRDRGRFDYEDFDTVPHKYNF

SEQ ID NO: 33550 - DNA, 633 bp, Panicum virgatum
  misc_feature: Ceres CLONE 1952812
  misc_feature: Encodes the peptide sequence at SEQ ID NO. 33551
gccactcgctcctgccccccgcgcctctctccgctcccaactcgcgtctcgatccctcctccgatctctcttctctcgggaggatggaaggccctccaatcgcgcttttcgacagcctcaaggctgccaaaccattcttcttgctagctgggcccaatgtgattgaatcggaggagcatgtcctgaagatagccaaacacattaaaggcatcacaaccaagcttgggatcccacttgtgttcaaatctagcttcgataaagcaaatcgtacatcatcaaaatctttccgtggccctggtctggaagaaggcctgaagatccttgaaaaggtgaaagcaacatatgaccttccagttgtcactgatgtgcatgaaagccaccagtgtgaagctgttggaaaagttgctgacattatacaaattccagctttcctctgtcgccagactgatcttctcgtggctgctgctaagactggaaaaattatcaatatcaagaaaggacaattctgtgcaccctctgttatggtcaactctgcggagaaaataagacttgctggaaatcctaatgtgatggtctgtgagcgtggtaccatgtttggctacaatgatctaattgttgacccaaggaattttg

SEQ ID NO: 33551 - protein, 183 aa, Panicum virgatum
  misc_feature: Ceres CLONE 1952812
  misc_feature (11)..(183): Pfam Name: DAHP_synth_1 Pfam Description: DAHP synthetase I family
  misc_feature: SWISSPROT Homolog: EC 2.5.1.55 3-deoxy-8-phosphooctulonate synthase
MEGPPIALFDSLKAAKPFFLLAGPNVIESEEHVLKIAKHIKGITTKLGIPLVFKSSFDKANRTSSKSFRGPGLEEGLKILEKVKATYDLPVVTDVHESHQCEAVGKVADIIQIPAFLCRQTDLLVAAAKTGKIINIKKGQFCAPSVMVNSAEKIRLAGNPNVMVCERGTMFGYNDLIVDPRNF

SEQ ID NO: 33552 - DNA, 320 bp, Panicum virgatum
  misc_feature: Ceres CLONE 1952812-R
  misc_feature: Encodes the peptide sequence at SEQ ID NO. 33553
cgcaaggacttatgttgctgttggtgttgatggtattttcatggaggtacatgatgatcccttgaatgcgccatgtgatggcccaacccaatggccattgcgcaatttggaggagctattggaggaattgttagcaatcgctcgagttaccaagggaaagaagccgttcaagattgatctcacaccgttccaggaatgatctggtttggtagattgagagcacaatgacactgtccactggtttcaacagggcgtatttctcattgctgtacttgttattgttttgggcatagctgccgtagacgactgttatatcggaa

SEQ ID NO: 33553 - protein, 65 aa, Panicum virgatum
  misc_feature: Ceres CLONE 1952812-R
  misc_feature: SWISSPROT Homolog: EC 2.5.1.55 3-deoxy-8-phosphooctulonate synthase
ARTYVAVGVDGIFMEVHDDPLNAPCDGPTQWPLRNLEELLEELLAIARVTKGKKPFKIDLTPFQE

SEQ ID NO: 33554 - DNA, 993 bp, Panicum virgatum
  misc_feature: Ceres CLONE 1952822
  misc_feature: Encodes the peptide sequence at SEQ ID NO. 33555
gctgatgtgctgttaagctgttaagctgcgaagctaaaaagcggtgctcgtctgctgccctggaggctggtcaagcacgcttccgaattaaaagcgctctggcccgcctgctctctcctccacggccggccgcgtcccttcccccctcccccacctcccccccgcatttcttgatttcttcttccaccgggaacaatgtctccggcgccgacctcgcatcagtcgcagatcaattcgaggaaggagaagcgcatgaggaaggtggacaccttcgcgccgcacaacgacggccaccaatggaggaagtacggcgagaagaagatcaacaacaccaacttccccagatactactacagatgcacctacaaggacaacatgaactgcccggccacgaatcaggtgcagcataaggaccacagcgacccgccattgtacgcggwcacctactacaacgagcactcgtgcawcagcgccttcctcccgctctccccctccgagttccagctgcagacctcgtcggggaaggccgtctccatctgcttcgactcctcgtccgggccggccgcgcaagaaccgccgtccgtcgccgcagcctccgccgcggcggccaccaatgccagcggcggctcgccctcctccagcgccgcgctgcggcggtcggagacgtacccgtggggcgcgggcgccgtggagcagaagccggcgtcctgcagcaccgagtgccacgacgcgttcccgggtggcgccggcgcggtgccggaagaggtggtagatgcaggcagatttgggtctatcaggttcttccactttttgtaaattgatcggtggaaggcaattgattttacttcatcaagaaactaatatgatacagatgtctttttttctttttgttcctttattacgtgcggaagagtactagagattcgcatgttacttttgttctcttggttcaagaatcgaaataccactgctaatttaaatccagttcatctc

SEQ ID NO: 33555 - protein, 206 aa, Panicum virgatum
  misc_feature: Ceres CLONE 1952822
  misc_feature (29)..(92): Pfam Name: WRKY Pfam Description: WRKY DNA -binding domain
  misc_feature (82)..(82): Xaa is any aa, unknown, or other
  misc_feature (91)..(91): Xaa is any aa, unknown, or other
MSPAPTSHQSQINSRKEKRMRKVDTFAPHNDGHQWRKYGEKKINNTNFPRYYYRCTYKDNMNCPATNQVQHKDHSDPPLYAXTYYNEHSCXSAFLPLSPSEFQLQTSSGKAVSICFDSSSGPAAQEPPSVAAASAAAATNASGGSPSSSAALRRSETYPWGAGAVEQKPASCSTECHDAFPGGAGAVPEEVVDAGRFGSIRFFHFL

SEQ ID NO: 33556 - DNA, 694 bp, Panicum virgatum
  misc_feature: Ceres CLONE 1952888
  misc_feature: Encodes the peptide sequence at SEQ ID NO. 33557
accgagtgacacacagagagacatcagatttgcgttgtctcccgtgcagccgagtggttcagtgctagctagctagctgttgggacctgggcgtgctcccctggaccgggaaggacaccaccccttctcttccacctctgttcgcctccatttgggtttcaggccaaagagaggctaagttcatagccaaagggagctgaattcaagggggctgcgccgagatggagcacatcgcgaggttcttcttcggagtttccgggaatgtcattgcgctcttcctcttcctgtcgcctgtcgtcaccttctggaggatcatcaagaagcgctcgacggaggacttctccggcgtgccctacaacatgacgctgctcaactgcctcctatcggcttggtacgggctgccgttcgtgtccccgaacaacatcctggtgacgacgatcaacgggacggggtcgctgatcgaggccatctacgtggtgatcttcctcatcttcgcggagcggcggatccggctgcggatgctgggcctgctgggcgtcgtcacctccatcttcgccgcggtggtgctcatctcgctgctggccctccacggcaacggccgcaagatcttctgcggcctcgccgccaccgtcttctccatctgcatgtacgcctcgccgctctccttctgcggcacctcctggttcatctacgg

SEQ ID NO: 33557 - protein, 157 aa, Panicum virgatum
  misc_feature: Ceres CLONE 1952888
  misc_feature (7)..(96): Pfam Name: MtN3_slv Pfam Description: MtN3/saliva family
MEHIARFFFGVSGNVIALFLFLSPVVTFWRIIKKRSTEDFSGVPYNMTLLNCLLSAWYGLPFVSPNNILVTTINGTGSLIEAIYVVIFLIFAERRIRLRMLGLLGVVTSIFAAVVLISLLALHGNGRKIFCGLAATVFSICMYASPLSFCGTSWFIY

SEQ ID NO: 33558 - DNA, 1076 bp, Panicum virgatum
  misc_feature: Ceres CLONE 1952890
  misc_feature: Encodes the peptide sequence at SEQ ID NO. 33559
ctctctctcatcatcgtcgccacctccatcccgtctccatccccttcggcctccgatccctccacgagtcgagcagaggatccgcggcggcggcgggcggcgggcggtggtcggccggcgatggcgcaccgggtggacaacgagtacgactacctcttcaagatcgtgctcatcggcgactccggcgtcggcaagtccaacatcctctcccggttcacccgcaacgagttctgcctcgagtccaagtccaccatcggcgtcgagttcgccacccgcaccctccagatagaaggaaagaccatcaaagctcagatatgggatactgctgggcaagagaggtaccgtgcaatcactagcgcttactacagaggagctgtgggtgcacttttagtctacgatatcacaaagaagcagacatttgaaaatatccagaggtggcttcgtgagctccgtgatcatgcagactccaacattgtgatcatgatggttggtaacaaatcggatctgaaccacctgagatcagttccagaggaagatggccaggcattarcagagaaggaaggcttatccttcctggagacatcagctcttgaagccgtgaatgttgagaaggcatttcagactattctcgcagatattcatcaaatcataagcaagaaggcgcttgctgcccaggaggcagcaggcagcgggccaccaggtcaaggaaccaccatcaatgttgctgactcgtctgccaacacaaagagaggatgctgttcttcctaggggcaaacaaagatgtgatggtactgcaaaaggaaaatattatggatcttacaacactgtaggtgttatgtaggttgccttgactccttttcacctgtaactctggtggggttgtaatcacaattcatacttctgcaaagaaattctcctctcaggtagatattttggtagagaccagtgtttggcagacttgcttcgagagtgtgttttctttcagtgttgagtgttctatccttatatagtctttctactgaaaagaacaaaatcagatatttcttgtatttctacttgagtttgtggtatgattc

SEQ ID NO: 33559 - protein, 215 aa, Panicum virgatum
  misc_feature: Ceres CLONE 1952890
  misc_feature (14)..(175): Pfam Name: Ras Pfam Description: Ras family
  misc_feature (14)..(128): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50223
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
  misc_feature (144)..(144): Xaa is any aa, unknown, or other
MAHRVDNEYDYLFKIVLIGDSGVGKSNILSRFTRNEFCLESKSTIGVEFATRTLQIEGKTIKAQIWDTAGQERYRAITSAYYRGAVGALLVYDITKKQTFENIQRWLRELRDHADSNIVIMMVGNKSDLNHLRSVPEEDGQALXEKEGLSFLETSALEAVNVEKAFQTILADIHQIISKKALAAQEAAGSGPPGQGTTINVADSSANTKRGCCSS

SEQ ID NO: 33560 - DNA, 1167 bp, Panicum virgatum
  misc_feature: Ceres CLONE 1952896
  misc_feature: Encodes the peptide sequence at SEQ ID NO. 33561
tatggcaagcccggcggcaccacggtcggcgtcggcaagggcggagtcggcgttaacgtcaagcctggttatggcaagcccggcggcaccaccgtcggcgtcggcaagggcggcgttggcgtcaacgtcaaaccagggagcgggaagcccggcggcaccacggtggccgtcgggaagggcggggttggcgttaacgtgaagccccgcggcaagcccgtccacgtcgacgtcgctcctttccattacaactacgccgcaacggagacgcagctgcacgacgaccccagcgtcgcactcttcttccaggagaaggagctccaccccgggaagaagatgaccgtccagttcaccaacaccgtgcccggcaccaagttcctcccccggagcgaggccgatgccatcccgttctcctcggagaaggtgcccgagatcctcaaccgcttctcggtgagcccggactccgtcgaggcggcggagatggcgcagacgctgcgcgactgcgaggcgcccgcggccaagggcgagaagaaggcctgcgccacgtcgctggagtccatggtcgacttcgccacggccggcctcgggaccagccacgtgagggccgtctcgaccgtcgtggcgaggccggactcgccgaagcaggagtacaccatcaccggagtgaagcgcgtggccggcgccgacgacggccggctcgtcgcctgccacgcggagccgtacgcgtacgccgtgttcgcgtgccaccagacgcggcagacgcgggcgtactcggtgtcgatgctcggcagagacagcacggccgtggacgccgtcgcggtgtgccacgccgacacgtccgggtggaaccccaagcacgtcgccttccaggtgctcaacgtgaagcccggcaccgtgccggtctgccacttcctgccgcaggaccacgtcgtctggacccgcagcggctgacccttggatggccgccgtgcctgttcttgctgcgcaggtttcatctacgttctagtagccggcctctgagcgaactgtcatcttgtatcatgtgtttgcttatgttttcagtacttgatacttgtatgaatggtgttgccagccagtatcgtgtatcgactatcgatcacctgctaggttctgctgtatagttctaaataaacagacatctctttatcc

SEQ ID NO: 33561 - protein, 315 aa, Panicum virgatum
  misc_feature: Ceres CLONE 1952896
  misc_feature (98)..(314): Pfam Name: BURP Pfam Description: BURP domain
YGKPGGTTVGVGKGGVGVNVKPGYGKPGGTTVGVGKGGVGVNVKPGSGKPGGTTVAVGKGGVGVNVKPRGKPVHVDVAPFHYNYAATETQLHDDPSVALFFQEKELHPGKKMTVQFTNTVPGTKFLPRSEADAIPFSSEKVPEILNRFSVSPDSVEAAEMAQTLRDCEAPAAKGEKKACATSLESMVDFATAGLGTSHVRAVSTVVARPDSPKQEYTITGVKRVAGADDGRLVACHAEPYAYAVFACHQTRQTRAYSVSMLGRDSTAVDAVAVCHADTSGWNPKHVAFQVLNVKPGTVPVCHFLPQDHVVWTRSG

SEQ ID NO: 33562 - DNA, 998 bp, Panicum virgatum
  misc_feature: Ceres CLONE 1952899
  misc_feature: Encodes the peptide sequence at SEQ ID NO. 33563
ctctccccatctccaggggaggcgccgcgcgctgctccctcctctccccttcggcgccggcatcacctccgcggccaccattatcacttgtgaaagtatcttgtggggagatggcggtttctttcgctaacctcaactctgaggcagggcttaaaaagcttgacgactaccttctcactctcagctacattaatggttaccaagcttcgaaggatgacttggctgtctactcctcattttctgctgctccctcatccaattatatcaacgtcacaaggtggttcagtcacattgatgcactcttgaggctgagtggagttactgcagagggccagggtgtcaaggttgaatcatctgctgttccatcaacatcaacacctgatgttgctgacacagcggctacacctgctgatgacgacgacgatgatgatgttgacctttttggcgaggagaccgaagaggagaagaagkctgctgaagagcgtgctgcagctgtcaaggcttctggcaagaagaaagaatctgggaagtcgtcagttttgcttgatgtgaagccatgggatgatgagtctgacatggccaagcttgaggaagcagtaaggaatgtcaagatggaaggcctgctttggggtgcatccaagcttgtcccagttgggtatggcatcaagaagcttcagatcatgttgagtattgttgatgaccttgtctctgtcgacattctgatcgtggaccatttgtgcgctgagccagtgaaggagtatgtccagagctgtgacattgttgctttcaacaagatctaaatttgttgagctccggctgtgtggtcagtggacagtgcaccggtccaatttatccagagttttgcatcactatgtttgccccgtgtgtcgactagttattgcttgtgaggtttttggaacctagtcaaaagtgtaccagttactgttaccagggttaatttgccttatttgaaagaccgacgggctggatttttggtc

SEQ ID NO: 33563 - protein, 229 aa, Panicum virgatum
  misc_feature: Ceres CLONE 1952899
  misc_feature (140)..(229): Pfam Name: EF1_GNE Pfam Description: EF-1 guanine nucleotide exchange domain
  misc_feature: SWISSPROT Homolog: EC 6.1.1.16 Cysteine--tRNA ligase
  misc_feature (121)..(121): Xaa is any aa, unknown, or other
MAVSFANLNSEAGLKKLDDYLLTLSYINGYQASKDDLAVYSSFSAAPSSNYINVTRWFSHIDALLRLSGVTAEGQGVKVESSAVPSTSTPDVADTAATPADDDDDDDVDLFGEETEEEKKXAEERAAAVKASGKKKESGKSSVLLDVKPWDDESDMAKLEEAVRNVKMEGLLWGASKLVPVGYGIKKLQIMLSIVDDLVSVDILIVDHLCAEPVKEYVQSCDIVAFNKI

SEQ ID NO: 33564 - DNA, 1135 bp, Panicum virgatum
  misc_feature: Ceres CLONE 1952902
  misc_feature: Encodes the peptide sequence at SEQ ID NO. 33565
atacctttacctttcgatcggcggccgcctccctcctcccctccactcccgtccccttccccgagccgccgccgccgccatggccatgaagggacccggtctcttctccgacatcggcaagaaggccaaggatctgctcacgaaggactacacctacgaccagaagttcaccatctccaccgtcagcgcctccggagtgggcctcacttccacagctgtgaagaaaggagggctttatactcttgatgtcagctcagtttacaagtacaagaatactcttgttgatatcaaagtggacactgaatcaaacatctctaccaccttgactgtgttggatgccctgccatccacgaaacttgtgacgtctgtgaagctgcctgactacaattctggaaaggtggaattgcaatacttccatgagaatgcaagttttgctactgttgttggcacaaagccatctcctgtggttgaactttctgggacagttggtgctcaaggagtttcgtttggtgccgaagctgggtacgacactgctacaggaaaacttaccaagtacactgctgcaattggtgtaaccaagccagactaccatgctgcattcattctggccgataaaggtgacaccattaaagtgtcaggtgtttatcaccttgatgagaagcagaaagcctcagctgtggctgaactaacacggaggctctcaacaaatgagaacacactcactgttggtggcctatacaagattgatcttcagacagccgtgaagacaaggctcaacaacactggaacgcttgccacgcttcttcagcatgagcttaaacccaagtcactcttgacaatctccggtgaattcgataccaaggccctggacagggcccccaagtttggcctggcacttgcattgaagccctgatcagatcattcccggttgattgctggtgaattttggattctttggttgtttttgcaaagctgtagccaataatttgttccacggatatgttctgttaacctggcaaaggtttgacgctgtgtgggaaggatccggatgggtcgtctacaagattttttacccatcggtttttgttgttgaaagcatctgtagatgtatgccagttatttcttttttgcttcc

SEQ ID NO: 33565 - protein, 277 aa, Panicum virgatum
  misc_feature: Ceres CLONE 1952902
  misc_feature (5)..(270): Pfam Name: Porin_3 Pfam Description: Eukaryotic porin
MAMKGPGLFSDIGKKAKDLLTKDYTYDQKFTISTVSASGVGLTSTAVKKGGLYTLDVSSVYKYKNTLVDIKVDTESNISTTLTVLDALPSTKLVTSVKLPDYNSGKVELQYFHENASFATVVGTKPSPVVELSGTVGAQGVSFGAEAGYDTATGKLTKYTAAIGVTKPDYHAAFILADKGDTIKVSGVYHLDEKQKASAVAELTRRLSTNENTLTVGGLYKIDLQTAVKTRLNNTGTLATLLQHELKPKSLLTISGEFDTKALDRAPKFGLALALKP

SEQ ID NO: 33566 - DNA, 1189 bp, Panicum virgatum
  misc_feature: Ceres CLONE 1952903
  misc_feature: Encodes the peptide sequence at SEQ ID NO. 33567
gaggacggggagcctgcagccaccatggattccgagctgtggatctcgcgcctcatggccgccaagcggcagttcgcgctgcagcgcgcccagcgccagcatgccactccggcttcccatcacgatcggttcgggtatgatgatattgaaccagaggatgagggacgctcagacttcccatgtccttactgctatgaagaccatgatattacatcactttgcacccatttggaggatgagcacccatttgagtctaaagttgtggcttgcccagtttgctcggccaggatttcgaaggacatgttggaacatataactcttcagcacggctacctgttcaaattgcaaagacatcacaggttacgtagagttgctggtgctggcaaccacactctctcttatgcagggagagatcttcaagagacctacttaaaggtgctgcttggaaatagcggtcgaagcagcagcactaccaatacatcaacttcagacactgattcactgctatcttcattagttttaaatttatcttcatcagaagcagaagacacctcaaaatcttctgctcctgctgtggccgaaaatagttggtttaaaagatcactatcttcaaagaattggaagataagttctgctgattccaaccttagtcatgaagagagggagcagagaaggaggcgagctgtggtgagatcagcatttgtacagcatatccttgtcactacccttttcgatgactagcaggacatagctcatgcattgaaatcatgtgggccttttgcccactcatttatctggatgaataatgagctaatcacctccggtatctcgaagttgttcatcaaactgaggttggtacctgattccatgaagctcgatgataaattgaagactcagagggcctcttaccttatatggaagcagctctgaacatttgctgtccagatcaaattcagactgctaggctattaactagcgttcttatagtagagtcttgatgtttctttcattggatttcgttttgtgctgcagaacgtgttgtaccttatcctatttattattactatggacatttgaatgttagtctttccaactatggtgtatgcttatgaaatctgtttgaaccttgcgttcatttatttcaacatattgcagtgtgtaagtgacaactctattaaatccttatggc

SEQ ID NO: 33567 - protein, 238 aa, Panicum virgatum
  misc_feature: Ceres CLONE 1952903
  misc_feature (18)..(235): Pfam Name: Di19 Pfam Description: Drought induced 19 protein (Di19)
MDSELWISRLMAAKRQFALQRAQRQHATPASHHDRFGYDDIEPEDEGRSDFPCPYCYEDHDITSLCTHLEDEHPFESKVVACPVCSARISKDMLEHITLQHGYLFKLQRHHRLRRVAGAGNHTLSYAGRDLQETYLKVLLGNSGRSSSTTNTSTSDTDSLLSSLVLNLSSSEAEDTSKSSAPAVAENSWFKRSLSSKNWKISSADSNLSHEEREQRRRRAVVRSAFVQHILVTTLFDD

SEQ ID NO: 33568 - DNA, 590 bp, Panicum virgatum
  misc_feature: Ceres CLONE 1952905-R
  misc_feature: Encodes the peptide sequence at SEQ ID NO. 33569
acggacaacaccaccatcgtcgagatggaccccggcagcttccggaccttcgacctgagctactaccggggcgtgctcaagcgccggggcctgttccagtcggacgcggcgctgctcaccgacccggcggccaaggccgacatcctcagcgcggtgaactcgccgcccgagtttttcttccaggtgttcgcggcgtccatggtgaagctgggcgccgtcgaggtcaagacaggctccgagggcgagatcaggaagcactgcgccgtcgtcaactagcactaggtgccattgcccattcggggacccggaaggaaaacatggttccatttcttcagagatccttgggatactggtggtggatggatacatggattgtggtgtctctacgtttgtttttttgttgttgctgtattcttttgttacctttgtgctgatcattggggtgttctttttttttttcagtttctgtacgagctgtaactatgtgatttacacattttgttcttgttattcctgcaactgtaagttaattcagtgatgactgaatttgatatacatgaaggtgaaataaagaagtgggacattctgtc

SEQ ID NO: 33569 - protein, 91 aa, Panicum virgatum
  misc_feature: Ceres CLONE 1952905-R
  misc_feature: SWISSPROT Homolog: EC 1.11.1.7 Peroxidase
  misc_feature: Functional homolog of the protein sequence given in SEQ ID NO 50563
  misc_feature: Useful for making plants with altered carbohydrate content
  misc_feature: Functional homolog of the protein sequence given in SEQ ID NO 50564
  misc_feature: Useful for making plants with altered cell wall content and/or composition
  misc_feature: Useful for making plants with modulated phosphate use efficiency
  misc_feature: Functional homolog of the protein sequence given in SEQ ID NO 50230
  misc_feature: Useful for making plants with modulated nitrogen use efficiency
TDNTTIVEMDPGSFRTFDLSYYRGVLKRRGLFQSDAALLTDPAAKADILSAVNSPPEFFFQVFAASMVKLGAVEVKTGSEGEIRKHCAVVN

SEQ ID NO: 33570 - DNA, 287 bp, Panicum virgatum
  misc_feature: Ceres CLONE 1952905
  misc_feature (177)..(177): n is a, c, t, g, unknown, or other
gtaccagcggcagctcgaggcgcgagtcagaggcgagccagcagcagctcgaggcgcgagtcagaggcgagccagcagccactagagcctcgagagcggagggagtgcgggatggcgagaatggcgctggtgctggttccggctcggctacgcgcattcgtgttgctggagcccgcnaccacacaaacaactacactatcctttatacactcccctacgccccccaaaactccctcttcaaacccaaccactaccccaacatcaatcaccacccctacaataactca

SEQ ID NO: 33571 - DNA, 459 bp, Panicum virgatum
  misc_feature: Ceres CLONE 1952913
  misc_feature: Encodes the peptide sequence at SEQ ID NO. 33572
ataacaccaccagttgtggcgactactggcgacagttgcagtgacgacggaggtcaccatcacgacggtggctgtggaggtcaccatggtggctgcggaggtcaccatggcggcggaggtcaccatggtggtggcggcggcggcggcggaggtcactttggccaccatggcggtggtggcggcggaggtcactttggccaccatggcggtggtcaccatggccaccatgttggccaccatggccaccatgttggcggaggaggcctccttggtggcggctactagaactgggaaggggctctcgagctatattataggtatctttttctgatcttcagtactgattattattttatatcggttgtttgtggtaaagtaatatggtgctgtatatttagcttgatgtaataatggaagaagtttgtactagtaattgccatgtgaccagtcagttgatat

SEQ ID NO: 33572 - protein, 94 aa, Panicum virgatum
  misc_feature: Ceres CLONE 1952913
  misc_feature: Functional homolog of the protein sequence given in SEQ ID NO 50178
  misc_feature: Useful for making plants with modulated nitrogen use efficiency
  misc_feature: Functional homolog of the protein sequence given in SEQ ID NO 50142
  misc_feature: Useful for making plants with altered lignin content
  misc_feature: Functional homolog of the protein sequence given in SEQ ID NO 50143
  misc_feature: Useful for making plants with altered alkaloid content
  misc_feature: Functional homolog of the protein sequence given in SEQ ID NO 50144
  misc_feature: Useful for making plants with altered terpenoid content
  misc_feature: Functional homolog of the protein sequence given in SEQ ID NO 50179
  misc_feature: Useful for making plants with modulated phosphate use efficiency
  misc_feature: The sequence is a functional homolog of SEQ ID NO 2 in US patent 7189892
  misc_feature: Functional homolog of the protein sequence given in SEQ ID NO 50185
  misc_feature: Useful for making plants with modulated flowering time
  misc_feature: The sequence is a functional homolog of SEQ ID NO 1844 in the 10/374,780 US patent application
ITPPVVATTGDSCSDDGGHHHDGGCGGHHGGCGGHHGGGGHHGGGGGGGGGHFGHHGGGGGGGHFGHHGGGHHGHHVGHHGHHVGGGGLLGGGY

SEQ ID NO: 33573 - DNA, 519 bp, Panicum virgatum
  misc_feature: Ceres CLONE 1952921
  misc_feature: Encodes the peptide sequence at SEQ ID NO. 33574
gctttacggctccccaccccgaaagaatccaccgcagaccgcacacagtcacctagtgcggcggccgccggcaatggcggcggtggcggcgcatggcggcgactacctgcggcgcttcgtcgcggagacggagtggtacaacgagctcgtcctcagcgcggtggcgcccggcaactggtggcgcggcctgccgcacccggtgcagtcgtggatgcgcaacatggtcggcggctacctcctctactacctctcgggcttcctctggtgcttcgtcatctactactggaagcgcaacgcctacatccccaaagattccgtccctacaaatgaagctatgaggaagcaaataattgtcgcatcgaaggctatgcctttgtattgtgcacttccagctttatctgagtacatgattgagagcggatggacacggtgttcctgacaggcctgctgtaatctacgactcggtcactgtgttggtgttgctgctgcgttttggtgatgtatctggtgccgcggaaa

SEQ ID NO: 33574 - protein, 121 aa, Panicum virgatum
  misc_feature: Ceres CLONE 1952921
  misc_feature: SWISSPROT Homolog: EC 1.14.21.6 Lathosterol oxidase
MAAVAAHGGDYLRRFVAETEWYNELVLSAVAPGNWWRGLPHPVQSWMRNMVGGYLLYYLSGFLWCFVIYYWKRNAYIPKDSVPTNEAMRKQIIVASKAMPLYCALPALSEYMIESGWTRCS

SEQ ID NO: 33575 - DNA, 452 bp, Panicum virgatum
  misc_feature: Ceres CLONE 1952921-R
  misc_feature: Encodes the peptide sequence at SEQ ID NO. 33576
cggcgccggcgaggcggtccgtggcggcgcgggcggagctgagcccatcgctggtgatcagcctcagcacgggcgtctcgctcttcctgggccgcttcgtcttcttcaacttccagcgggagaacgtggcgaagcaggtgcccgagcagaacggcaagacgcacttcgaggccggcgacgagcgcgccaaggagttcgccgccctgctcaagtccaacgaccccgtcgggttcaacctcgtcgacctcctcgcctggggctcgctcggccacatcgtcgcctactacatcctcgccacctccagcaacggatacgaccccaacttcttctgagcgccgggggcggtgttcctgacaggcctgctgtaatctacgactcggtcactgtgttggtgttgctgctgcgttttggtgatgtatctggtgccgcggaaagattcgttaaatttggac

SEQ ID NO: 33576 - protein, 109 aa, Panicum virgatum
  misc_feature: Ceres CLONE 1952921-R
  misc_feature (12)..(106): Pfam Name: PSI_PSAK Pfam Description: Photosystem I psaG / psaK
  misc_feature: Functional homolog of the protein sequence given in SEQ ID NO 50450
  misc_feature: Useful for making plants with modulated nitrogen use efficiency
  misc_feature: Functional homolog of the protein sequence given in SEQ ID NO 50449
  misc_feature: Useful for biocontainment applications
APARRSVAARAELSPSLVISLSTGVSLFLGRFVFFNFQRENVAKQVPEQNGKTHFEAGDERAKEFAALLKSNDPVGFNLVDLLAWGSLGHIVAYYILATSSNGYDPNFF

SEQ ID NO: 33577 - DNA, 694 bp, Panicum virgatum
  misc_feature: Ceres CLONE 1952935
  misc_feature: Encodes the peptide sequence at SEQ ID NO. 33578
ctagccgagttccgcagagaaaggcgtcttcaaaactcacctctccgcgactgaaaaaacttcctcgcccctcccaatattcccaccgccgccgccccaccccacccctccaacaacaccatgagggagtgcagtcgcaatccacatcggccaggccggtatccaggtcggagacgcctgctgggagctgtactggggctatcatggcattcagcctgatggacagatgcccggtgacaagacagttggaggaggtgatgatgcattcaacaccttcttcagagagactggcgcagggaagcatgtcccccgtgctgtgttcgttgatcttgagcccactgcgagtgatgaggtgaggactggcacatatcgccagctcttccaccctgagcagctcatcagtggcaaggaggatgctgccaacaactttgcccgtggtcactacaccattggcaaggagattgttgacctgtgccttgaccgcatcaggaagcttgccgacaactgcactggtctccagggcttcctcgtcttcaatgctgttggtggaggaacgggctctggccttggttccctcctccttgagcgcctgtctgttgactacggcaagaagtccaagctcgggttcactgtgtacccatctccccaggtctccacctcagatgttgagccatacaacagtgtcctgtccacc

SEQ ID NO: 33578 - protein, 155 aa, Panicum virgatum
  misc_feature: Ceres CLONE 1952935
  misc_feature (14)..(155): Pfam Name: Tubulin Pfam Description: Tubulin/FtsZ family, GTPase domain
  misc_feature: Functional homolog of the protein sequence given in SEQ ID NO 50141
  misc_feature: Useful for making plants with altered cell wall content and/or composition
MPGDKTVGGGDDAFNTFFRETGAGKHVPRAVFVDLEPTASDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSDVEPYNSVLS

SEQ ID NO: 33579 - DNA, 379 bp, Panicum virgatum
  misc_feature: Ceres CLONE 1952943
  misc_feature: Encodes the peptide sequence at SEQ ID NO. 33580
cttcccttcccccctctcctgaacggctcctggaccgggcgccgctagggtttcgccgccatgccgcagggagactacatagagctgcaccagaagcgccatgggcggcggccggactatgaggagcgcaagcgcaagcgcgaggcgcgcgaggttcacaagcggtcggagcaggcccggaagatgctgggtgccaaggccaagaggtttgccaagaagcggtatgccgagaaggcacagatgaagaagactctgaagatgcatgatgagtcaactaagagggataaggttgaggaagttcaggaaggagctctcccgccatatctacttgatcgtgatcagacacaacgtgcaaaagttcttagtaacactattaagc

SEQ ID NO: 33580 - protein, 106 aa, Panicum virgatum
  misc_feature: Ceres CLONE 1952943
  misc_feature (1)..(106): Pfam Name: Ribosomal_S8e Pfam Description: Ribosomal protein S8e
MPQGDYIELHQKRHGRRPDYEERKRKREAREVHKRSEQARKMLGAKAKRFAKKRYAEKAQMKKTLKMHDESTKRDKVEEVQEGALPPYLLDRDQTQRAKVLSNTIK

SEQ ID NO: 33581 - DNA, 656 bp, Panicum virgatum
  misc_feature: Ceres CLONE 1952945-R
  misc_feature: Encodes the peptide sequence at SEQ ID NO. 33582
gtttgatagccctagcccccagtggtggtggtgggacgatgtcgtttgcgaggtcattcatgtcatccttgagtatggaggggagtgtggctagcttggatggaaagcggccattccatttggttggtgcgccagtggcaagtgactcggctgatgcaaaccgtgtgcccaagcgaaggtgcacaggtagggggcaggatggcacaggcaagtgtgccactaccggcaggtgccattgctcaaagaggaggaaattgcgaattaagagatcgataaaagtgccagccattagcaataaaattgctgatatacctccagatgaatactcttggcggaagtatgggcagaagccgattaagggttcccctcacccaaggggttactacaaatgcagcagtgtcaggggctgcccggcaaggaagcatgttgagcgctgcgtagatgacccagctatgctaattgtgacttatgaaggcgagcacaaccatactcgaccgccagcacagtctgtccaaacctagagaatcagtaaaactcagcactccacacatgaagcgcaggccatgcctttgcttggatggccaagctgttcatcatgtagaaactcggtccattgatctactgatctttgaatgcacagtgaccgacatagagcc

SEQ ID NO: 33582 - protein, 172 aa, Panicum virgatum
  misc_feature: Ceres CLONE 1952945-R
  misc_feature (104)..(164): Pfam Name: WRKY Pfam Description: WRKY DNA -binding domain
  misc_feature: The sequence is a functional homolog of SEQ ID NO 736 in the 10/412,699 US patent application
  misc_feature: The sequence is a functional homolog of SEQ ID NO 528 in the 10/374,780 US patent application
  misc_feature: The sequence is a functional homolog of SEQ ID NO 28 in the 10/374,780 US patent application
  misc_feature: The sequence is a functional homolog of SEQ ID NO 476 in the 11/435,388 US patent application
  misc_feature: The sequence is a functional homolog of SEQ ID NO 678 in the 10/225,066 US patent application
  misc_feature: The sequence is a functional homolog of SEQ ID NO 1277 in the 11/479,226 US patent application
  misc_feature: The sequence is a functional homolog of SEQ ID NO 2442 in the 10/374,780 US patent application
  misc_feature: The sequence is a functional homolog of SEQ ID NO 48 in the 11/375,241 US patent application
  misc_feature: The sequence is a functional homolog of SEQ ID NO 590 in the 10/412,699 US patent application
  misc_feature: The sequence is a functional homolog of SEQ ID NO 632 in the 11/435,388 US patent application
  misc_feature: The sequence is a functional homolog of SEQ ID NO 1254 in the 11/479,226 US patent application
  misc_feature: The sequence is a functional homolog of SEQ ID NO 510 in the 11/435,388 US patent application
  misc_feature: The sequence is a functional homolog of SEQ ID NO 578 in the 10/412,699 US patent application
  misc_feature: The sequence is a functional homolog of SEQ ID NO 676 in the 10/412,699 US patent application
LIALAPSGGGGTMSFARSFMSSLSMEGSVASLDGKRPFHLVGAPVASDSADANRVPKRRCTGRGQDGTGKCATTGRCHCSKRRKLRIKRSIKVPAISNKIADIPPDEYSWRKYGQKPIKGSPHPRGYYKCSSVRGCPARKHVERCVDDPAMLIVTYEGEHNHTRPPAQSVQT

SEQ ID NO: 33583 - DNA, 666 bp, Panicum virgatum
  misc_feature: Ceres CLONE 1952945
tctctttctctgctgccgctcctcctcctcctccacctcctcctcccccttcgatccctcctcgccaggcctgcagcggccagggatgtaccgcgccgccgccgccgccgcctacgacagcccggtctttcccatctccctcgcgcaggtgctgctgtccgtgagaattggaaggagctgaggttccatccgaggtggtggaagagaggagcttggagttcagggaacggattgcttcttttcaccccctctccggctgcttctccacttcagccatggaggaggtggaggtggccaacagggccgcggtggagagctgccaccgggtgctgaccctgctctcccagtcccagcagcaggatccggccctgctcaagagcgtagcttcggtgatgggtgaagcctgcgccaagtttaggaaggtgaccgccctcctcggcaatggcggcagcaccgggcatgctaggggtagattctccaggagaggcaggcctgcggggctcttcaccctgaagagcctcttggggagcagcagcgatacccggtcggagcttatgccgagcactgctgctgctccatctccgtctactagctatgcgcaattgcgtgctcggattagtggcgcgccagacccacgagggctggatttggctagttcgagcggga

SEQ ID NO: 33584 - DNA, 1396 bp, Panicum virgatum
  misc_feature: Ceres CLONE 1952953
  misc_feature: Encodes the peptide sequence at SEQ ID NO. 33585
aatcattagccacaaaacacgcagccccgtcggcaaaacagtagtagcctcaactgacaacatctccgttgtgaacgcggatgaatgcctgatgacaaggatgcaggagatgtccctggattaccacttcaccgtggagcaggaagtcggctcctccacccacgccttcttcggcttcaatggaactgctggtgtatggcgcatatccgctctgaatgaggcaggaggttggaaggacaggaccacagtcgaagacatggatttggcggtgcgagcaagcctcaaaggatggaaatttgtattcctaggcgacctcatggtgaaaaatgagctcccaagcacactcaaagcataccgatatcaacaacacagatggtcatgtggaccggcaaacctgttcaggaaaatgctgatggagattgtcaggaacaagaaagtgacgctttggaagaaaatccatgtcatctacagtttcttccttgtgcgcaagatcatagcgcacattgtgacctttgtgttttactgcattgtcatcccggccacagtcttagttcctgaggttgagataccaaagtggggttctgtgtatatcccaaccatgatcacccttctcaatgctgtaggcactccaaggtcgctacacttaattgtcttctgggtactctttgagaatgtgatgtccttgcatagaacgaaggccactttcattggcctattggaggcaggcagggtaaatgaatgggtggtgacagaaaagcttggtgatgctttgaggatgaaaatgccaggcaagggatccaagaaacccctcatgaggatcggagataggttgcatatcctggagcttggtgtcgcagcatacctcttcttctgtggatgctacgacttcacatttgggaataatcactactacatattcctctttctccaatctattgctttcttcgtcgttggtgtgggctatgtcggtacatttgttccgtagcagaagggcaatgacaccatcttcatggattcatgattgggttaaactgtttacagctttatggtacataaccggatgaaaagataagattaagcagccttatcttgtgtgtacctgctgtcaggaagagaagccgtgcaagagcactgcaagacagtataggtatgtttttgctgctaggaatgtgctgtgaagcgcatgaatcagcagtagaaaaagatagcaaatcatgaaagtttcatcgtttgttgtgcaaacagaaaaacagaaaccttttgctcattcattgttcgcaagtttgttgggagaagagggagaaaataaagttgtacgtgttctcctttactttcattgtttcccatgtcaattttaattgtaataaaaatattgcatttgagaatattccagttc

SEQ ID NO: 33585 - protein, 327 aa, Panicum virgatum
  misc_feature: Ceres CLONE 1952953
  misc_feature: SWISSPROT Homolog: EC 2.4.1.12 Cellulose synthase (UDP-forming)
  misc_feature: Functional homolog of the protein sequence given in SEQ ID NO 51439
  misc_feature: Useful for making plants with altered cell wall content and/or composition
  misc_feature: Functional homolog of the protein sequence given in SEQ ID NO 51027
  misc_feature: Useful for making plants with altered carbohydrate content
IISHKTRSPVGKTVVASTDNISVVNADECLMTRMQEMSLDYHFTVEQEVGSSTHAFFGFNGTAGVWRISALNEAGGWKDRTTVEDMDLAVRASLKGWKFVFLGDLMVKNELPSTLKAYRYQQHRWSCGPANLFRKMLMEIVRNKKVTLWKKIHVIYSFFLVRKIIAHIVTFVFYCIVIPATVLVPEVEIPKWGSVYIPTMITLLNAVGTPRSLHLIVFWVLFENVMSLHRTKATFIGLLEAGRVNEWVVTEKLGDALRMKMPGKGSKKPLMRIGDRLHILELGVAAYLFFCGCYDFTFGNNHYYIFLFLQSIAFFVVGVGYVGTFVP

SEQ ID NO: 33586 - DNA, 1285 bp, Panicum virgatum
  misc_feature: Ceres CLONE 1952976
  misc_feature: Encodes the peptide sequence at SEQ ID NO. 33587
accatcctttcccctccgcctccgggtgccgggtttgactccggcggctcgcggagttgctcggctgccttctccctctcgagcctgagctgcaacatacgagcagcgagagaaatggcgagcgcggcatcctcgaggtgctccggcgttctcctccccccgaacctcgccggagcccgctgctgcccgcgtccgtcctcctccctccgcttccgttcgcggtcggcccggcgccgcccggggaccctcgcctgcgtcgcgccgccggactccgcggagcagcagacggatgagcagactgtgaaagcggagtcgactgtgggagaggctcagacaaccagcacgtcccaggatgctggacttccagctctcccaaataaggatctcaacagaagggtagcattactgtccactcttggggcagtagttctctttgggtcgcagaggctcaatcttactgaggcgtctcttaaagatcttgcagccaattcagttccatatgaggaggctctttcaaatggcaaacccactgttgttgagttttatgcggactggtgtgaagtttgccgagagttagctccagatatctaccaagttgagcaacaatacaaggaccgtgtcaactttgtcatgttgaatgtcgacaatacaaagtgggaacaagagcttgatgagtttggggtagaaggcatcccccattttgcctttctggataaggaaggaaatgaggaaggcaatgttgttgggagactcccaaaacagtattttcttgacaacgtggtggcacttgcttctggtgattccaacatacctcatgcacgagttgtgggtcagttctcaagtgctgaatctaggaaagttcatcaagttgccaatcccagaagtcacggctagtagttgctggctctgtgggtgctgggtagcagtataatggcaagaccatttgacaagaggcgaccctaggctatactattaagtattaacacaaccagtcttggtatcaaggcatcaagcttgcgggcgctggcaagagctggtgggtttcataataaacgccagaagaaaatgatggctgctgcagcaatcgtcaatggggtcatgaagatttccggatatgatttgttgatttgcatgtgtggattctggggacccatcttcagcgttgatttgtcagtgatgaatgacacggaaacgattgcaccttgtaccccacatgcttatatgtacagagataaatagtacagccgcggctatgcattacagtagggtaactgcaagaatcttg

SEQ ID NO: 33587 - protein, 259 aa, Panicum virgatum
  misc_feature: Ceres CLONE 1952976
  misc_feature (117)..(225): Pfam Name: Thioredoxin Pfam Description: Thioredoxin
  misc_feature: SWISSPROT Homolog: EC 1.8.1.8 Protein-disulfide reductase
MASAASSRCSGVLLPPNLAGARCCPRPSSSLRFRSRSARRRPGTLACVAPPDSAEQQTDEQTVKAESTVGEAQTTSTSQDAGLPALPNKDLNRRVALLSTLGAVVLFGSQRLNLTEASLKDLAANSVPYEEALSNGKPTVVEFYADWCEVCRELAPDIYQVEQQYKDRVNFVMLNVDNTKWEQELDEFGVEGIPHFAFLDKEGNEEGNVVGRLPKQYFLDNVVALASGDSNIPHARVVGQFSSAESRKVHQVANPRSHG

SEQ ID NO: 33588 - DNA, 294 bp, Panicum virgatum
  misc_feature: Ceres CLONE 1952998
  misc_feature: Encodes the peptide sequence at SEQ ID NO. 33589
aaaacttccgaaaggcaaagcccacgccgtcctctcctcgctcacgcggctcgccctcgagatctcgctcggccgccatggacgcgatcgactcagtggtggatcccctccgcgacttcgccaaggacagcgtccgcctcgtcaagcgctgccacaagcccgaccgcaaagagttcaccaaggtggccacgcgcacggcgatcgggttcgtcgtcatgggcttcgtcgggttcttcgtcaagctcatcttcatccccatcaacaacatcatcgtcgggtccggttaggctttgt

SEQ ID NO: 33589 - protein, 69 aa, Panicum virgatum
  misc_feature: Ceres CLONE 1952998
  misc_feature (10)..(66): Pfam Name: SecE Pfam Description: SecE/Sec61-gamma subunits of protein translocation complex
MDAIDSVVDPLRDFAKDSVRLVKRCHKPDRKEFTKVATRTAIGFVVMGFVGFFVKLIFIPINNIIVGSG

SEQ ID NO: 33590 - DNA, 1093 bp, Panicum virgatum
  misc_feature: Ceres CLONE 1953007
  misc_feature: Encodes the peptide sequence at SEQ ID NO. 33591
attaaagcgtgcgtccaagaacggcgctgcggctaggcgaccgcatccgcatctccaccccctcctcaccgctcgcgcacgaggcgaaggcagcgatggcgacggcgacggcggctggtggacccgacaggatggcggctccggcgacggcggccgggctcaccggcgctgttgccgcccagaggttgctgagcctgctggctcttgcgattcaagctgtaaacaatggagtggaaatattgaatgaagaccagagggcaatttacaagctacttggtagaactaaatctgaaaaagttcctgagaataaggatgctgggtcagatgatgatgatgatgacgacgatgaagacgaggatgatgaagggggtgatgacgatgatgatgctgaggagtactccggggatgaaggagatgacccgattgttgaggatgacgatgatgaggaagatgacgatgatgaggatgacaaggatgatgatgatgctgagggagttgatgctagtgggagatctaagcagagccgcagtgagaaaaagagcaggaaggccatgctgaagcttggcatgaaggcgatcactggtgtaagccgtgtaactgtcaagaagagcaagaatatgctctttgtcatctccaaaccagatgtcttcaagagccctgcatcagacacctacgtgatctttggggaggccaagattgaggacctgagctcacagctgcagacacaggctgcagagcagttcaaggcaccagacatgagcagcgtcctgtcaaagccagaggtctccacagcggcccaggatgacgatgaagctgtcgatgagactggtgtggaggagaaggacattgagttggtgatgacccaggctaccgtgtcgagggctagggcggtgaaggcgctgaaggcggccgatggggatatagttagtgcaatcatggagctgacaacttagctggtcgtgcgccgacttgtgatatcatgtcagttttatcttgtttaatggatctattatctgagacacatgttgtcacgttgtgctgttttgcatgttgtgtgattggaaacaaatggaaaacacatgttttgaaggct

SEQ ID NO: 33591 - protein, 285 aa, Panicum virgatum
  misc_feature: Ceres CLONE 1953007
  misc_feature (144)..(203): Pfam Name: NAC Pfam Description: NAC domain
  misc_feature (246)..(283): Pfam Name: UBA Pfam Description: UBA/TS-N domain
MATATAAGGPDRMAAPATAAGLTGAVAAQRLLSLLALAIQAVNNGVEILNEDQRAIYKLLGRTKSEKVPENKDAGSDDDDDDDDEDEDDEGGDDDDDAEEYSGDEGDDPIVEDDDDEEDDDDEDDKDDDDAEGVDASGRSKQSRSEKKSRKAMLKLGMKAITGVSRVTVKKSKNMLFVISKPDVFKSPASDTYVIFGEAKIEDLSSQLQTQAAEQFKAPDMSSVLSKPEVSTAAQDDDEAVDETGVEEKDIELVMTQATVSRARAVKALKAADGDIVSAIMELTT

SEQ ID NO: 33592 - DNA, 1009 bp, Panicum virgatum
  misc_feature: Ceres CLONE 1953020
  misc_feature: Encodes the peptide sequence at SEQ ID NO. 33593
ttgagttcctaaccgaatgtccgaaccctagcgtggcacggcaggagactcgcgaaagaaatccaatccaatccggcacgatttgatttttgctgatcctcgatctcatcgattcactcctgcctgagggcagacgcaggcagcttgacaaggaaaaggaagccttcaccatgggcaacaaagcacctttcttcctcttgatcctcttgttgctcgtcgccagggcacctgcacaagccagggatgctgaccacagccctgtctacaaggaacatgtccctgtccatctcaagagcagcagcccgctatgctctgcttgtgaaaacttagcgagtggagctgtcacttatctaagtgagaaacaaacacaagataagatcatggaattacttcatcatgcttgttctcagtcattctccttggaacagaagtgtgttgaattgatggactcctatgcaactctgctgtttgccaagatttcagagatcaagccagaagagttctgcaaacagtatggcctgtgcagggataccgcccttttctctggtgtgggaagtgacagcacttgtgtgttttgccaccacctgcttgatgaaattatgtccaaactgaaagatccagattcggagtttgagataattcaaattctcatcaaggagtgcaataagatcgaaggtcatgtccagcagtgcaagagattggtcctgcaatacattccctttatcatggtcaatggcgagaagttccttgagaagaatgatgtgtgcgcactcgtacaagcatgtccagccagtcaaaagaccgcaatcagctcattcttggacgagggattggtgagcgatgcatgaagattggaagattacaaaaacgcacagcgatggtgaaaatagtattccttgtacataaggcgataaaccaatggcttcagtattgtgcccgtgtattcttcgaaacccttatattgtgtatacaatgttttacgatagcaatctgttaatattctgggagc

SEQ ID NO: 33593 - protein, 225 aa, Panicum virgatum
  misc_feature: Ceres CLONE 1953020
  misc_feature (44)..(83): Pfam Name: SapB_1 Pfam Description: Saposin-like type B, region 1
  misc_feature (130)..(168): Pfam Name: SapB_1 Pfam Description: Saposin-like type B, region 1
  misc_feature (85)..(118): Pfam Name: SapB_2 Pfam Description: Saposin-like type B, region 2
  misc_feature (171)..(205): Pfam Name: SapB_2 Pfam Description: Saposin-like type B, region 2
MGNKAPFFLLILLLLVARAPAQARDADHSPVYKEHVPVHLKSSSPLCSACENLASGAVTYLSEKQTQDKIMELLHHACSQSFSLEQKCVELMDSYATLLFAKISEIKPEEFCKQYGLCRDTALFSGVGSDSTCVFCHHLLDEIMSKLKDPDSEFEIIQILIKECNKIEGHVQQCKRLVLQYIPFIMVNGEKFLEKNDVCALVQACPASQKTAISSFLDEGLVSDA

SEQ ID NO: 33594 - DNA, 1233 bp, Panicum virgatum
  misc_feature: Ceres CLONE 1953043
  misc_feature: Encodes the peptide sequence at SEQ ID NO. 33595
aaacactcgcactcgagaacgcacgcaggcgccgcccaaccaggcacccgcacgagcgccgccgccggcgacgagccgccgcccgccggcaaggaggagcgccttctgcaatctccgcaatagtgaatagcaaggagttaggagaaatggatatgcaagagaacacaacccccgctcatcatggaaagacaaagaaaaaagaaagtgcaaagaaaaaagagagagcaaggaagaggacatcatctgttttggattctactaatgacacagtcaatgaggaaatgccagagtatgatcttgatggacctactatcggcgaaaaactagctactctggatttgatcaatagagataatgaaaagaatgttactcaagagcaaacactatctatggtgccaccaagtgcagattcggtccatattttgctcaagcaagctctgcgtgctgatgataacgcatcattgctaacttgcttgtataatagagatgagaaggttattgcaaaatctatatcactcctaacaccatcagatgttgtgaagcttctcaagttcttcgtattgcaaatacaatctaggggcgcagtcttggtttgtttacttccctggctgcaaactttacttaatcggcacatgagcagcatagtgtcccaggaatcttctctgtccttgctcaactcactctaccagcttattgatgcaagaacatcaaccttcaagtcagcacttcaactctctaccactctagattatcttttcagtgagattgctgatgatgaagctgatgatggagaggtagagccacctatcatttatgaggacaaggacactgatgatgaagaatctgaagttgatgccatggaaaccgacggaaaagaggctgaagagcttggggatgttactgatgcctctgagcattcagatggaagtgagataatgagcgactgattgacttctaccctaggactgagctctcagatgttaatcctgatatggtggtattcacaaagcttatgatgactgcaagttctgtgatgatgtttatcatactgtgtcctagctggttgctatatctggatgcactttttgactcggcaagtggtaaaaactggatatagtatttgtaggagttttgatgatagttatgcttgtgtgttgcgaagcttcattgcatctattgctaaactgcatcatacattggctcggtaaagtttgccaccaaagtggatgcttt

SEQ ID NO: 33595 - protein, 266 aa, Panicum virgatum
  misc_feature: Ceres CLONE 1953043
  misc_feature (118)..(204): Pfam Name: NUC189 Pfam Description: NUC189 domain
MDMQENTTPAHHGKTKKKESAKKKERARKRTSSVLDSTNDTVNEEMPEYDLDGPTIGEKLATLDLINRDNEKNVTQEQTLSMVPPSADSVHILLKQALRADDNASLLTCLYNRDEKVIAKSISLLTPSDVVKLLKFFVLQIQSRGAVLVCLLPWLQTLLNRHMSSIVSQESSLSLLNSLYQLIDARTSTFKSALQLSTTLDYLFSEIADDEADDGEVEPPIIYEDKDTDDEESEVDAMETDGKEAEELGDVTDASEHSDGSEIMSD

SEQ ID NO: 33596 - DNA, 604 bp, Panicum virgatum
  misc_feature: Ceres CLONE 1953047
  misc_feature: Encodes the peptide sequence at SEQ ID NO. 33597
accttcaaacagatcatgaagctggtggtgctctccctgcagatccccaatcaccagatgatgggcctcctatgagtgaaccagcagcctgcagcaactgttactactaccgccaccggccagcactgggaaagaactcaagaagtcagcctccaattcgtacaccacctgcagtgagatccaagctcgctcggctgctaactccacccaaagctagctagctgatccaccatggacatgtcgccgaaccccgacagcccctcgtcgggagggggcaacggcggcggcatcgggtcgagcagcggcggcgcttcgccgtccgttggttcgatgacgccgcagtcgccgagccggtacgaggcgcagaagcggcgcgactggaacacgttcgggcagtacctgcggaaccaccggccgccgctgagcctggcgcagtgcagcggcgcccacgtgctcgagttcctccgctacctggaccaattcggcaagaccaaggtgcacggcgcggcgtgccccttcttcggccacccaaacccgccggcgccgtgcccctgcccgctccgccaggcctggggcagccctcgacgccctcgtgggccgcctc

SEQ ID NO: 33597 - protein, 124 aa, Panicum virgatum
  misc_feature: Ceres CLONE 1953047
  misc_feature: Functional homolog of the protein sequence given in SEQ ID NO 51087
  misc_feature: Useful for making plants with modulated low light sensitivity
  misc_feature: Functional homolog of the protein sequence given in SEQ ID NO 50806
  misc_feature: Useful for making plants with modulated nitrogen use efficiency
  misc_feature: Functional homolog of the protein sequence given in SEQ ID NO 50808
  misc_feature: Useful for making plants with modulated biomass
  misc_feature: Useful for making plants with modulated flowering time
MDMSPNPDSPSSGGGNGGGIGSSSGGASPSVGSMTPQSPSRYEAQKRRDWNTFGQYLRNHRPPLSLAQCSGAHVLEFLRYLDQFGKTKVHGAACPFFGHPNPPAPCPCPLRQAWGSPRRPRGPP

SEQ ID NO: 33598 - DNA, 623 bp, Panicum virgatum
  misc_feature: Ceres CLONE 1953047-R
  misc_feature: Encodes the peptide sequence at SEQ ID NO. 33599
ctctacctccgcgaggtccgcgagcaccaggcccgcgcccgcggcgtcagctacgagaagaagaagcgcaagaagccgcagcagctgctgcagggcgacggcagcggcggccttcacggccacccccaccagccgccgccgcctccgcccgccggcgccgcctgctgatgagctcgatcgatctggtcgaccgaaggcgcctcgatcgcccagcctcctatttggctggtatgatgccagattgagctcgagcatctacatatatattttatgtatcattcagatttcagagttcgcgtatgatgaatgcatgcatgcatgcctgcatgtgcatggcagtggcttccttcatgctgctgatccgtgcactctaccttgagaagcaccaccagtagtggccgggtgctgctgcctgcgtgtacttgcattgcttgtgtgtttaattaattcgattggctttagctctggtgttgtctattattagcttgtaggagtgagcaagtatttgctgtactttgaacaagaggagtgtatgtgccgtacgtcctctgaggtctagctagggacagggagatacatatatggagatctctcttgctgtttgtggaagagatttgaaagcc

SEQ ID NO: 33599 - protein, 55 aa, Panicum virgatum
  misc_feature: Ceres CLONE 1953047-R
  misc_feature: Functional homolog of the protein sequence given in SEQ ID NO 50808
  misc_feature: Useful for making plants with modulated biomass
  misc_feature: Useful for making plants with modulated flowering time
  misc_feature: Useful for making plants with modulated low light sensitivity
LYLREVREHQARARGVSYEKKKRKKPQQLLQGDGSGGLHGHPHQPPPPPPAGAAC

SEQ ID NO: 33600 - DNA, 625 bp, Panicum virgatum
  misc_feature: Ceres CLONE 1953050
  misc_feature: Encodes the peptide sequence at SEQ ID NO. 33601
ctccctctcttctctctcctccgcaagtgtgcacagtgccactgcgagctctccctccacctccccgatctggtcgcaccagtctccgtctccaccagcccttcccttcgcacgcacctccgaaaccctagacccgctcggcgagtagcgagttgcttcgccaccagccgccatggacccggccccggcggtcgctgcggagctctggcgcccgccgcacctcgccgcgggcggcggccgagctgtggaggccacctccgccgtcacggagaagagcagtggcggccgcggaggaggcagcgccggacggaggaggcagagggagaccccatcgtccgaggacgactcgtcccggaacgtctccacttccggcggcggcggtcaggatttgacagattcaggagcaaaacgtttcaaatcaaataaatccaatgataataatggcaacctaagaacggaggctgaaactgactcaagaagtgctggcaaggctgttagtaaaaactctcccgcaccagagccaccgaaacaagattacatccatgtcagggcaagaaggggccaagcaactgacagtcatagccttgcagaaagggcacggcgtgagaagataagcgaacggatg

SEQ ID NO: 33601 - protein, 150 aa, Panicum virgatum
  misc_feature: Ceres CLONE 1953050
  misc_feature: The sequence is a functional homolog of SEQ ID NO 1929 in the 10/374,780 US patent application
  misc_feature: The sequence is a functional homolog of SEQ ID NO 1930 in the 10/374,780 US patent application
MDPAPAVAAELWRPPHLAAGGGRAVEATSAVTEKSSGGRGGGSAGRRRQRETPSSEDDSSRNVSTSGGGGQDLTDSGAKRFKSNKSNDNNGNLRTEAETDSRSAGKAVSKNSPAPEPPKQDYIHVRARRGQATDSHSLAERARREKISER

SEQ ID NO: 33602 - DNA, 1262 bp, Panicum virgatum
  misc_feature: Ceres CLONE 1953054
  misc_feature: Encodes the peptide sequence at SEQ ID NO. 33603
acatgggcgctcattgtcatggggcatcttaggcctcggtcaagtcaacttctctttgtttacgcggttgctctcagatccatagacttcaagagggccatcagaaatggcgagccagcagagtcttgctcttgcgagtacattaccaaaagacctacccgtgacctttattaaggaaattaccaaagatttctctcctgaacaagagcttggccgatctgtttttggaacagtttataagggggttcttccagaagggggtggcatgattgctgtgaagaggcttgctgaaaatgcagcagtgccactcggcgtattatttgcatctgaggttacaaaccttatggcacttcagcacgaaaatatagtagagctggttcactactgccatgaagcgcagaagaaagtggttcagaataatggaagatatgtgattgtagacatgaccgaaagctgcctttgctacaaatatctacccaagggaagtcttgacaattatatttatgacactacgttaataatctgggacacgcgattcaaaataattaaggggatctgccagggtttacatttccttcacaaggaattgattagtggcccccttgttcatatgaatctcgcgcctaactcaatatggttggatgataactgggttccaaagattgctgattttggtctctctagactctttggcaaagagcagacccggatgtacacggtcaacgttaagggatataatgggtacatagccccggaatatctatacagaggtgaaatctccaccatgtccgacatatatagtttaggcatggttattcttgagatcacgactggagagaagaactgtgcagtttctcaagacagatctgcaagactgtttgtcgacaatgtacataaaaattggcagacagatgagcaaataataaacaagtacccatcactaaatcacaatggtctccagcaagtaagagcatgcattgtaattgggctgaagtgtgtggaggccgatcggaacagaaggccttccatagttgatattgttaataagctcaatggaaaacgtaccaatttttgattaggtctcccctttccagcatgcaagaaacatgatccttccaaggagaaattgatgtccaagatgaagtgaaacctactctatgagcagttgatgacatgaattctcttcagaactcagatcgttgttttataaattctcttttcctggaaacagcgtgacactgtattattgaagtacttttctc

SEQ ID NO: 33603 - protein, 322 aa, Panicum virgatum
  misc_feature: Ceres CLONE 1953054
  misc_feature (29)..(315): Pfam Name: Pkinase Pfam Description: Protein kinase domain
  misc_feature: SWISSPROT Homolog: EC 2.7.11.1 Non-specific serine/threonine protein kinase
MASQQSLALASTLPKDLPVTFIKEITKDFSPEQELGRSVFGTVYKGVLPEGGGMIAVKRLAENAAVPLGVLFASEVTNLMALQHENIVELVHYCHEAQKKVVQNNGRYVIVDMTESCLCYKYLPKGSLDNYIYDTTLIIWDTRFKIIKGICQGLHFLHKELISGPLVHMNLAPNSIWLDDNWVPKIADFGLSRLFGKEQTRMYTVNVKGYNGYIAPEYLYRGEISTMSDIYSLGMVILEITTGEKNCAVSQDRSARLFVDNVHKNWQTDEQIINKYPSLNHNGLQQVRACIVIGLKCVEADRNRRPSIVDIVNKLNGKRTNF

SEQ ID NO: 33604 - DNA, 544 bp, Panicum virgatum
  misc_feature: Ceres CLONE 1953058
  misc_feature: Encodes the peptide sequence at SEQ ID NO. 33605
ggccagtggtaatcaactgagcagagcagggcaaagcgaagaagggcttgcgttgccttgccttgcctatcagctagcttccccgcccaggacctggtctgagagcgcggccacgaccaccgggcagcctgcttccgtctcccctcgcgcgcgcctattttacgccgggcaccgggccctccaagatggagatggcgggggcggccgaggcggacacggcgacgcaggagccggagcgcacaggacggaccagctccttcctgctccccctcctccgcatcctcttcccctaccggctcttccgctacctccgcccgcgcctgccgggactgctcatttcccactagctcccattgcgatcacgtccgcctgggcggctgcactgcctcccgtccatggtgtacgccgtgtagtctttggatccgattttgtaccagcgacacaatcagatgacacttcttgggatctccttagacctgatgtgtttgctgccataatggatttttactcatcggcgcagccactttttctagactctcatgct

SEQ ID NO: 33605 - protein, 180 aa, Panicum virgatum
  misc_feature: Ceres CLONE 1953058
  misc_feature (97)..(172): Pfam Name: Nfu_N Pfam Description: Scaffold protein Nfu/NifU N terminal
ASGNQLSRAGQSEEGLALPCLAYQLASPPRTWSESAATTTGQPASVSPRARLFYAGHRALQDGDGGGGRGGHGDAGAGAHRTDQLLPAPPPPHPLPLPALPLPPPAPAGTAHFPLAPIAITSAWAAALPPVHGVRRVVFGSDFVPATQSDDTSWDLLRPDVFAAIMDFYSSAQPLFLDSH

SEQ ID NO: 33606 - DNA, 304 bp, Panicum virgatum
  misc_feature: Ceres CLONE 1953058-R
gaagctccctggtccctgcatactgcaacttccccaaagctaaatggactacggagtttgagctgggcagttggggaatggatccatgcgtttcgttcaacatccaggaacgtgtacagtcttcgcagagagagacgcatgcagggaactcatctgaaggtatactgggggctgttgtcagtggatgagcatgaccgctagattatgtttttgccgtgttttacctgaaaaatagaaatgtacaatcatagagtggaatgttctatttccagatgcatgtaacaatgtaacatgtctttttttc

SEQ ID NO: 33607 - DNA, 1130 bp, Panicum virgatum
  misc_feature: Ceres CLONE 1953061
  misc_feature: Encodes the peptide sequence at SEQ ID NO. 33608
acaacgccacgcatcaaggagatggccatggccatggcgaggcggaggcttctcgcgctcgcgtcccagctccagaggagggctccagcgccgccggcgacgcagccgtggcggcgagccaggccccggttcctctcctcagcggcgtccgcccccctcgaccgcctgaagacgccgcctttcgcgcgcccagcgcccaggaaccccgcctcctctccatgggatcgattcggaggagggcagaagaggaccatgttcatccagacgcaatccactccaaacccacagtcgctcatgttctatcccggaaagccagttatggaggtcgggagctctgatttcccaaatgctcggactgcgatgacatcccctttggctaaggcactgtttgcaatcgatggtgtaaccagggtattctttggatctgattttgtaactgttacaaaatcagaagaaacttcttgggattaccttaaacctgaggtttttgctgcgataatggatttttactcatctgggcaaccactttttctagactcaaatgctgcagctgctatggacacagcaattcatgaggatgattcagaaatagttgccatgataaaggaattgttggagactcgcattcggccagctgttcaagatgatggtggtgacattgaataccgaggatttgatctagaaacaggaatagttaagcttaaaatgcaaggtgcctgcagtggctgtccaagttcatcggttacattgaagtctgggatagaaaacatgcttatgcactatgtacctgaggtgaaaggagtagagcaggagcttgatggtgatgaggaagctgagctagctggagctgggcagatagagtgagtttttacagattttgcaagggtcaacacatcctcttcaaatgttagcaaactttgcgtgtatgatatgtttggggagtttcaaattcccaaaaggttattcatatgtttatttttccgaaaaagacttctgtgatgattagctgtcggtagcagtcttgatgtatgcaggaggcagactaccataggtagcggagaggcagcagttgtctgaactaacaacagttgcactaggatccaaataaaatgacactgtgaattgctttt

SEQ ID NO: 33608 - protein, 276 aa, Panicum virgatum
  misc_feature: Ceres CLONE 1953061
  misc_feature (76)..(162): Pfam Name: Nfu_N Pfam Description: Scaffold protein Nfu/NifU N terminal
  misc_feature (190)..(260): Pfam Name: NifU Pfam Description: NifU-like domain
MARRRLLALASQLQRRAPAPPATQPWRRARPRFLSSAASAPLDRLKTPPFARPAPRNPASSPWDRFGGGQKRTMFIQTQSTPNPQSLMFYPGKPVMEVGSSDFPNARTAMTSPLAKALFAIDGVTRVFFGSDFVTVTKSEETSWDYLKPEVFAAIMDFYSSGQPLFLDSNAAAAMDTAIHEDDSEIVAMIKELLETRIRPAVQDDGGDIEYRGFDLETGIVKLKMQGACSGCPSSSVTLKSGIENMLMHYVPEVKGVEQELDGDEEAELAGAGQIE

SEQ ID NO: 33609 - DNA, 390 bp, Panicum virgatum
  misc_feature: Ceres CLONE 1953089
  misc_feature: Encodes the peptide sequence at SEQ ID NO. 33610
cagaggagacgctttgccccccgcacgactcctcccaaagcctacctacccctcgccagcctcgcaatcgcaaatggtgctcgccaccaactccgcggccgccgccgcaacggccgtatccggcggcgcggcgtcccaaccgcgccgcgcgaccgcgttcctcccgatgaagaggcgcaccatctcggccatccacgccgccgacccggcgaagaacaacgggcctgccgaccccccggttgacgcaaccgaggactcgtccgcggcggtggcgactgccggataagaatcgggcggcgcaggggaagggggcgatcgacagctggaagtctaacagcgcggtgcagctccccgagtaccctaaccagcaggatctggacgccgagctct

SEQ ID NO: 33610 - protein, 70 aa, Panicum virgatum
  misc_feature: Ceres CLONE 1953089
  misc_feature: SWISSPROT Homolog: EC 2.5.1.54 3-deoxy-7-phosphoheptulonate synthase
MVLATNSAAAAATAVSGGAASQPRRATAFLPMKRRTISAIHAADPAKNNGPADPPVDATEDSSAAVATAG

SEQ ID NO: 33611 - DNA, 618 bp, Panicum virgatum
  misc_feature: Ceres CLONE 1953089-R
  misc_feature: Encodes the peptide sequence at SEQ ID NO. 33612
gtccgcaatgctggcctgattgtcacatggattactgatcctatgcatggaaacacaatcaaggccccttgtggtttgaagacacgtccatttgactctattctggctgaagtgcgtgcattcttcgacgtgcatgaccaagaagggagccacccaggaggtatccacctggagatgacagggcagaacgtgaccgagtgcattggtggatcacggaccgtgaccttcgatgacttgagcgaccgccaccacacccactgtgacccaaggctgaatgcctcccagtccgtggagcttgccttcatcattgccgagaggctcaggaagaggaggatgcggtcaggactcaacaacagtctgccgctgccaccactggctctctaaatggctgatgctgaatagagagggtaggaatagttgcgacgacttgaaagcggtggccgatgcctatttattcgttggagggtgctcttatcgttaagttacatgctcgtgagctataggtgtaaaactatgtttttgtttgatgctttgggtgtgagacttgccgacttagctgtttctgttgttttggccttggtaaggagaaaataaagagagaatgagattgcaacgctt

SEQ ID NO: 33612 - protein, 127 aa, Panicum virgatum
  misc_feature: Ceres CLONE 1953089-R
  misc_feature (1)..(104): Pfam Name: DAHP_synth_2 Pfam Description: Class-II DAHP synthetase family
  misc_feature: SWISSPROT Homolog: EC 2.5.1.54 3-deoxy-7-phosphoheptulonate synthase
VRNAGLIVTWITDPMHGNTIKAPCGLKTRPFDSILAEVRAFFDVHDQEGSHPGGIHLEMTGQNVTECIGGSRTVTFDDLSDRHHTHCDPRLNASQSVELAFIIAERLRKRRMRSGLNNSLPLPPLAL

SEQ ID NO: 33613 - DNA, 513 bp, Panicum virgatum
  misc_feature: Ceres CLONE 1953128
  misc_feature: Encodes the peptide sequence at SEQ ID NO. 33614
ggcgcatcttacgttgactatttcacaatgtcatccggggttcaagttgctgatggtgttgtttcgacttaccaagaattgaagcttggtcactctttaagatacgctttgttcaaattgaatgacaacaatactgagattgttgtagacaaaaccgctccaccaagcgccacctatgatgattttgtgaagaatttaccaagcaatgattgtagatatgctgtttttgattttgaataccaagaagatggtggacaaagaaacaagatcttgtttgttgtctgggctcctgattcagctaaaatcaaagcgaaaatgctttatgcttcctcaaaggacgcagtccgaaaaaagttggttggtgtcggcactgaaatccaagccactgatttgtctgaaattgatcgtgacacagtcatggataaagtcaagcgtgtatagacatcgcccttcactactttttctctgaattgaactgttgcaatactatttactaaaatgaaaaaaagttcg

SEQ ID NO: 33614 - protein, 137 aa, Panicum virgatum
  misc_feature: Ceres CLONE 1953128
  misc_feature (9)..(135): Pfam Name: Cofilin_ADF Pfam Description: Cofilin/tropomyosin-type actin-binding protein
MSSGVQVADGVVSTYQELKLGHSLRYALFKLNDNNTEIVVDKTAPPSATYDDFVKNLPSNDCRYAVFDFEYQEDGGQRNKILFVVWAPDSAKIKAKMLYASSKDAVRKKLVGVGTEIQATDLSEIDRDTVMDKVKRV

SEQ ID NO: 33615 - DNA, 1178 bp, Panicum virgatum
  misc_feature: Ceres CLONE 1953130
  misc_feature: Encodes the peptide sequence at SEQ ID NO. 33616
agtccgcctcatccgtgccgcagcgtctcctcccgcaagaaagaaagaaaaccccgcaagcgagacgccgccgcgcaatccatggattccgaactggaggaggcggtctgcaagctcgcgtggctcaacttcgcgtgcgcgaggggcgacctccactccggcgccgccctgctcgccgagctcaaggtgctcctcacaaggttacctagcttgccaccatcatttgagaagacgcctaatgcagttgaagagctgaaaatcgcaagggctatctatgagaatgctgttatcttgatcttgaaaattaaagaccgcgaggcatttgagaggagcttgtgccagctaaaagaattttacatcaatacatgcggtataattgctccatcaccagatgagtacccatttctgggccttaatcttctcaggctgttggccgagaacagaattgctgaattccatactgagctggaacttctgcccctggaagctttaagccatccttgtatcaaatatgcagtggagcttgagcaatcctttatggaaggtgcctataaccgattaatcaatgctcgccaggctgtgccacatgaggcatatgtttacctcatggaccttcttgctgaaactgttagagatgaagtagctgattgcagcgttgaggcctatgactacttaccaatcaatgttgcaaagaaaatgctaatgtttacatcagatcaagaacttctcgagtacatatgggaggaacaaccagaatgggaaatcaaggattgctcagtccattttgacatggcaaaacccaaatctcacatggacttgccatcgttcaagctggtcaagcaagctcttagctatgcgcgggagctggagaacattgtgtagcttgcaacgcaaagttgactccagatgtagacagccaaatgcaattgtctactggtaaaagtgcagtgcttagtggttaggcgcatcatattcaaaaaggatgcctaggtggaccttttgttccgttttgttgtttgaggcgacgattaagtggaattgacacttaaaatggccctgagtggggagtgctccggagtttcagaactttgtgatgtgttcgtgtcagtttaacatactgtgacaccttcagtacatttgtcctgtgagctattataaccattcgcaattttgatgcc

SEQ ID NO: 33616 - protein, 266 aa, Panicum virgatum
  misc_feature: Ceres CLONE 1953130
  misc_feature (24)..(209): Pfam Name: SAC3_GANP Pfam Description: SAC3/GANP/Nin1/mts3/eIF-3 p25 family
MDSELEEAVCKLAWLNFACARGDLHSGAALLAELKVLLTRLPSLPPSFEKTPNAVEELKIARAIYENAVILILKIKDREAFERSLCQLKEFYINTCGIIAPSPDEYPFLGLNLLRLLAENRIAEFHTELELLPLEALSHPCIKYAVELEQSFMEGAYNRLINARQAVPHEAYVYLMDLLAETVRDEVADCSVEAYDYLPINVAKKMLMFTSDQELLEYIWEEQPEWEIKDCSVHFDMAKPKSHMDLPSFKLVKQALSYARELENIV

SEQ ID NO: 33617 - DNA, 1075 bp, Panicum virgatum
  misc_feature: Ceres CLONE 1953135
  misc_feature: Encodes the peptide sequence at SEQ ID NO. 33618
atcccgaaaccccatcgcaactactccaatccccgaccccaaacccccaatccacccacacccccctcatccactccgggcggccatggcctgctccttcgccgccgccgccgccaccgtctcctccgcgcccacccacgccgccagggctctcgccgccgcgccgcagtccgtctccgtcgcccgctccgccaccgccaggcccctccgcctcgccgcctccagacccgcgcgggccatcaagctcgttgcccgcgccggcggcgtcgatgacttgccattggtcggtaacaaagcgccagacttccaggccgaagccgtgttcgaccaagagttcatcaacgtcaagctatctgactacattgggaagaaatacgtgattctgttcttctaccctttggacttcaccttcgtctgcccaamcgagattaccgccttcagcgacagatatgargaatttgagaagttgaacacagagatccttggtgtctccattgacagtgtgtwctcccaccttgcatgggtgcagacagacaggaagtctggtgggcttggagatcttaaatacccacttatttccgatgttaccaaatcaatttcaaagtccttcggtgttctgatccctgaccagggcattgctctgagaggactgttcatcatcgacaaggagggagtgattcagcactctaccattaacaaccttgccattggtcgcagtgtggatgagaccatgaggacccttcaggcgttgcagtacgtccaggagaacccggacgaggtctgcccggccggatggaagcctggggagaggtcgatgaagcccgaccccaagggaagcaaagagtacttcgcggccatctaggatgccctgccacagctttggtgctctgtatcatggtgcaccagcggtggatcgatgtggagtttttgcactgctgtgccgagctcgtgttttgacatatcagctgcgccttgcgatgaaccgattgtagtagctcctgtgcatcggattgaatgctgttccccgccaccttgtttcttctttttgacccgatgaataaggttcattttggtc

SEQ ID NO: 33618 - protein, 258 aa, Panicum virgatum
  misc_feature: Ceres CLONE 1953135
  misc_feature (67)..(201): Pfam Name: AhpC-TSA Pfam Description: AhpC/TSA family
  misc_feature: SWISSPROT Homolog: EC 1.11.1.15 Peroxiredoxin
  misc_feature (113)..(113): Xaa is any aa, unknown, or other
  misc_feature (141)..(141): Xaa is any aa, unknown, or other
MACSFAAAAATVSSAPTHAARALAAAPQSVSVARSATARPLRLAASRPARAIKLVARAGGVDDLPLVGNKAPDFQAEAVFDQEFINVKLSDYIGKKYVILFFYPLDFTFVCPXEITAFSDRYEEFEKLNTEILGVSIDSVXSHLAWVQTDRKSGGLGDLKYPLISDVTKSISKSFGVLIPDQGIALRGLFIIDKEGVIQHSTINNLAIGRSVDETMRTLQALQYVQENPDEVCPAGWKPGERSMKPDPKGSKEYFAAI

SEQ ID NO: 33619 - DNA, 703 bp, Panicum virgatum
  misc_feature: Ceres CLONE 1953157
  misc_feature: Encodes the peptide sequence at SEQ ID NO. 33620
actcatcagtgctcactctccagctctcagcaaacactgcaagcgagagctagctaccaaagacaaggacacaatgccacccttacccaagagacccgggcctctccttgtcctcctcgttgtcgcattcgcggccgccactgccgccgccgccgcctccgacgccgccggcgcgaccgtccccttctacccctccgcggaggccgccgcggccgcgcactgcgacggcacgctctaccctgacgtctgcctgtccacgctggccgacatcccggacctgcacaagaagcccctcccggacgtcatctgcgccgccgtgaaccgcaccgaggacgtcgtggcggccaccgcctccaactgctcctcctacctccgggagaggtccctgaccgcgcgcgaccgcctcgccctcagcgactgcctggagctcctgtccaccagcatggacgagctccaggccacggtcgcggacctggagtcccccgccgccaccggcggcggtggctcggcgtcgtcgtcgtccgcggtgggcgccaggcgcgtgacgatggaccacgtgatgacggtgctctcggcggccatcacgaaccagtacacctgcctggacgggttcgcgtaccagaacggcgggcgcgtgcggcgctacatcgagccgacgctccaccacgtctcccgcatggtgagcaactcgctcgccatggcg

SEQ ID NO: 33620 - protein, 209 aa, Panicum virgatum
  misc_feature: Ceres CLONE 1953157
  misc_feature (40)..(209): Pfam Name: PMEI Pfam Description: Plant invertase/pectin methylesterase inhibitor
  misc_feature: SWISSPROT Homolog: EC 3.1.1.11 Pectinesterase
  misc_feature: Functional homolog of the protein sequence given in SEQ ID NO 51361
  misc_feature: Useful for making plants with altered carbohydrate content
MPPLPKRPGPLLVLLVVAFAAATAAAAASDAAGATVPFYPSAEAAAAAHCDGTLYPDVCLSTLADIPDLHKKPLPDVICAAVNRTEDVVAATASNCSSYLRERSLTARDRLALSDCLELLSTSMDELQATVADLESPAATGGGGSASSSSAVGARRVTMDHVMTVLSAAITNQYTCLDGFAYQNGGRVRRYIEPTLHHVSRMVSNSLAM

SEQ ID NO: 33621 - DNA, 491 bp, Panicum virgatum
  misc_feature: Ceres CLONE 1953157-R
  misc_feature: Encodes the peptide sequence at SEQ ID NO. 33622
gcgcggcatccgttcatggggtacgggcagatggtgaaggggttcccgcggtgggtgcggcccggggaccggcggctgctgcaggcgccggcgtcgggcatcgcggcggacgcggtggtggcccaggacgggagcgggaactacacgacggtgtcggcggccgtggcggcggcgccgaccaactcgaagcggcggtacgtgatttacatcaaggccggggcgtacatggagaacgtggaggtcgggaagaagcacgtcaacctgatgttcatcggcgacggcatcgggaagacggtcatcaaggccagccgcaacgttgttgacggctccaccaccttccgctccgccacagtcgtggatcattacttcggagccgttcatcactgcgaagtacagtaacaaacagttcgaattgacaagcaccgctggtgttcggtaaacgatggatcccccccccccctccaaaaaaagtgtaactttcgctttcccag

SEQ ID NO: 33622 - protein, 132 aa, Panicum virgatum
  misc_feature: Ceres CLONE 1953157-R
  misc_feature (37)..(132): Pfam Name: Pectinesterase Pfam Description: Pectinesterase
  misc_feature: SWISSPROT Homolog: EC 3.1.1.11 Pectinesterase
  misc_feature: Functional homolog of the protein sequence given in SEQ ID NO 50796
  misc_feature: Useful for making plants with altered carbohydrate content
  misc_feature: Functional homolog of the protein sequence given in SEQ ID NO 51440
  misc_feature: Useful for making plants with altered cell wall content and/or composition
ARHPFMGYGQMVKGFPRWVRPGDRRLLQAPASGIAADAVVAQDGSGNYTTVSAAVAAAPTNSKRRYVIYIKAGAYMENVEVGKKHVNLMFIGDGIGKTVIKASRNVVDGSTTFRSATVVDHYFGAVHHCEVQ

SEQ ID NO: 33623 - DNA, 668 bp, Panicum virgatum
  misc_feature: Ceres CLONE 1953160
  misc_feature: Encodes the peptide sequence at SEQ ID NO. 33624
aaggcggacacaccagctccccgcacccgcagtgccaccagccttccacttcctgcagctgccatggctgccactcccgtgtccatgccccgcatcaagctgggctcgcagggactggaggtctcggcgcagggcctcggctgcatgggcatgtcggccttctacggcccgcccaagcccgagcccgacatggtcaagcttatccaccatgccgtcgctgccggggtcaccttcctcgacacctccgacgtctacggcccgcacaccaacgagatcctcctcggcaaggcgcttcaaggtggggtacgggagaaggtcgagctggccaccaagttcggcgcctcctttgccgacgggaaatgggagatccgtggcgacccagctttcgtgcgggcggcgtgcgagagcagcctcaagcggctcggcgtcgactgcatcgacctctattaccagcaccgcgttgacaagagggtgcccatcgaggtcacgattggtgaactcaagaagctagtggaagaaggaaagataaagtacataggattatccgaagcatctgcatccacaatccgaagagctcatgcaatccatcctatcactgcagtacagcttgaatggtcattatggtctagagatgtagaagaagatataattcccacttgcagagaact

SEQ ID NO: 33624 - protein, 201 aa, Panicum virgatum
  misc_feature: Ceres CLONE 1953160
  misc_feature (14)..(201): Pfam Name: Aldo_ket_red Pfam Description: Aldo/keto reductase family
  misc_feature: SWISSPROT Homolog: EC 1.1.1.65 Pyridoxine 4-dehydrogenase
MAATPVSMPRIKLGSQGLEVSAQGLGCMGMSAFYGPPKPEPDMVKLIHHAVAAGVTFLDTSDVYGPHTNEILLGKALQGGVREKVELATKFGASFADGKWEIRGDPAFVRAACESSLKRLGVDCIDLYYQHRVDKRVPIEVTIGELKKLVEEGKIKYIGLSEASASTIRRAHAIHPITAVQLEWSLWSRDVEEDIIPTCRE

SEQ ID NO: 33625 - DNA, 641 bp, Panicum virgatum
  misc_feature: Ceres CLONE 1953160-R
  misc_feature: Encodes the peptide sequence at SEQ ID NO. 33626
tgtggcttacagtccactaggcagaggtttcttctctagtggagcaaaactagttgactcactatctgagcaggactcccgcaagaatatgcctagatttcaaccagagaatcttgagaagaatgctcagatattcgagcgtgtgaatgcaatggcagcacgaaaaggatgcacaccatcgcaactcgcattggcttgggttcaccaccaaggaagcgaagtttgccccatacctggcacaacaaaaattgagaactttaaccaaaatgtcaaggcactgtctgtgaagcttacaccagatgagatggctgaactcgagtcgtacgctgcggcaggtgaagtcttgggtgaccggtatgctcaagtggcctacacttggaaggactttgagaccttgccattatcttcatggaaaattgagtagccaatctggtattttcaaccgtgtcctccgcccattgccgtatctccaagttgtgcagaggatgcccaggtccactttgcgagttttgatgtttggtacaaaatgcgtattgcatgcctcattttgtatatttatgcttaaaggttaaaaccgctgatgcgatgaataactatgtgcattgtataaagatgtcaaagagtatttaccaagagtagcg

SEQ ID NO: 33626 - protein, 140 aa, Panicum virgatum
  misc_feature: Ceres CLONE 1953160-R
  misc_feature: SWISSPROT Homolog: EC 1.1.1.65 Pyridoxine 4-dehydrogenase
VAYSPLGRGFFSSGAKLVDSLSEQDSRKNMPRFQPENLEKNAQIFERVNAMAARKGCTPSQLALAWVHHQGSEVCPIPGTTKIENFNQNVKALSVKLTPDEMAELESYAAAGEVLGDRYAQVAYTWKDFETLPLSSWKIE

SEQ ID NO: 33627 - DNA, 610 bp, Panicum virgatum
  misc_feature: Ceres CLONE 1953162
  misc_feature: Encodes the peptide sequence at SEQ ID NO. 33628
gcaccggccctcctctaccggccctcactccctcgccgccggccgcctcgccgtttggatcacctcctacctcggtgaagatgagagagatcttgcacatccagggtgggcaatgtggcaaccagattggtgccaagttctgggaggtggtgtgcgatgagcacggcattgaccctaccgggcggtacactggcaactctgacctgcagttggagcgtgtcaatgtctactacaatgaggcctcctgtggccgctttgtgccccgtgctgttctcatggaccttgagcctgggacaatggacagtgtccgcactggaccctatgggcagatcttccgccctgacaactttgtgtttgggcaatctggagctggtaacaactgggctaagggccattacactgaaggtgctgagctcatcgactctgttctggatgttgtgaggaaggaagctgagaactgtgactgcttgcaaggattccaagtatgccactctcttggtggtggtactggatctggtatgggtacactgttgatctcaaagatcagggaggagtaccctgaccgcatgatgctgacgttctcagttttcccctcaccgaaagtatcaga

SEQ ID NO: 33628 - protein, 176 aa, Panicum virgatum
  misc_feature: Ceres CLONE 1953162
  misc_feature (45)..(176): Pfam Name: Tubulin Pfam Description: Tubulin/FtsZ family, GTPase domain
  misc_feature: Functional homolog of the protein sequence given in SEQ ID NO 50258
  misc_feature: Useful for making plants with modulated flowering time
MREILHIQGGQCGNQIGAKFWEVVCDEHGIDPTGRYTGNSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVS

SEQ ID NO: 33629 - DNA, 651 bp, Panicum virgatum
  misc_feature: Ceres CLONE 1953162-R
  misc_feature: Encodes the peptide sequence at SEQ ID NO. 33630
ccccgagctcacacagcagatgtgggatgccaagaacatgatgtgtgccgccgaccctcgccatgggcgttacctcactgcctcagccatgttccgtgggaagatgagcaccagggaggttgatgagcagatgatcaatgtccagaacaagaactcatcctacttcgtggagtggatccccaacaacgtgaagtccagcgtgtgtgacatcccgccgaggggcctgtccatggcgtccaccttcatcggcaactcgacctccatccaggagatgttccggagggtgagcgagcagttcacggccatgttcaggaggaaggctttcttgcactggtacacaggcgagggcatggacgagatggagttcactgaggctgagagcaacatgaacgacctggtgtcggagtaccagcagtaccaggacgcgaccgcagacgaggagggtgagtatgaggacgaggaggagatgcaccccgaggacatgtgagacctgatacccatgaggcttggtggttctacccttctagagctggcagatttcgatgggttgcgttccttccgtgttgttgccatgttgctactgttagcgtaccatcctccgtcgttgttgatgcttgtattttccttgtgctatggaatcttgcttttggt

SEQ ID NO: 33630 - protein, 161 aa, Panicum virgatum
  misc_feature: Ceres CLONE 1953162-R
  misc_feature (1)..(97): Pfam Name: Tubulin_C Pfam Description: Tubulin/FtsZ family, C-terminal domain
  misc_feature: Functional homolog of the protein sequence given in SEQ ID NO 50258
  misc_feature: Useful for making plants with modulated flowering time
PELTQQMWDAKNMMCAADPRHGRYLTASAMFRGKMSTREVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADEEGEYEDEEEMHPEDM

SEQ ID NO: 33631 - DNA, 553 bp, Panicum virgatum
  misc_feature: Ceres CLONE 1953167
  misc_feature: Encodes the peptide sequence at SEQ ID NO. 33632
ccatctcatcgatcgagccagccagccatccatccatccatccagccgcctctcctcgcctgctgcgcgcgtctctctgctctcctagggagatctcgcgcagcccggaaacccgtcgacccagctcgtcctcgtcgcagatggccggcctcaggatgaagttcgtcgccgccgccgccgtggccgccgcgctcgtggcgttcgccgccgccgccatcgaggcccccgccccggcgcccgcctccgacgccgccgccgcggtgcccctcgcggcggcgtccctcgccgccgccgccttcggctacctcttctgctagaaccatcggccgttccccgtgggtcctgctgatatgatgattcgttttggcgtgagtcgagtccgtgtccgtggcgtgtcgggaggatgtcggtgggcgtgtgtatgtacgagttcggcggcggtgggggcgtgcgtcgacgcgccgttctctgtggcgtcgatcatgtactcactccgtttctggttattgatgagatcatttatttgattctttccatcttattattacatacg

SEQ ID NO: 33632 - protein, 58 aa, Panicum virgatum
  misc_feature: Ceres CLONE 1953167
  misc_feature: Functional homolog of the protein sequence given in SEQ ID NO 50631
  misc_feature: Useful for making plants with altered carbohydrate content
  misc_feature: Functional homolog of the protein sequence given in SEQ ID NO 50546
  misc_feature: Useful for making plants with altered cell wall content and/or composition
MAGLRMKFVAAAAVAAALVAFAAAAIEAPAPAPASDAAAAVPLAAASLAAAAFGYLFC

SEQ ID NO: 33633 - DNA, 532 bp, Panicum virgatum
  misc_feature: Ceres CLONE 1953183-R
  misc_feature: Encodes the peptide sequence at SEQ ID NO. 33634
gtcgagcagcagtacttcaccgacaccaccaccctcttcatcatsgagytcatcctcatsggctgggccgagggccgccgytgggccgacatcatcaagcccgggagsgtcaacaccgaccccatcttccccaacaacaagctcaccggcaccgacgtcgggtaccctggtggcctgtggtttgacccgctcggctggggcagcggctcgccggagaagatcaaggagctgcgcaccaaggagatcaagaacggccgcctcgccatgctcgccgtcatgggcgcctggttccaggccgagtacaccggcaccggccccatcgacaacctcttcgcccacctcgccgaccccggccacgccaccatcttccaggccttcacccccaaatgaggagttggagttagcgatttgagattgcgaccaagcatgcatgggggtggagattgttaggttgatggtcgatcgatgcgacttttttctgtttgtggggcggaagactgtccatgcatgatgattgaatggtttgtggagc

SEQ ID NO: 33634 - protein, 129 aa, Panicum virgatum
  misc_feature: Ceres CLONE 1953183-R
  misc_feature (1)..(100): Pfam Name: Chloroa_b-bind Pfam Description: Chlorophyll A-B binding protein
  misc_feature: Functional homolog of the protein sequence given in SEQ ID NO 50113
  misc_feature: Useful for making plants with modulated oxidative stress sensitivity
  misc_feature (15)..(15): Xaa is any aa, unknown, or other
  misc_feature (17)..(17): Xaa is any aa, unknown, or other
  misc_feature (20)..(20): Xaa is any aa, unknown, or other
  misc_feature (36)..(36): Xaa is any aa, unknown, or other
VEQQYFTDTTTLFIXEXILXGWAEGRRWADIIKPGXVNTDPIFPNNKLTGTDVGYPGGLWFDPLGWGSGSPEKIKELRTKEIKNGRLAMLAVMGAWFQAEYTGTGPIDNLFAHLADPGHATIFQAFTPK

SEQ ID NO: 33635 - DNA, 646 bp, Panicum virgatum
  misc_feature: Ceres CLONE 1953183
atgattttaggatatgcacaggtaggcaccagcagtaggcagccattgggatggaaggtccaaggcaatgacgtgggcctttcttccttccccaactatataagccaacaagatgcgctcgcctgaccacaccacggcagcagcagagatgcagatccggcgatagcggcggcgggagccctggtgctcgggttacccaccctccgtgcctctgttcatccatccgggaaaaataatccgggatgatgaacaagccgaggggtggccaggagaagcgcaggggaggaggagggggactcggcagggtgctgaggaagcaggtggccaggctctgcatcatccgggagtgcgtcatcatgctcctcttctaccatgactgatccactgatgcgtttgcggttcctcctggccattgactactttgattggttctatcggttggttccttgatgtacccatgtacattgggtccttcagatatgtatctgtaccatctttaacttttctgggtttgttgttactttctactcctaagtccgacaatggcaaggatgtaccgcgaaatgttggcatgtatctttttgtgtgtttgctctatgagaaatgcaaaacagaaaacttgtgtcctacctttttggctttctcg

SEQ ID NO: 33636 - DNA, 1199 bp, Panicum virgatum
  misc_feature: Ceres CLONE 1953209
  misc_feature: Encodes the peptide sequence at SEQ ID NO. 33637
aaaacacggtcagaagccagcgccaatttacggtttcgcccgccgaccggccacagcgacgcgcctctcgctcctcgctttctcccctctctgtgccccgccctcttctccggcgaggcaatcagccctgcccgcgtgaagcacacgcgccgatccggggaggggcatccgatccgatccgttccccgtgcccgcggcgccgatggagaaggtgaagaacctgctgaagccgcggccgactccgcaacgagtgccgcgtcctcgaccgccagatccgagatgtgcagagggaggagaagaatgtggagaaagccatcagggaggctgccaagcgcaacgacatgggatctgcaaaggcacttgctaaggaacttgtgcgatcaagacgtgctgttaatcgtctttatgaaaacaaggcccagctgaactcagtatcgatgcacctcggagaaattgttgcaactgcaagaacagtgggccatctgtccaagagtgctgaagtgatgaaaattgttaataatctaatgaaagctccagagttggctgccactatgcaagaatttagcaaagaaatgacgaaggctggtgtgatggaagagatggtgaatgaagctgttgattcagctttggactctgaggacatggaagaggaaattgaggaggaggtcgacaaggttcttgcttcggtagcaggggagactgcatcccagctaccagatgctgccaggacacagaagatacagcaagcttcaacaagcaaggttccagaagagcgacaagctgttgctgagggtgttgatgacgacgaggaagacctagaagagatcagggcccggcttgccaaagtgaggtcgtaaaccatgcatccccgaggcatctaacttccagagtccatgatctaggcagccaaaccgttgtatgtcaaattgggttgatgaatggtgatggttgtttccctcttgaccccgcaaggtattgttgtacagtaagcaatgtgatgtgaacagcgacttcttgttgctgatttggtctgagattgaagatttagcacagaaaaaaactgaataatggtttgtctactcttcagtatgtcacgttctcacgtgtacagataccatcggaaacacagcaacgagctgccaagcttcggtacccagcattttgttcagagaaagttgtgatatgctattaactggcat

SEQ ID NO: 33637 - protein, 171 aa, Panicum virgatum
  misc_feature: Ceres CLONE 1953209
  misc_feature (1)..(132): Pfam Name: Snf7 Pfam Description: Snf7
MGSAKALAKELVRSRRAVNRLYENKAQLNSVSMHLGEIVATARTVGHLSKSAEVMKIVNNLMKAPELAATMQEFSKEMTKAGVMEEMVNEAVDSALDSEDMEEEIEEEVDKVLASVAGETASQLPDAARTQKIQQASTSKVPEERQAVAEGVDDDEEDLEEIRARLAKVRS

SEQ ID NO: 33638 - DNA, 1188 bp, Panicum virgatum
  misc_feature: Ceres CLONE 1953224
  misc_feature: Encodes the peptide sequence at SEQ ID NO. 33639
atcacacccaagtcccaaccacattctaacagagtcacagagcagagcgtcgcagcagcaagagcagtgatccgatcgacatggccgccgccgccgccaccatggccctgacctcccgcgcgctctccggcaagccggcggccagcgccagggacgtcttcggcgagggccgcatcacgatgcgcaagaccgcggcgaagcccaagccggcggcggcggccggcagcccctggtacgggcccgaccgcgtgctgtacctgggcccgctctccggcgagcccccgagttatctgaccggcgagttccccggcgactacgggtgggacaccgcgggtctgtccgccgacccggagaccttcgccaagaaccgcgagctggaggtgatccactgccggtgggcgatgctgggcgcgctggggtgcgtgttcccggagctcctcgcccgcaacggcgtcaagttcggcgaggcggtgtggttcaaggcggggtcgcagatcttcagcgagggcgggctggactacctgggcaacccgagcctggtgcacgcgcagagcatcctggccatctgggcgtgccaggtggtgctcatgggcgccgtcgaggggtaccgcgtcgccggcggcccactcggggaggtggtggacccgctgtacccgggcggtagcttcgacccgctggggcttgccgacgacccggaggcgttcgcggagctcaaggtgaaggagatcaagaacggccgcctcgccatgttctccatgttcggcttcttcgtgcaggccatcgtcaccggcaagggcccgctcgagaacctcgccgaccacctcgccgaccccgtcaacaacaacgcctgggcctacgccaccaacttcgtccccggcaagtgagcgagcgagctcgatcgctgtgtgaattgaagctagcgacccggccgggggggttcgcgcgtgtaccgtagacgtacgtattcgtatgtactgctacgtactgcagggtgcacgagtatctgcgatgaagagaacctgggatcgcacaggtttgttgtacaagtagcagtgtatttgtacccatgcatgcgctggacggatcaatgaaatacgcgcgccgcgttgtaaatttgtagcaaaataatttgtaataaaatatttttatctttatctatttttataaaaaacggaccgtttctgcggt

SEQ ID NO: 33639 - protein, 267 aa, Panicum virgatum
  misc_feature: Ceres CLONE 1953224
  misc_feature (66)..(234): Pfam Name: Chloroa_b-bind Pfam Description: Chlorophyll A-B binding protein
MAAAAATMALTSRALSGKPAASARDVFGEGRITMRKTAAKPKPAAAAGSPWYGPDRVLYLGPLSGEPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEVVDPLYPGGSFDPLGLADDPEAFAELKVKEIKNGRLAMFSMFGFFVQAIVTGKGPLENLADHLADPVNNNAWAYATNFVPGK

SEQ ID NO: 33640 - DNA, 1302 bp, Panicum virgatum
  misc_feature: Ceres CLONE 1953226
  misc_feature: Encodes the peptide sequence at SEQ ID NO. 33641
gcgaccccaggtcagacgggatcacccgctgagtttaagcatataaataagcggaggagaagaaacttacaaggattcccctagtaacggcgagcgaaccgggagcaaaccatgggttgggaagagcttagcatgggaaaagacccagcaatcaaggcatttgaacaaggtcttctgtatgtccgttcaacaagcaagcaaaagcaaagttgctgttaaacctgttgaattggagaatgcaaaggagccaccactcaacttatacaaaccaaaggaaccttacacagccacgattgtctcagttgagaggattgtaggccctaaagcccctggtgaaacatgtcacattgttattgaccatggtggcaatgttccatactgggaaggacagagttatggtgtcattcctccgggagagaatccgaagaaacctgggtccccaaatactgttaggctctattctattgcttctactaggtatggtgattcttttgatggaaagacagcaagcttatgtgttcgccgtgctgtttactatgatcctgaaactggaaaggaagacccctcagagaaaggtatctgcagtaacttcctgtgtgactcaaaaccagggggacaagttcagatcacaggcccctcggggcaaattatgcttcttgcggaggatgatccaaatgcaactcatatcatgattgccactggcactggtgttgctccttaccgtggctacctacgtcgtatgttcatggaagatgtctcaacttacaaatttggtggtctggcatggctcttccttggtgttgctaactctgacagccttctctatgatgaagagttcactaactaccttcagcagtatccagacaatttcaggtatgacaaagcactaagcagggagcagaagaacaagaacggtggcaagatgtacgtgcaggacaagattgaggagtacagcgatgaaatcttcaagctcctggacggcggagcgcacatctacttctgtggtttgaaggggatgatgccggggatccaggacacgctcaagagggtggccgagcagagaggagagagctgggaccagaagctgtcgcagctgaaaaagaacaagcagtggcacgtagaggtttactaggttgtgaaaatgccacagattatgattgtttcacgacaatgtgagaaactggacatataattgaacgattcttgttgcaatgtaaaattgtgggttttgttcataagcttttgctccaaatgttgaataaattgaagcacatgcttttgagttggtgttactatttattg

SEQ ID NO: 33641 - protein, 317 aa, Panicum virgatum
  misc_feature: Ceres CLONE 1953226
  misc_feature (170)..(286): Pfam Name: NAD_binding_1 Pfam Description: Oxidoreductase NAD-binding domain
  misc_feature: SWISSPROT Homolog: EC 1.18.1.2 Ferredoxin--NADP(+) reductase
MSVQQASKSKVAVKPVELENAKEPPLNLYKPKEPYTATIVSVERIVGPKAPGETCHIVIDHGGNVPYWEGQSYGVIPPGENPKKPGSPNTVRLYSIASTRYGDSFDGKTASLCVRRAVYYDPETGKEDPSEKGICSNFLCDSKPGGQVQITGPSGQIMLLAEDDPNATHIMIATGTGVAPYRGYLRRMFMEDVSTYKFGGLAWLFLGVANSDSLLYDEEFTNYLQQYPDNFRYDKALSREQKNKNGGKMYVQDKIEEYSDEIFKLLDGGAHIYFCGLKGMMPGIQDTLKRVAEQRGESWDQKLSQLKKNKQWHVEVY

SEQ ID NO: 33642 - DNA, 1225 bp, Panicum virgatum
  misc_feature: Ceres CLONE 1953232
  misc_feature: Encodes the peptide sequence at SEQ ID NO. 33643
gtcgcgtacagctggacgcctcctcctctccctccctccctcggtccctccccatcgctgtcggctgctgcttgcttcgcccgccccccctcctggaccccaccacaccctcgcctcctcctcggcgacggagggccaggggatcccagagagcgcggcggcggcggcggcggaggaggaggaggagggtgagcatggcggcggcgccgtcgaggtcccgaggcgactacgaccacctaatcaagctcctgctcatcggcgacagcggagttgggaagagttgcttgctcctgcggttttctgatgacacattcacaacaagttttatcaccaccattggcattgatttcaaggttaggacagttgagcttgatggaaagcgtgtaaaattacaaatctgggatactgctggtcaagaacgtttccggacaatcaccactgcttactatagaggagctatgggcattctgcttgtgtatgatgtcacagacaaatcatccttcaataacattagaaattggattcgcaacatagagcagcatgcatcagacaatgtgaacaacatcttggtgggcaacaaggttgatatggatgcaaaacgggtagtgtccacagctcaaggtcagaagctcgcagatgaatatggtatcaaattctttgagacgagtgcaaaaacaaatcaaaatgtggagcaggtcttctttaccatggcaagggacataaagcaacggctgactgagaccgttgccgctgcggctgagcccccaactattcatatcagcaggccagatcccgaccagcccaaccctgcctcgcggtggtcatcctgctgtaacacctgatcgacacggcggtgaaatcgcacagcgccttgtgtttacttctggtgccaaagccaaagatgtaaattccgcccggtcggtatctagtgcgaactaaagactagcaatactctgaccactgtgggtgtcgtgattcttcagcgaggtgttccggcgttcctgcttttaagttatcgccttgttgtagcccggtggtggctcgtgctaatgtatgcttgcttggggattggactcttcttgccctgtagcctccagatctgccggccggaacaaacgtttcggcagatctgctcttgtcttgtaaaaaacaaaaccttggagagacagcagtatctgatagtatgggatcgtccgtgattgtacattagcgcattgtactatcc

SEQ ID NO: 33643 - protein, 215 aa, Panicum virgatum
  misc_feature: Ceres CLONE 1953232
  misc_feature (17)..(178): Pfam Name: Ras Pfam Description: Ras family
  misc_feature (17)..(131): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 51218
  misc_feature: Useful for making plants with altered lignin content
  misc_feature: Functional homolog of the protein sequence given in SEQ ID NO 50522
  misc_feature: Useful for making plants with modulated oxidative stress sensitivity
MAAAPSRSRGDYDHLIKLLLIGDSGVGKSCLLLRFSDDTFTTSFITTIGIDFKVRTVELDGKRVKLQIWDTAGQERFRTITTAYYRGAMGILLVYDVTDKSSFNNIRNWIRNIEQHASDNVNNILVGNKVDMDAKRVVSTAQGQKLADEYGIKFFETSAKTNQNVEQVFFTMARDIKQRLTETVAAAAEPPTIHISRPDPDQPNPASRWSSCCNT

SEQ ID NO: 33644 - DNA, 1410 bp, Panicum virgatum
  misc_feature: Ceres CLONE 1953240
  misc_feature: Encodes the peptide sequence at SEQ ID NO. 33645
accacgccgccgctcaatttcgaaactcccgaccgttgcttctccatctcccctcctcacccacccccgcgccgctcgccaccggctaccccgtcgccacgccggagagggagagggatggcgtcgagagacgcggcggacagccccagatccgcgccgcgtcgccccgggacggcggcggctgaagcggcgcccaaggacggcgccggcctgctcagcccacggttccggtcggccgccgcgatggccgggtgggacgaggagtccgtcctcctcgcggctctcgtcgtcgaggacacacccgtccgcgagtcccgccgcaagaggcgggcctccaccacttcatcatccgccggcggtagcggcggatccagcacgaggaagaggaggtcccgtaggcagttgccgagcaggatcccggcggtggctctcgcactcgacgacgaaaacgacgataagccgggcgctgccgcagatggcaagttgaaagtgaaggatgcaaaggaagggaaagagaaggctgttgttgtgggtgagaaggaggcatccggatctggcgagaaggcagcggcggcgggcaacctgccgtgtatggatcggctccgggaggagctctcttgcgcgatttgcctggagatctgcttcgagcccagcaccacaccctgtggtcacagcttctgcatgaaatgcttaaaacatgctgcagccaagtgcggaaaacggtgtcctaaatgcaggcaattaatcagcaattcaagatcgtgcaccatcaatactgtactctggaacaccattcagctcttgtttcccagtgaaattgaggcaagaaggactttggtcgcatcaccttcatcatgcaatgaggatgtgaaccatagcccaccaggaagtaataatttttcacaaggtagccatggcatgagaacaaggagcagcagtggtagcttcatcacagaaggcaggacaagaagcagctacaggaacaccagtgggaatttcatcaacgcacatggcagcacaagaagcagtcacagcaggacagccttcatcccagcttcacgactggtcaatacaaggactgctgtaagatcagatcaatctgaagatgccgcattggcttacaggttgcagcaggaggagttcatgaatgcctttgaggagcctgagcaggagaggcagccatggaacaccgtgtccacagcccgagataatttgagagcaatggcctctcgcgccattcgccttcgtgctcgaggctggcctgtttagtgttcttttgcttactgcttgtcttcggttcattgatagctctcccttcttcgagttaactttgcaggaatcttttgtttgttattgtattgtaatgttgagtggcatgatcaaattgccactcaataatgattgtccatt

SEQ ID NO: 33645 - protein, 383 aa, Panicum virgatum
  misc_feature: Ceres CLONE 1953240
  misc_feature (168)..(206): Pfam Name: zf-C3HC4 Pfam Description: Zinc finger, C3HC4 type (RING finger)
MASRDAADSPRSAPRRPGTAAAEAAPKDGAGLLSPRFRSAAAMAGWDEESVLLAALVVEDTPVRESRRKRRASTTSSSAGGSGGSSTRKRRSRRQLPSRIPAVALALDDENDDKPGAAADGKLKVKDAKEGKEKAVVVGEKEASGSGEKAAAAGNLPCMDRLREELSCAICLEICFEPSTTPCGHSFCMKCLKHAAAKCGKRCPKCRQLISNSRSCTINTVLWNTIQLLFPSEIEARRTLVASPSSCNEDVNHSPPGSNNFSQGSHGMRTRSSSGSFITEGRTRSSYRNTSGNFINAHGSTRSSHSRTAFIPASRLVNTRTAVRSDQSEDAALAYRLQQEEFMNAFEEPEQERQPWNTVSTARDNLRAMASRAIRLRARGWPV

SEQ ID NO: 33646 - DNA, 587 bp, Panicum virgatum
  misc_feature: Ceres CLONE 1953262
  misc_feature: Encodes the peptide sequence at SEQ ID NO. 33647
agcgttagcgttcctcccgtgtccgccttcccgagctgcactgcgccgcctcgccctctccacctcctccggcgagaatcgctcacctccggcgaggtccctcgattccgggtgtgcggggaagtgtgccggcaagctcccagcctcccctccaccccttcctgcgagctctcccgtcccgaagcggagtggaatgggcctgtggacattgctggagggttttttgcttctcgcaaatgcgttggcaatactgaacgaagatcgttttcttgctcccagaggatggagcatgtctgaagtgtcaggaaatgggcaaacaaagtcattgaagggccagatcgtggggcttatctacgccacgcaatttctgagggtgcccttgatagcccttaatgttcttatcattgttgtgaagttggtgtcaggctgagcctcgctttctggttttgtctgttagttggatcgatatcagtagcattatgtaaaagttaattatacacaaagttgctggagacatgttcatgttgcctccaatgtgtatttctgttattgttctggtaaggtaattcttgtccgaaaatggtttg

SEQ ID NO: 33647 - protein, 78 aa, Panicum virgatum
  misc_feature: Ceres CLONE 1953262
  misc_feature (3)..(78): Pfam Name: Yos1 Pfam Description: Yos1-like
MGLWTLLEGFLLLANALAILNEDRFLAPRGWSMSEVSGNGQTKSLKGQIVGLIYATQFLRVPLIALNVLIIVVKLVSG

SEQ ID NO: 33648 - DNA, 1237 bp, Panicum virgatum
  misc_feature: Ceres CLONE 1953278
  misc_feature: Encodes the peptide sequence at SEQ ID NO. 33649
atgttctccgttatgcttccaggtcatttagtgtatacctttgaaattagagctgcaaaggaccaggacaaaaataatgtgaagattgtactagatatcgagaatgcaaagtgcagcatatgcttgaatttgtggcatgatgttgttactgttgctccctgcctccataacttctgcaatggatgtttctcagagtggttaagaaggtcttcatctaaatcgcatgataaaagccagagcgctgcatgcccccaatgtaggacggcagttcaatcagttggaaggaatcacttcctgcataatattgaagaggctatattacaagcgttttcatcgctacaaaggtctgatgaggagattgcattgctagagtcgtatgcttcagtaaaatctaatattgttttggggaaacagaaaaatcaatcaagaaaacggcctttttcacgttcaagtgatgaaatcaacaatgcagatctgccatgtcctcaatgccgtaccgaatttggtggatttcgatgcagtccaggagctgcgcacttgcaatgcaatggatgtggagggatgatgccagccagatctgacgtcaatataccacagaaatgttcggggtgtgataaagcattttgtgggtcttattggtgttcacaaggagtggattcaagccattgtaatctaatctgcagccaggaaactttcaagatgatctctcagcgccatgtctccagacttcttgacacagttcatgggggcaacccatatgaaaaagatattacagaaaaatgcatacaacagtcaggcaaaacattgcaagctgtaatctctgagtggatatcaaaatttgacaacatggaaattgaccgctcaaggttgcaattgaataatgtggatgcaattacgtccaggacctatatttgcaaccattgctacaagttcattgatttcctgctgtactggtaccgcgtttcaatgccccgaaatctttttccacctgatgctgtcaacagggagagctgctggtacggtttcatgtgccgcacccagcaccatcggcctgaccatgcgaagaagctgaaccacgtctgccgccctacaagaggcaacccctagccgtttcacctcgttctttaaaggtcatctcccggtgatggccgcattgtacagcaattctgcagaactactgacggttcagcacatgtaaacatattagcggtgatcatgtgaaactatttctatcatc

SEQ ID NO: 33649 - protein, 364 aa, Panicum virgatum
  misc_feature: Ceres CLONE 1953278
  misc_feature (34)..(82): Pfam Name: zf-C3HC4 Pfam Description: Zinc finger, C3HC4 type (RING finger)
MLPGHLVYTFEIRAAKDQDKNNVKIVLDIENAKCSICLNLWHDVVTVAPCLHNFCNGCFSEWLRRSSSKSHDKSQSAACPQCRTAVQSVGRNHFLHNIEEAILQAFSSLQRSDEEIALLESYASVKSNIVLGKQKNQSRKRPFSRSSDEINNADLPCPQCRTEFGGFRCSPGAAHLQCNGCGGMMPARSDVNIPQKCSGCDKAFCGSYWCSQGVDSSHCNLICSQETFKMISQRHVSRLLDTVHGGNPYEKDITEKCIQQSGKTLQAVISEWISKFDNMEIDRSRLQLNNVDAITSRTYICNHCYKFIDFLLYWYRVSMPRNLFPPDAVNRESCWYGFMCRTQHHRPDHAKKLNHVCRPTRGNP

SEQ ID NO: 33650 - DNA, 584 bp, Panicum virgatum
  misc_feature: Ceres CLONE 1953287-R
  misc_feature: Encodes the peptide sequence at SEQ ID NO. 33651
attcgccacagttgttggtcctgctcttactggccctcatttgttgaccctgtggctttgggtggtgttgagggtattggagacagttgaagctcacagcggctaccacttcccatggagcccctcaaatttcctgccactgtatggaggctcggacttccatgactaccatcaccgtgtgctctacaccaagtcagggaactatgcctcgacttttgtgtacatggactggttgtttgggacggacaaggattaccgcaaggcgaaggccatggaggagaaggaagggaacaaggatatgtagatcgatcatgcatgggagctgcgaataatgaagacaggcggagctagcaatacgtactgtctgtgtactacaatcgtacgtacgtaatccttggggtttgccgtttgcgttcctgctttgtttaatttggccgggatcggatgtatatatacatttggatcggagctagctagtagcaagatggtcgatgaggttgatgtgaccttagtttgcttgtgtgatgaattaacaataatgtcagcaattaaataaagccacaactatagccggcctgttcagc

SEQ ID NO: 33651 - protein, 100 aa, Panicum virgatum
  misc_feature: Ceres CLONE 1953287-R
  misc_feature: SWISSPROT Homolog: EC 1.14.13.72 Methylsterol monooxygenase
  misc_feature: Functional homolog of the protein sequence given in SEQ ID NO 51441
  misc_feature: Useful for making plants with altered sterol content
  misc_feature: Functional homolog of the protein sequence given in SEQ ID NO 51442
  misc_feature: Useful for making plants with modulated cold sensitivity
FATVVGPALTGPHLLTLWLWVVLRVLETVEAHSGYHFPWSPSNFLPLYGGSDFHDYHHRVLYTKSGNYASTFVYMDWLFGTDKDYRKAKAMEEKEGNKDM

SEQ ID NO: 33652 - DNA, 1462 bp, Panicum virgatum
  misc_feature: Ceres CLONE 1953287
tcacctcacctgctgctgtgtttaatttgtggtgaatgtttgcttttctccgtcaaggaaatactcctgtatgtatttcctagtatgtagtgagtcaccagtggtgtatgtatttagtactgtatatataggacactaagtaagactcaaaagggagataatataatgtcgagagaggcaggcaactaaccagtttttctttccttttacctgtctgtctgtctgtcaaggatccgtaaccgctttccttccccatccatagtggtaatggtaatcgatggatcctcgcaaattaattaagcacaggctagaaagatgatgacagcgatagatcagatgcttcttgttgttttggcttctagtatggcccaaaacaagactaggcaacctctcgctttcttcttctttcatcctcccacgccaccattctgggctccagatcctgctgatgtcgctacagtatccaaataaaaaagaaggcaagtatgacaagaattgaccatcttagaattgtcactatggcaaggtcaccaccttcggcactgctatattatattgctccttcaccttgcattagtattttatcgtgccagctcttcacagatctaatttggctttccctaatacatacagtagttgccattgagctcattgttccctaagaaaatgactgccacccaccatggattgactctttttgcatatctttaggataaaagaaaaaacaattgctgtgcctattttctgcttcattcatgctacctacttctcttttaattcactctagaatgcgatgcctgcatccccctgtgaaatagaacactcctgctaaggattttgtcccctgtttctagtgtagttcaagtaaaaagtggctgatggtccttttccctctccctctttttatggtgatacaatattattttgtcttactgaccttaagcaattaaatgagcacctacctatacttatattgctactatatctatctatctatctatctatctagacaaaaaaatgtgtgcatctttaatttgcagaagaagagcaacacctctgcttatcaaaacagatgtgtcctgcgtctcatactctaccatgtctgtgtgaacttgcctgtcatcattttctcctaccctgccttcaaattcatgggccttaggagctctcttcctctgccacactggtatcggttcgcttccttccttgtccttctactgagcccacgttatatattatatcatgcaaagatctagcttaactggaagaaaaatgtttgagacgatgctagctgtattgttttctgcaggacggttgttgtatctcaagttgcattctactttgtactggaggattttgtattctactgggggcaccgggcactgcacaccaaatggctgtacaagcatgtccacagcgtccaccacgaatatgctacacccttttgggttaaattctgaat

SEQ ID NO: 33653 - DNA, 1239 bp, Panicum virgatum
  misc_feature: Ceres CLONE 1953288
  misc_feature: Encodes the peptide sequence at SEQ ID NO. 33654
acgcggccacgccccctcccttccccagttgaagcaaagcagagccctaccggtctcccacctccccagatcggcgatccccggaggcagcggcgatggcgtcgtcgcaggccaacctcgagaagatgcatctccgccagagctaccgcaacctctggcacaccgacatcatgggcaccatgagggccgacttcccctactgctgcctcgcgctgtggtgtggaccatgcgtgtcatacatgctccgcaaaagggctctctataatgacatgtcaagatacgtctgctgtgctggatatatgccatgcagtggaaggtgtggtgaaagtcggtgcccagagttttgtcttgcaactgaggtgtttctttgctttggcaattcagttgcgtcaacccgtttcttgctgcaagatgaattcaacatacagacaactcagtgcgacaactgcatcattggcttcatggtctgccttcaacaagttgcttgcatcttctctatagttgcagctattgttgggagtgaggagctttcagaggcttcccagatccttaactgcatgtctgatttggtctactggacggtatgcgcatgtatgcagacacaacacaaaatcgaaatggacaagagggatgggaagtttggcccacagcccatggcagtgcctccagtgcaacaaatgtcacgcatcgatcagcctaccccgcctcccgccggatacgcaccacaaccagcctacggtcagccttatggtagctatccacctccagatcaaggttatcccccagctggttacccccagggtggtgcataccctccgcctgcccaaggttatccccagggtggtgcctacccaccgcctggttacccaccacaaggttcctacccccccgccgcaaggttcctaccccccacagggttacccggccaagtaaagcacacacgtcaattggagagacccctttgccaggcacctgaaatattgtggacatgtaaacagtaggactgcggtagcgtaataggtgatttcgaaacaccacgtgcgatttgtctgcgtggtaaacaatgaacggtatattgattctctggtgaactcatcagtgacatgtgttgagcgtactgtgttgagtatactcttcaaataaggagtggtgaattgtgcaagtcattcggaaaattaatctgtaactgaatttggtgattacattattcctggagattgttggtcgtatgttttggac

SEQ ID NO: 33654 - protein, 301 aa, Panicum virgatum
  misc_feature: Ceres CLONE 1953288
  misc_feature (21)..(145): Pfam Name: PLAC8 Pfam Description: PLAC8 family
MASSQANLEKMHLRQSYRNLWHTDIMGTMRADFPYCCLALWCGPCVSYMLRKRALYNDMSRYVCCAGYMPCSGRCGESRCPEFCLATEVFLCFGNSVASTRFLLQDEFNIQTTQCDNCIIGFMVCLQQVACIFSIVAAIVGSEELSEASQILNCMSDLVYWTVCACMQTQHKIEMDKRDGKFGPQPMAVPPVQQMSRIDQPTPPPAGYAPQPAYGQPYGSYPPPDQGYPPAGYPQGGAYPPPAQGYPQGGAYPPPGYPPQGSYPPAARFLPPTGLPGQVKHTRQLERPLCQAPEILWTCKQ

SEQ ID NO: 33655 - DNA, 689 bp, Panicum virgatum
  misc_feature: Ceres CLONE 1953291
  misc_feature: Encodes the peptide sequence at SEQ ID NO. 33656
gtctcaatccgcaccacctcctctccctcttccccttcctcctccttcccagcctctgctcgtgccgccgccggccatggcctgcctcaccgacctcgtcaacctcaacctctccgacaccacggagaagatcatcgccgagtacatatggatcggtggatctggcatggatctcaggagcaaggccaggaccctctccggcccggtgacggatcccagcaagctgcccaagtggaactacgacggctccagcaccggccaggcccccggcgaggacagcgaggtcatcctgtacccgcaggctatcttcaaagacccattcaggaagggcaacaacattctcgtcatgtgcgattgctacaccccagctggcgagccaattcccaccaacaagaggcacagcgccgccaagatcttcagcaaccctgaggttgccgctgaggagccctggtatggtattgagcaggagtacaccctccttcagaaggacaccaactggccccttgggtggcctgttggtggcttccctggccctcagggtccttattactgcggtatcggcgctgacaagtctttcgggcgcgacatagttgactcccactacaaggcttgcctgtatgctggcatcaacatcagtggcatcaacggggaggtcatgccaggacaggtgaaatactaccacacttccc

SEQ ID NO: 33656 - protein, 204 aa, Panicum virgatum
  misc_feature: Ceres CLONE 1953291
  misc_feature (17)..(97): Pfam Name: Gln-synt_N Pfam Description: Glutamine synthetase, beta-Grasp domain
  misc_feature: SWISSPROT Homolog: EC 6.3.1.2 Glutamate--ammonia ligase
  misc_feature: Functional homolog of the protein sequence given in SEQ ID NO 50222
  misc_feature: Useful for making plants with modulated water use efficiency
MACLTDLVNLNLSDTTEKIIAEYIWIGGSGMDLRSKARTLSGPVTDPSKLPKWNYDGSSTGQAPGEDSEVILYPQAIFKDPFRKGNNILVMCDCYTPAGEPIPTNKRHSAAKIFSNPEVAAEEPWYGIEQEYTLLQKDTNWPLGWPVGGFPGPQGPYYCGIGADKSFGRDIVDSHYKACLYAGINISGINGEVMPGQVKYYHTS

SEQ ID NO: 33657 - DNA, 656 bp, Panicum virgatum
  misc_feature: Ceres CLONE 1953291-R
  misc_feature: Encodes the peptide sequence at SEQ ID NO. 33658
gaattacagcaccaagtccatgaggaacgagggtgggtacgaggtgatcaaggccgcgatcgagaagctgaagctgcggcacaaggagcacatcgccgcctacggcgagggcaacgagcgccggctgaccggcaagcacgagaccgccgacatcaacaccttcagctggggagtcgccaaccgtggcgcgtcggtgcgcgtgggccgggagacggagcagaacggcaagggctacttcgaggatcgccggccggcgtccaacatggacccctacgtggtgacctccatgatcgccgagaccaccatcatctggaagccctgaagcgtccccgcccaaactccccccagctccccgtctcgtctcggtcggtccggcggccgccatggctgcctccggcgaccgcattgagctgggcgcggaaattgtccaattaatccgttccgttccattccattctgtccgattatacgctgctgctgcggctgccgctgctgctaccactactgcatttagttagatctgtgaaagggttgtgcgaaaacaaaacaaaaacattgtttgctttgatgctttgcacttccatgggtatcacttgtgtaatcctctcctccaataatggccgtaccgcagcggtggtaccatccgtacttgcatc

SEQ ID NO: 33658 - protein, 106 aa, Panicum virgatum
  misc_feature: Ceres CLONE 1953291-R
  misc_feature: SWISSPROT Homolog: EC 6.3.1.2 Glutamate--ammonia ligase
  misc_feature: Functional homolog of the protein sequence given in SEQ ID NO 50222
  misc_feature: Useful for making plants with modulated water use efficiency
NYSTKSMRNEGGYEVIKAAIEKLKLRHKEHIAAYGEGNERRLTGKHETADINTFSWGVANRGASVRVGRETEQNGKGYFEDRRPASNMDPYVVTSMIAETTIIWKP

SEQ ID NO: 33659 - DNA, 1241 bp, Panicum virgatum
  misc_feature: Ceres CLONE 1953293
  misc_feature: Encodes the peptide sequence at SEQ ID NO. 33660
accgacaaacctaccagcgacctttatgaaggaaattaccaccgattttgcttctgagcgagaatttggccgctctgtatttggaatagtttacaagggtgttcttccagagacagaagggaaccgcatgattgctgtgaagaggcttgctgagaactcaccagtgccggctggcaaaacatttgaaactgaggttacaaatcttatggcatttaaacacagaaatgtagtagagctggttagcttctgccacgaagcacagaagaaagtagttcagcatagtgggagatatgtgatcgtagacgtgatcgaaagctgtctttgctacaaatatctgccgaagggaagtcttgacaagcatctttatgcggacactacgtcaataacctgggacacacgactcaaaataattaaagggatctgccaaggtttacatttccttcacaaggaattggatgggccccttgttcatatgaaccttgtgcccagctcaatatggttggatgataactgggtgccaaagattgctgattttggtctctcaagactctttggccaagagcagaccaggatgtacacagtcaatgttaagggatataatgggtacatggctccagaatatctatacagaggtgaaatctccaccatgtcagacatatatagtttaggcatgcttattcttgagatcacgactggagagaagaactgtggatattctgaagacagatctgcaagaaactttgttaccaatgtacatcaaaattggaaaacgaatgagcaaataatacacaagtacccatcactagatccaaatggcctccagcaagtaaatgcatgcattgtaattgggctgaagtgtgtggaggctgatcggaacaaaaggccttccatagttgatattgttgataagctcaatgggaaacgtgtaccaatttttgaccaggcctccacttcccaggagcgatgagacgtggtcttttgaaggagagatcaatatccaagatgaagtagaacctgctctatgatcagaagatgacatgaattttcttcagaacaaatatctacttttttaaaaaaaatattggctcttccttgcaacaacgtaactgccactttacttatctttctaattagatttggcactgtattgttgaagcactgttctctctgttgacctcttttagagtagaatttctgttcctccgcggcattaaaatatttgttctttttctggaaagcat

SEQ ID NO: 33660 - protein, 321 aa, Panicum virgatum
  misc_feature: Ceres CLONE 1953293
  misc_feature (16)..(304): Pfam Name: Pkinase_Tyr Pfam Description: Protein tyrosine kinase
  misc_feature: SWISSPROT Homolog: EC 2.7.11.1 Non-specific serine/threonine protein kinase
PTNLPATFMKEITTDFASEREFGRSVFGIVYKGVLPETEGNRMIAVKRLAENSPVPAGKTFETEVTNLMAFKHRNVVELVSFCHEAQKKVVQHSGRYVIVDVIESCLCYKYLPKGSLDKHLYADTTSITWDTRLKIIKGICQGLHFLHKELDGPLVHMNLVPSSIWLDDNWVPKIADFGLSRLFGQEQTRMYTVNVKGYNGYMAPEYLYRGEISTMSDIYSLGMLILEITTGEKNCGYSEDRSARNFVTNVHQNWKTNEQIIHKYPSLDPNGLQQVNACIVIGLKCVEADRNKRPSIVDIVDKLNGKRVPIFDQASTSQER

SEQ ID NO: 33661 - DNA, 615 bp, Panicum virgatum
  misc_feature: Ceres CLONE 1953301
  misc_feature: Encodes the peptide sequence at SEQ ID NO. 33662
tgcggatgctcaaaatcaccaccatggatgacttggtcaaaaattcaatgaacattctggaaccatcacccgtggatgctagtggcaacgatcgtgaagatgtattgtcagcctcttcccctgttgacctttttctattgcctggacaagcgtttgacagaactggtcgaagactgggacgtggtggagggtactatgacacattcttgctgaaataccaagaacttgcaaaagagaaagggtggaatcagcccctcttagttgctctttcatactcggtgcaaattatggaggaaggtctcatcccagtcaactcaactgatatccctattgatgctctggtctcatcttctggtattattccaataagccctgcagcgctggagaggatgtaatgaagctgattggtttcttgttatgctttgacaacatgccctctttcagtattttgtgttccctggttgccctaatgatactgataaatcagcggataagggaatctgtcctctttcttgtggctttctgctgtatcattttataataatatagacacttgatttctattccttatttcagctgattaatgtaaattctccttttgaacagtcagttgac

SEQ ID NO: 33662 - protein, 130 aa, Panicum virgatum
  misc_feature: Ceres CLONE 1953301
  misc_feature (1)..(116): Pfam Name: 5-FTHF_cyc-lig Pfam Description: 5-formyltetrahydrofolate cyclo-ligase family
  misc_feature: SWISSPROT Homolog: EC 6.3.3.2 5-formyltetrahydrofolate cyclo-ligase
RMLKITTMDDLVKNSMNILEPSPVDASGNDREDVLSASSPVDLFLLPGQAFDRTGRRLGRGGGYYDTFLLKYQELAKEKGWNQPLLVALSYSVQIMEEGLIPVNSTDIPIDALVSSSGIIPISPAALERM

SEQ ID NO: 33663 - DNA, 663 bp, Panicum virgatum
  misc_feature: Ceres CLONE 1953305
  misc_feature: Encodes the peptide sequence at SEQ ID NO. 33664
agatccactagtgcgcagcgcagggcgcgccatggcgagcgccagcgccacctccagcctcctcgtcccggcgacccctgccgcctcaacgccccctgcatgcccatcgtcgtcgacttccagccggaagccaccgtgaagcgcgtccgccgcccggcgcacctcctcgaccgggagcacaaggagaagtaccgggaggccgtcggcaagatgcgggcgctgccggcgacccacccgctgagcttcgcggcgcaggcggccgtccacgaggcctactgcgacgggcactaccggtacgacccggcggagaagaaccggcccttcgacgtgcacttctcctggatcttcgcgccgtggcaccgcatgtacatctacttctacgagaaggccctcgggcagctcatcggcgacgacaccttcgcgctgcccttctggaactgggacgcgccggcgggcatggggatcccggccatcttcaaggacgacgactccttcgccaacccgctctacgacccctaccgcgaccagacccaccgcgacgccctcatcgacctcgactacatccactcccccaaagacgtgccccccatcctcttcgtgcgcacgccggcgaccgccgcagcctacgatgaggccgtgcagaagaacctctgcaccatatac

SEQ ID NO: 33664 - protein, 187 aa, Panicum virgatum
  misc_feature: Ceres CLONE 1953305
  misc_feature (3)..(187): Pfam Name: Tyrosinase Pfam Description: Common central domain of tyrosinase
  misc_feature: SWISSPROT Homolog: EC 1.10.3.1 Catechol oxidase
MPIVVDFQPEATVKRVRRPAHLLDREHKEKYREAVGKMRALPATHPLSFAAQAAVHEAYCDGHYRYDPAEKNRPFDVHFSWIFAPWHRMYIYFYEKALGQLIGDDTFALPFWNWDAPAGMGIPAIFKDDDSFANPLYDPYRDQTHRDALIDLDYIHSPKDVPPILFVRTPATAAAYDEAVQKNLCTI

SEQ ID NO: 33665 - DNA, 585 bp, Panicum virgatum
  misc_feature: Ceres CLONE 1953305-R
  misc_feature: Encodes the peptide sequence at SEQ ID NO. 33666
gctctcccccggcggcagcaagaagggtgggttgtcgtcgagcagggcggccgcggcgccgccggagttcccggtgaccctgcgcggcggcgaccaggccgtggcggtgccgggcgtggccgtgccggcgagggaggcggggaaggagctggtgctggtggtggagggcatcgagtacgacccccggacgagcaacaagttcgacgtggccatcaacgtggccggggaggacgccctcaaggtgggcccgcagtgcagcgagtacgcgggcagcttctccgccgtgccgagctccaaggcggacggcgggacgctgctcgggaaggtcagcctttttgtcgacggcgtgctggccgacctcggactcggagcgggcggcaacgccaccgtcgacgtcgtgctcgtgccgcgcacggcgggggaggtgaaggtcttccttccgccgacgatccagaatgcgtgacatgtcgtcaccggtgtccgcaaaaataaatcgccttgtagtagtttgctcgtgacatttgtattatatactaggcaattatgtccgtgcattgctacaaacaaaattggtataagtattgg

SEQ ID NO: 33666 - protein, 153 aa, Panicum virgatum
  misc_feature: Ceres CLONE 1953305-R
  misc_feature: SWISSPROT Homolog: EC 1.10.3.1 Catechol oxidase
LSPGGSKKGGLSSSRAAAAPPEFPVTLRGGDQAVAVPGVAVPAREAGKELVLVVEGIEYDPRTSNKFDVAINVAGEDALKVGPQCSEYAGSFSAVPSSKADGGTLLGKVSLFVDGVLADLGLGAGGNATVDVVLVPRTAGEVKVFLPPTIQNA

SEQ ID NO: 33667 - DNA, 1256 bp, Panicum virgatum
  misc_feature: Ceres CLONE 1953311
  misc_feature: Encodes the peptide sequence at SEQ ID NO. 33668
aggttaaagcgacgccgccgccgcaagccgtccgccttgcccttctgcttccctgaaggcttggtcctcctccttgtatctccgcccccacagatccgccgcggcgtctagctagggttaggtttcctctgccgcgatggcgatcaagcggaccaaggcggagaagaagcaggcgtacgaccgcaagctgtgcagcctgctcgatgagtacaccaaggtgctcatcgccctcgccgacaacgtgggctccaagcagctccaggacatccgccgcgggctgaggggcgactccgtggtgctcatggggaagaacacgctcatcaggcgctgcatcaaggcctacgccgacaagactgggaaccacaccttcgacccgctcatggacctcctcgtcggcaacgtcggcctcatcttcaccaagggagacctcaaggaggtccgcgaggaggtggccaagtacaaggttggtgctcctgctcgtgttgggctggttgctccagttgatgtcgttgtcccccctggcaacactggtctggatccctcccagacctctttcttccaggtgctcaacatccccaccaagattaacaagggtaccgtggaaattattacccctgtggagctgatcaagaagggtgacaaagtgggctcatctgagtctgctcttctcgccaagctgggtatccgccctttctcatatggtctccagatcaccaatgtctatgaggatgggtcagtcttcagccctgaggttctcgacctgactgaggaagaccttattgagaagtttgccactggtgtctccatggttgcctctctgtccttggcgctctcgtaccccacccttgctgctgcgccccacatgttcatcaatgggtacaagaatgtgcttgctgttgctgtggagacggactactcgtacccgcatgctgacaagatcaaggagtacctcaaggacccaagcaaatttgctattgctgccccagttgctgccgcagactctggtgctgcagctgctcccaaggaagaagagaagaaggcggaagagcctgctgaggagtcggatgatgacatgggtttcagcctgtttgactagagttgctcagatcgtcaagaagctgcaagttttggcatttgtttatgaaacacctaaagtactgtttaccttattatttagcctatcggatgaagagaactatgttgttactagtgtaactgacaatggtattttgtgttaaagcatttgtgatgtctct

SEQ ID NO: 33668 - protein, 319 aa, Panicum virgatum
  misc_feature: Ceres CLONE 1953311
  misc_feature: SWISSPROT Homolog: EC 4.2.99.18 DNA-(apurinic or apyrimidinic site) lyase
MAIKRTKAEKKQAYDRKLCSLLDEYTKVLIALADNVGSKQLQDIRRGLRGDSVVLMGKNTLIRRCIKAYADKTGNHTFDPLMDLLVGNVGLIFTKGDLKEVREEVAKYKVGAPARVGLVAPVDVVVPPGNTGLDPSQTSFFQVLNIPTKINKGTVEIITPVELIKKGDKVGSSESALLAKLGIRPFSYGLQITNVYEDGSVFSPEVLDLTEEDLIEKFATGVSMVASLSLALSYPTLAAAPHMFINGYKNVLAVAVETDYSYPHADKIKEYLKDPSKFAIAAPVAAADSGAAAAPKEEEKKAEEPAEESDDDMGFSLFD

SEQ ID NO: 33669 - DNA, 1214 bp, Panicum virgatum
  misc_feature: Ceres CLONE 1953321
  misc_feature: Encodes the peptide sequence at SEQ ID NO. 33670
gcactcgagaacgcacgcaggcgccgcccaaccaggcacccgcacgagcgccgccgcccgccggcaaggaggagcgccttctgcaatctccgcaatagtgaatagcaaggagttaggagaaatggatatgcaagagaacacaacccccactcatcatggaaagacaaagaaaaaggaaagtgcaatgaaaaaagagagagcaaggaagaggacatcatctgttttggattctactaatgacacagtcaatgaggaaatgccagagtatgatcttgatggacctactatcggcgaaaaactagctactctggatttgatcaatagagataatgaaaagaatgttactcaagagcaaacactatctatggtgccaccgagtgcagattcggtccatattttgctcaagcaagctctgcgtgctgatgataacgcatcattgctaacttgcttgtataatagagatgagaaggttattgcaaaatctatatcactcctaacaccagcagatgttgtgaagctcctcaagttcttcgtattgcaaatacaatctaggggcgcagtcttggtttgtttacttccctggctgcaaactttacttaatcggcacatgagcagcatagtgtcccaggratcttctctgtccttgctgaactcactgtaccagcttattgatgcaagaacatcaaccttcaagtcagcacttcaactctctaccactctagattatcttttcagtgagattgctgatgatgaagctgatgatggagaggtagagccacctatcatttatgaggacaaggacactgatgatgaagaatctgaagttgatgccatggaaacggacggagaagaggctgaagagcttggggatgttactgatgcctctgagcattcagatggaagtgagataatgagcgactgattgacttctaccctaggactgagctctcagatgtcaatcctgatatggtggtattcacaaagcttatgatgactgcaagttctgtgatgatggtttatcatactgtgtcctagctggtcactacatctggatgcacttgttaagtcggcaagtggtaaaaactggatatagtatttgtaggagttttgatgatagttatgcttgtgtgttgcgaagcttcattgcatctattgctaaactgcatcatacattggctcggtaaagtttgccacccgaagtgtatgctttcttt

SEQ ID NO: 33670 - protein, 266 aa, Panicum virgatum
  misc_feature: Ceres CLONE 1953321
  misc_feature (118)..(204): Pfam Name: NUC189 Pfam Description: NUC189 domain
  misc_feature (170)..(170): Xaa is any aa, unknown, or other
MDMQENTTPTHHGKTKKKESAMKKERARKRTSSVLDSTNDTVNEEMPEYDLDGPTIGEKLATLDLINRDNEKNVTQEQTLSMVPPSADSVHILLKQALRADDNASLLTCLYNRDEKVIAKSISLLTPADVVKLLKFFVLQIQSRGAVLVCLLPWLQTLLNRHMSSIVSQXSSLSLLNSLYQLIDARTSTFKSALQLSTTLDYLFSEIADDEADDGEVEPPIIYEDKDTDDEESEVDAMETDGEEAEELGDVTDASEHSDGSEIMSD

SEQ ID NO: 33671 - DNA, 508 bp, Panicum virgatum
  misc_feature: Ceres CLONE 1953325
  misc_feature: Encodes the peptide sequence at SEQ ID NO. 33672
accgcactctcgcgcaggcgccacttcactcccccgttcgctcgtcttccccggccgccgtccatctccgccgcctcgccagatcccgtccggctctggttcgtgggagagcgagggccggagatgggcagcgccagcgcgttcctcatcaggtggatcaacttcttcaccatgatactggcactgctggtggtgggcttcgggttctggatgagcacacacaacgacacgtgcagacggtccttgaccatccctgtcatgggcctcggcggggtgattttcctcatatcgctcgtgggtttccttggtgcttggaagaacatttcgtgcttgctctggacatacctaatcatgctgttcgtggtcttggtggcaatcatggtgttcacggtccttgcgttcatcataacaaatactggaactggtcatgttgttcttggggctagatataaagagtatcatcttcaggattacagttcctggtttgtcaaacagctcaatgatacgg

SEQ ID NO: 33672 - protein, 128 aa, Panicum virgatum
  misc_feature: Ceres CLONE 1953325
  misc_feature (4)..(127): Pfam Name: Tetraspannin Pfam Description: Tetraspanin family
MGSASAFLIRWINFFTMILALLVVGFGFWMSTHNDTCRRSLTIPVMGLGGVIFLISLVGFLGAWKNISCLLWTYLIMLFVVLVAIMVFTVLAFIITNTGTGHVVLGARYKEYHLQDYSSWFVKQLNDT

SEQ ID NO: 33673 - DNA, 1186 bp, Panicum virgatum
  misc_feature: Ceres CLONE 1953333
  misc_feature: Encodes the peptide sequence at SEQ ID NO. 33674
ctctcccaaaaccctagccgccctcgcgccgccgccgccgcccctagcgctcgagctcctcgccgcccgcgagctcgcgctgcatcgccgccatgaagttcaacattgccaacccgaccaccgggtgccagaagaagcttgagatcgatgacgaccagaagctgcgtgccttttttgacaaaaggatctcccaggaggtcaatggtgatgctctgggcgaggagttcaagggttatgttttcaagatcatggggggttgtgacaagcaaggttttcccatgaagcaaggagtgctaactcctggccgtgttcgccttctgctacacaggggcactccatgcttccgtggttatggtaggcgtgatggtgagcgcaggcggaagtctgtccgtggttgcattgtcagccaagacctctctgttatcaacttggtgattgtcaagaagggcgaaaatgatctgcctggtctgactgacaccgagaagcccaggatgaggggacccaagagggcctccaagatcaggaagctgttcaacctgtcgaaggatgatgatgtccgcaagtatgtgaacacataccgcaggacattcactaccaaaaatggcaagaaggtgagcaaggctcctaagatccagcgtctggtgacccccttgaccctccagaggaagcgcgctagaattgctgacaagaagaagaggattgccaagaagaagtccgaggctgctgagtaccagaagcttcttgcccagaggcttaaggagcagagggaacgccggagcgagagcttggcgaagaggaggtccaagctttctgctgctgccaaggcttcagctgctacatctgcttaagattgttcagagcttgagagatgtcagaatgcctacctaagctatagttggagaaccctcgtattctgtcggatctgtcgacccccctatcctttagctttctcgagtgcaattttgcatgaacatgcaaggcttgttggaatttgatttaccatgttggtttctgttatgaaggttggacccatcagatagctttataacttgctctctgccaatatgtcaaactatctgatcttgcaattttgattgtagtcaccattttgttgctagcgtctacgactgttttgctcggagtgtttgctatgctggagaaataacatactagtgtccttccggcg

SEQ ID NO: 33674 - protein, 251 aa, Panicum virgatum
  misc_feature: Ceres CLONE 1953333
  misc_feature (1)..(129): Pfam Name: Ribosomal_S6e Pfam Description: Ribosomal protein S6e
MKFNIANPTTGCQKKLEIDDDQKLRAFFDKRISQEVNGDALGEEFKGYVFKIMGGCDKQGFPMKQGVLTPGRVRLLLHRGTPCFRGYGRRDGERRRKSVRGCIVSQDLSVINLVIVKKGENDLPGLTDTEKPRMRGPKRASKIRKLFNLSKDDDVRKYVNTYRRTFTTKNGKKVSKAPKIQRLVTPLTLQRKRARIADKKKRIAKKKSEAAEYQKLLAQRLKEQRERRSESLAKRRSKLSAAAKASAATSA

SEQ ID NO: 33675 - DNA, 442 bp, Panicum virgatum
  misc_feature: Ceres CLONE 1953354
  misc_feature: Encodes the peptide sequence at SEQ ID NO. 33676
gtcacatcccgttctcttctccacgtaaggaatagggttgggactcatggcgcccacccagacaaactccagcctcttcatgggaatccacaaggaccatgtcgtcaacatgagcaagctgccgccgcgcccgtccctcctccaggggaaaggaaagaaccggtggaccttggtcacgggcctgatcatggacgttgctggctttgctcctaataagaaccgaatcactgagcttcagatcgttagctacgacaaccgtgctcagaacgttactcacagacaactcggaactcacatgacggaaaagaataagagagaggacatggccgctgtcctcgtgaaaatgagatctgctggcaccccccctgataacaataaatatagcatctccattccgtgaatctggtggctacattctgctgtgtcaggtttcccaacctgt

SEQ ID NO: 33676 - protein, 117 aa, Panicum virgatum
  misc_feature: Ceres CLONE 1953354
  misc_feature (5)..(103): Pfam Name: Ribosomal_L36e Pfam Description: Ribosomal protein L36e
MAPTQTNSSLFMGIHKDHVVNMSKLPPRPSLLQGKGKNRWTLVTGLIMDVAGFAPNKNRITELQIVSYDNRAQNVTHRQLGTHMTEKNKREDMAAVLVKMRSAGTPPDNNKYSISIP

SEQ ID NO: 33677 - DNA, 592 bp, Panicum virgatum
  misc_feature: Ceres CLONE 1953356
  misc_feature: Encodes the peptide sequence at SEQ ID NO. 33678
ctctccgagcgcggttcagcctcgccgtctcccccgctcgtcccccgacggttccatctccccccgtctctttcaccctggcgatcgctcggactcggcttgacatcacccccccacggagtgaatctcgagtgatgtcggccacgccggtctccacgtcggaaacgcgtgctgggagctgtactggctcgagcatggcattccccctgatgggcgaatgcccagtgacaagacaggtggaggaggtgatgatgcgtatgacaccttcttcagtgagactggcgctgggaagcatgttccccgtgctgtgttggttgatcttgagcacactgtcattgatgaggtgaggactggcacttaccgccagcttttccaccctgagcagctcatgatgggcaaggaggatgctggcaacgactttgcccgtgggcactacaccattggtagggagattgttgacctatgccttgaccgcatcacgaagcttggagaatactgcactggtctacaaggcttcctcgtgtacaacgctgttggtggaggaacaggctctggcattggttccctcctccttgagcgcctgtctgttgac

SEQ ID NO: 33678 - protein, 124 aa, Panicum virgatum
  misc_feature: Ceres CLONE 1953356
  misc_feature (12)..(124): Pfam Name: Tubulin Pfam Description: Tubulin/FtsZ family, GTPase domain
  misc_feature: Functional homolog of the protein sequence given in SEQ ID NO 50141
  misc_feature: Useful for making plants with altered cell wall content and/or composition
MPSDKTGGGGDDAYDTFFSETGAGKHVPRAVLVDLEHTVIDEVRTGTYRQLFHPEQLMMGKEDAGNDFARGHYTIGREIVDLCLDRITKLGEYCTGLQGFLVYNAVGGGTGSGIGSLLLERLSV

SEQ ID NO: 33679 - DNA, 621 bp, Panicum virgatum
  misc_feature: Ceres CLONE 1953356-R
tacaagttgaatcagttttgttaggtcagagagtagacatcataattgattaatcaatttatctcgcttgaacccattaaagtgtcagaaactttgatctatgttcctcattcggcagttcaacacgtataaaaaccaaaaggtatgtcatcccatttagtgtgcagaatagtagattagagtaggcatacaggaggttaatcagctagcaagtaattccttatttcatccattattcaagacacactgtcccgattgtggttttgaatttgaccataatatcgtagttatggtcgtgaatttgaccatggaagtttcagaaactttgatctatattcgtcattctgcagttcaacatgtataagaaccagaaggtatgtcatccctatttagtatgcagaatagtagattagagtaggcatacaggaggttaataagctagcaagtaatgccttatatcatccattattgaagactcactgtcttgcttgtggttttgaatttgaccataatatcctagttgtggtcttgaattttagtagataaactgcagatggaacttatgttaaacagctaggtagcaattattgggatgtcatggtgcctagcttagtgattagc

SEQ ID NO: 33680 - DNA, 559 bp, Panicum virgatum
  misc_feature: Ceres CLONE 1953388
  misc_feature: Encodes the peptide sequence at SEQ ID NO. 33681
cagcattctactacgatcctttgataaatcctatcacttcaactaacaaggttgatcgtcgggagaggaaagcaactgaagaggacgatgatgaagatttttgtctcccagaagacgtggagcctctcttgaaaagcactgaactctacactgatacaacagctgctggtatatcattactttttgctccaaagccttttaacatgagatctggcagaacacgtcgtgctgaggacattcctcttgtatcagagtggtacaaggagcattgcccaccagcttatcctgtgaaagttcgtgtgagttaccagaagctgttgaagtgctatgtactcaatgagctacatcataggcctcccaaggctcagaaaaagaaacacctgttccgttcactccaagctacaaagtttttccaaactactgagcttgactgggcagaggcaggcttgcaagtttgcaagcaggggtacaacatgctgaacttgttgattcacaggaagaatcttaactatcttcatttagactacaatttcaatttgaaacccgtgaggactcttac

SEQ ID NO: 33681 - protein, 185 aa, Panicum virgatum
  misc_feature: Ceres CLONE 1953388
  misc_feature (48)..(185): Pfam Name: PROCN Pfam Description: PROCN (NUC071) domain
AFYYDPLINPITSTNKVDRRERKATEEDDDEDFCLPEDVEPLLKSTELYTDTTAAGISLLFAPKPFNMRSGRTRRAEDIPLVSEWYKEHCPPAYPVKVRVSYQKLLKCYVLNELHHRPPKAQKKKHLFRSLQATKFFQTTELDWAEAGLQVCKQGYNMLNLLIHRKNLNYLHLDYNFNLKPVRTL

SEQ ID NO: 33682 - DNA, 659 bp, Panicum virgatum
  misc_feature: Ceres CLONE 1953394
  misc_feature: Encodes the peptide sequence at SEQ ID NO. 33683
ttccactacccgcacgccgcctcttccaccgtcaccatggccgccgcccccgcctcttctgccgccgttatggccgcagcccccgcaatccccgcgtcctcctccttcatctcgtcgtctccgtgctctctcagggtgtcaaagacaagcccccggcggcccacgggaagagtgtctcacaaaatcagctgcgtcagtaggccaccggccgtcgaaacatcttacaagactagtgtcccgcgcaatgctaacatggccaagctccaagcaggatatttatttcctgagatcgccaggagaagagcagctcacttgctcaagtaccctgatgctaagattataagccttgggataggtgacactacggagcccattccagatgtcataacaaatgccatggcagagagagcacatgccttatcaacaattgatggctacagtggttatggagctgagcaaggtgaaaagaaagtaaggtcagcaattgctgcgacatactatgcggaccttggtattgaagattcagacatatttgtctctgatggtgccaaatgtgacatttcccgcctacaggtcctttttggatctaatgtgacaattgcggtccaagacccatcatatcctgcatatgttgatttcagtgttatcatggggcaaac

SEQ ID NO: 33683 - protein, 207 aa, Panicum virgatum
  misc_feature: Ceres CLONE 1953394
  misc_feature: SWISSPROT Homolog: EC 2.6.1.83 LL-diaminopimelate aminotransferase
  misc_feature: Functional homolog of the protein sequence given in SEQ ID NO 50595
  misc_feature: Useful for making plants with modulated nitrogen use efficiency
MAAAPASSAAVMAAAPAIPASSSFISSSPCSLRVSKTSPRRPTGRVSHKISCVSRPPAVETSYKTSVPRNANMAKLQAGYLFPEIARRRAAHLLKYPDAKIISLGIGDTTEPIPDVITNAMAERAHALSTIDGYSGYGAEQGEKKVRSAIAATYYADLGIEDSDIFVSDGAKCDISRLQVLFGSNVTIAVQDPSYPAYVDFSVIMGQ

SEQ ID NO: 33684 - DNA, 616 bp, Panicum virgatum
  misc_feature: Ceres CLONE 1953394-R
  misc_feature: Encodes the peptide sequence at SEQ ID NO. 33685
gccatagtgtgcacttgcttcaatggcgcatcaaacattgctcaagctggtggcttagcttgcctctctccagagggtctgaagactatgcatgatgttgttggcttctacaaggagaatactgaaataattgtcgacacatttacgtcgcttggattcaacgtgtatggtgccaagaacgctccttatgtgtgggtgcacttccctggtcgcaattcgtgggatgtgtttgctgagatccttgagaaggcgaacgttgtcactacccctggcagtggatttggacccggcggtgaaggcttcgtgagggtcagcgcattcggccacagagataacatcattgaagcagctaggagactaaaacagctgtacaagtgagcactgacgcagcttcagtaacgtcttggaaggacgatatcaataagattgcagcaggatttgtttcaccaaattcgctctgtcgagctacttggagatatcagaagcggaacttgataatttcctaggctttatgtggtggcagttctttcaaattatttccaattcgaaactatgcttgttgtatccccgagacatttgaatcaccaggtagttcatctgttgttgctgttttcgg

SEQ ID NO: 33685 - protein, 125 aa, Panicum virgatum
  misc_feature: Ceres CLONE 1953394-R
  misc_feature: SWISSPROT Homolog: EC 2.6.1.83 LL-diaminopimelate aminotransferase
  misc_feature: Functional homolog of the protein sequence given in SEQ ID NO 50595
  misc_feature: Useful for making plants with modulated nitrogen use efficiency
AIVCTCFNGASNIAQAGGLACLSPEGLKTMHDVVGFYKENTEIIVDTFTSLGFNVYGAKNAPYVWVHFPGRNSWDVFAEILEKANVVTTPGSGFGPGGEGFVRVSAFGHRDNIIEAARRLKQLYK

SEQ ID NO: 33686 - DNA, 1764 bp, Panicum virgatum
  misc_feature: Ceres CLONE 1953401
  misc_feature: Encodes the peptide sequence at SEQ ID NO. 33687
tttttgaccaatcttttgctctgccccacctcgtggtgttcgttgtataaatcttctgttggggggtgggaagaggagaccaagcccggagcaagagccgcggtttcaaggatcctcaggaatcaccaactgttcaagtgctggtattgggagtgaaaaaaggattttagacgttgctgttttacctttgtctaaaaatgttgaggcagagctctagtagaaatcacagatccagaggtctgaagctaaagaaggctctccagataactctcttgattctggtttctgtttggttgatctaccaagttaagcattcttatgagaagaaggcgtcatatagcgaaggtgaagggaatgatctacataaagatgataaggaccagggggtggttatcagattgagcaggaaggacctacctttaaagatggaggctgattcttcaacattggatgaaaaggtggaggatgaagagaatgatgaaatggagcaagaaattaaacatgatgagaatgatgaggaccccatcgatgagcaagacctagagaaggacgaagatcttcccgagcctggtgaacattctgctgacaaggatggagatgatgtgggtgtgtttgaggatgaagagaataaggagcggtctcaggaggatcaagagaagagcttccatggtgataatgtttctagtgctgtcactcatgatcccccatcatctgagcaagatgagctgtcccatcatgcccaagagaaggtcttgttcgtggatgacgcttcatctgcagtgcctcatgaaaaccacgagggcggaagcaaggaggaggaagtgcgcagggctagggagaagagtttcagaggtgatgatgtggctagctctgtggatcatgatgccaagttgacaaaacctcttcccgaggaccaattgaacaccatggataggatatttgaaggcaccacaaatttgtccaatggaatttcatttcgggggcctggtgtaaatggatcaaatgctaccgggggacatgtggctactccaactaatatgtcttcccatcagaatgctgacattcctagcatgaacccagaaagcaagatccattccactccagcaaatttgaccagtgaccatgagcaaactaattcaactttgaatggtcaagcagagcagcaagtgaattcaacggtggtgctgcagggagaagtacagcctttgactgaccagacaacgtctgttgagttgcattctccaccaaatggcaccttggctcaggtaacagatgggcaaaagtccacatctggagctggaaatgatgacaataacactggcgcatcctccaccccggtggacaagaaggctgacagtgaggatgctcacaaagaagacgtggatgtctccacgaaaataatgaacagggcaatgagtgaagaagaagttgtccctgaatgataataagatgagatcctcctctcttattaggctctggtgtaacctgtaagttcgtaggacttggtttcttcatctcctagactcggagatgcaatgcaagcaggctatctctgttgcccctctttttgtaaaagtgttcgatagatacctgctttgtattgcctagtagtagtagtacatcgtgatggtctggggcaagtgatgaacaagaagcatgtacccacaggaatatagcgattcggcagctaagaaacttggctgcttgaatcatgtgccaactaggctatcaatgagatgtccatcacgcccaccattaagcccg

SEQ ID NO: 33687 - protein, 414 aa, Panicum virgatum
  misc_feature: Ceres CLONE 1953401
  misc_feature: SWISSPROT Homolog: EC 2.7.11.1 Non-specific serine/threonine protein kinase
MLRQSSSRNHRSRGLKLKKALQITLLILVSVWLIYQVKHSYEKKASYSEGEGNDLHKDDKDQGVVIRLSRKDLPLKMEADSSTLDEKVEDEENDEMEQEIKHDENDEDPIDEQDLEKDEDLPEPGEHSADKDGDDVGVFEDEENKERSQEDQEKSFHGDNVSSAVTHDPPSSEQDELSHHAQEKVLFVDDASSAVPHENHEGGSKEEEVRRAREKSFRGDDVASSVDHDAKLTKPLPEDQLNTMDRIFEGTTNLSNGISFRGPGVNGSNATGGHVATPTNMSSHQNADIPSMNPESKIHSTPANLTSDHEQTNSTLNGQAEQQVNSTVVLQGEVQPLTDQTTSVELHSPPNGTLAQVTDGQKSTSGAGNDDNNTGASSTPVDKKADSEDAHKEDVDVSTKIMNRAMSEEEVVPE

SEQ ID NO: 33688 - DNA, 942 bp, Panicum virgatum
  misc_feature: Ceres CLONE 1953406
  misc_feature: Encodes the peptide sequence at SEQ ID NO. 33689
aaccgctacaggtcccaaagtcgccgccagaagcccagaaccctaaaacctccgctccggcgatcgccgccgggacggccgccaccatgacggggccttcatggttgattgactacaaaagaatggcttcaaaaataaaaaatgcttctgcacctacacaccataccacacatacctggaagagcaacccgactaaggaatgcccaaaatgcaactacattatcgacaacagtgatgttgttgatgagtggcctggtttgccaaaaggcgtgaaatttgatccatcagaccaggaattgctgtggcatttgctagcaaaaattgggaaagtgggtgtcaaacctcatccatttatcgatgaatttattcccactattgattcaaatgaaggcttatgctgtactcatccgcagaaactcccaggagttaagcaggatggaagtgtatcacacttcttccacagaacatttaaggcctacaccactgggactaagaagcgtcggaagataaataccgacgagcttggtgaggttcgttggaacaagactggcaagacgaaagcagtagtaataggtggaacacaccttggttgcaagaaaataatggttatgtatgcgagcaatgtaaagggwgggaagcaagaaaagactaattgggtgatgcaccaataccacgttggcactggggaagatgagactgacagtgaatttgttgtctctaaattattctatcagcagcaacctaaggccggggataagatcacataagacatgggtgatcatatgtaacctgtatatgctgtagtagatttggctgattgtcctccattgaaggacttatcgcctttgctcttggaagaggacaataataatcatgaagctgttcagaagtctgaacataactttgattacgcaaatagtcattgagaaataaaggccatat

SEQ ID NO: 33689 - protein, 226 aa, Panicum virgatum
  misc_feature: Ceres CLONE 1953406
  misc_feature (58)..(198): Pfam Name: NAM Pfam Description: No apical meristem (NAM) protein
  misc_feature: The sequence is a functional homolog of SEQ ID NO 1710 in the 10/374,780 US patent application
  misc_feature: The sequence is a functional homolog of SEQ ID NO 542 in the 10/666,642 US patent application
  misc_feature: The sequence is a functional homolog of SEQ ID NO 210 in the 10/666,642 US patent application
  misc_feature: The sequence is a functional homolog of SEQ ID NO 562 in the 11/435,388 US patent application
  misc_feature: Functional homolog of the protein sequence given in SEQ ID NO 50710
  misc_feature: Useful for making plants with altered carbohydrate content
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 1713 in the 10/374,780 US patent application
MTGPSWLIDYKRMASKIKNASAPTHHTTHTWKSNPTKECPKCNYIIDNSDVVDEWPGLPKGVKFDPSDQELLWHLLAKIGKVGVKPHPFIDEFIPTIDSNEGLCCTHPQKLPGVKQDGSVSHFFHRTFKAYTTGTKKRRKINTDELGEVRWNKTGKTKAVVIGGTHLGCKKIMVMYASNVKGGKQEKTNWVMHQYHVGTGEDETDSEFVVSKLFYQQQPKAGDKIT

SEQ ID NO: 33690 - DNA, 559 bp, Panicum virgatum
  misc_feature: Ceres CLONE 1953406-R
ccatcctgcatctgaaaaggctgaagatgaagatagacacccttcacaggatccaaattggtgggagggcgaatcccagtttatgttgaactctcagcaactggcagaatgcatgtcaatttgtgatgagttccttcagagtcagaattcatctggcagtggagatgagcctggtaagagcagaccttgccttgctgaatatgcccagctgcctgcagatgacttgaaaaaagatcttgaagaatgccagaagctggacgtctcaaatgacacaaacctagaacttgaatgcactcctgagtttcgacttagccaactggattgctatgctacaacgtggattgaagggaaaatctagaaatggttaaagtgaggaggcaccactgttgcgaggcgacagaacgcacgcatcattttgtagtagctgttcatttagtatttaactactgtaattgctgtgtgtgaactgaaagtctggatacttgttttctaattgacccacttgacaatatatgtggggctcgctgagttgtaaaatatagtaaagaactcttgaccc

SEQ ID NO: 33691 - DNA, 417 bp, Panicum virgatum
  misc_feature: Ceres CLONE 1953411
  misc_feature: Encodes the peptide sequence at SEQ ID NO. 33692
accgcaagcagaattgaagcagcaaatccgcccaaaaccatcagctcgtctcccaaagagatgaagagcgcccacgcagcactgttcctcttggccttggtccttgtcgcatcgccatcaggtggcatggcggccaacactgcaggcgagtgctcggtgattatgctgtctccgggtgggaggtgcattcagagggcctgcagcttgctctgcgcggagagcttcgacggcggcataggcggctgcatcgatgcccaacgatgcgagtgctcgtacttctgtatgtagcaacagaggaacagtagaagataggtgtgcgctctatgaatgtgcctcgacgcataaggctatctagtatctacctggtgttgtggtggccaaatactgattagagctgggcagctgatgtttggatcc

SEQ ID NO: 33692 - protein, 75 aa, Panicum virgatum
  misc_feature: Ceres CLONE 1953411
  misc_feature (1)..(74): Pfam Name: SLR1-BP Pfam Description: S locus-related glycoprotein 1 binding pollen coat protein (SLR1-BP)
MKSAHAALFLLALVLVASPSGGMAANTAGECSVIMLSPGGRCIQRACSLLCAESFDGGIGGCIDAQRCECSYFCM

SEQ ID NO: 33693 - DNA, 1297 bp, Panicum virgatum
  misc_feature: Ceres CLONE 1953433
  misc_feature: Encodes the peptide sequence at SEQ ID NO. 33694
actcattcactcaccaagaagttgagcacctagagcttcagctcagctcattcgtttcttccggcttcccatccgggcttatcactagtgatcgctagctagcgaacaattctctgaagttgtcgagctgagcactagctagcggccatgatctccccggacaccatccgcacggccattggcgtcatcggcaatgggactgctctggtgctcttcctctccccagttccgacgttcatccgcatctggaagaaggggtcggtggagcagtactcgccggtgccgtacgtggcgacgctcctcaactgcatgatgtgggtgctgtacggcctaccgcttgtccacccccacagcatgctcgtcatcaccatcaacggcaccggcatggccatcgagctcacctacgtcacgctcttccttctctactccacggggcccgctcgccgcaaggtcgtcctcctcctcgccgccgaggtcgccttcgtctgcgccgtcgccgttctagtgctcagcctggcgcacacgcacgagcgcaggtccatgatcgtcggcatcctctgcgtcctcttcggcaccggcatgtacgcggccccgctctccgtcatgaaaatggtgatccagacgaagagcgtggagtacatgcccctattcctgtccctagcttctctggtgaacggcatctgctggactgcctacgccctcatcaaattcgacctctacatcacaatccccaacgggctgggcgttctgttcgcggtggcgcaggtggtcctctacgccatctactacaagtccacccaggagatcatcgaggcgcgcaggcgcaaggcaaaccaggtcgccatgaccgaggtcgtcgtcgacgacggcaagaccaacaacagccacgccggcgccggcctctactgacgaagtcatcgatgatatataccaagattaaggaagcgctcggcacaatataatcaagtatcaagtcgccgctggatgcctgtattgtgtgattgtgttcttcccacaagagatggaggccacatcatgttgtttcctaactgcttgcgcagcgctggacggagtcaccgggcctcttattaggtgggagtgatgggacgactgaggtgggggattttagctaattccaccttgccgatagggtttagcttaatctcgatgtgtagcggcacttaataatggtctcttgtctcaaatttgtattgatcacgaaaatctgtcgtcacacatgcacaaaagcatgctcatgaatcacgacctgtgatagggctgaattatttgttcggtc

SEQ ID NO: 33694 - protein, 253 aa, Panicum virgatum
  misc_feature: Ceres CLONE 1953433
  misc_feature (132)..(218): Pfam Name: MtN3_slv Pfam Description: MtN3/saliva family
  misc_feature (9)..(98): Pfam Name: MtN3_slv Pfam Description: MtN3/saliva family
MISPDTIRTAIGVIGNGTALVLFLSPVPTFIRIWKKGSVEQYSPVPYVATLLNCMMWVLYGLPLVHPHSMLVITINGTGMAIELTYVTLFLLYSTGPARRKVVLLLAAEVAFVCAVAVLVLSLAHTHERRSMIVGILCVLFGTGMYAAPLSVMKMVIQTKSVEYMPLFLSLASLVNGICWTAYALIKFDLYITIPNGLGVLFAVAQVVLYAIYYKSTQEIIEARRRKANQVAMTEVVVDDGKTNNSHAGAGLY

SEQ ID NO: 33695 - DNA, 1323 bp, Panicum virgatum
  misc_feature: Ceres CLONE 1953440
  misc_feature: Encodes the peptide sequence at SEQ ID NO. 33696
attctttcaggcaagcaactgaagtagttttggtttcctctctgcattgtgaagaggggacaagtagtgtattgtcaatctgcaatcttggtgcataaatctctgatcaagcaagctaaggctcctaaaacacacgaacaagccagcctgcacgttaaagttccatatcaaagcagaagttttcaatggctggcctatctcttcaccatccattggcctttgcctttggtctccttggcaacatcatctccttcatgacttacctggccccactgccgactttctaccgaatctacaagagcaagtcgactgaaggtttccagtcggtgccgtacgtggtggcgctgttcagcgcgatgctgtggatctactacgcgctgctcaagtccgacgagatcctgctcatcaccatcaacactgccggctgcatcatcgagaccctgtacatcgtcatctacctcgcctacgcgcccaagaaggccaagatgttcacggccatgatcctgctgctcctgaacgtcggcgtgttcgggctcatcctcctcctgacgatgctgctctccgccggccacagccgcgtcgtcctcgtcggctgggtctgcgtcggcttcgccgtcagcgtcttcgtcgccccgctcagcatcatccgtaaggtggtgcgcacgaggagcgtggagttcatgcctttcttcctctccctctccctcaccgtcagcgccgtcgtctggttcctctacggcctattcatcaaggacaaatacgtcgccctccctaatgtcatcggcttcaccttcggtgtcatccagatgggcctgtacgctctctattgcaacgcgacgcccaggttaccagccaagggtgtagatgctgacaaggataatgaggcggtggacgataccgtcatggtgcccgagcacatcgtgaccatcgctaagcttggagcgccggccgtggagatgaagacctgcgaggtgcaccccgtggagtcgccgccgacagaggaggctgcgaagcaggaggacgacgagccgtcggtcgaggagctggagatggcggggaacaagggaagcaacaacaccgaagcaagtctagatgccacatgcgtagtctgagtaatataattgaaggctacgccaacgccaagtggccaaccccatgtacggatgcacacacctagacgtctatggaagtgagccaccagacgagagggaagaaaaggggaccaaatcctgctgcttttgttattttattattagtccttattctgttcttgaaatagttccatttctttcttattagtatatgtctaacaccttctttggc

SEQ ID NO: 33696 - protein, 308 aa, Panicum virgatum
  misc_feature: Ceres CLONE 1953440
  misc_feature (12)..(99): Pfam Name: MtN3_slv Pfam Description: MtN3/saliva family
  misc_feature (133)..(219): Pfam Name: MtN3_slv Pfam Description: MtN3/saliva family
MAGLSLHHPLAFAFGLLGNIISFMTYLAPLPTFYRIYKSKSTEGFQSVPYVVALFSAMLWIYYALLKSDEILLITINTAGCIIETLYIVIYLAYAPKKAKMFTAMILLLLNVGVFGLILLLTMLLSAGHSRVVLVGWVCVGFAVSVFVAPLSIIRKVVRTRSVEFMPFFLSLSLTVSAVVWFLYGLFIKDKYVALPNVIGFTFGVIQMGLYALYCNATPRLPAKGVDADKDNEAVDDTVMVPEHIVTIAKLGAPAVEMKTCEVHPVESPPTEEAAKQEDDEPSVEELEMAGNKGSNNTEASLDATCVV

SEQ ID NO: 33697 - DNA, 1525 bp, Panicum virgatum
  misc_feature: Ceres CLONE 1953446
  misc_feature: Encodes the peptide sequence at SEQ ID NO. 33698
acgatctctgcccgaaaacctatcctgccgcaccaaccaaacaaacacggtctctcctcccctgctcctcaagttccaaactccatttccgctccggcgtttcttggtccggaagcacgctcctctctccaatctctacacacatgctattgctacgagcctacgacatgccttgcgagctgctaatgtgatgcccactcctgctcggtttcgccttgtcctcccttcacttcttggccaaagccccgcttataggtggcgcgtcgcgtcaccctacttggcccccaagagaccgtctccttctttaccattgaatcgatcatcgcaagcctgcactgcgtactgcacctccgtgccatcccgtcctctctcgtccctgtgctcctgtccatccaacgtcctccattcctcctgtgtgatcggcggcggcggcgcaccgccggcggtttctcgatcggttcagccattcttgcagttccagggcatgtgctttttctggtaaagcgtgctgccccgtgcgtgccttgggccggagcaaggaatatttccgagttcttcagcacgggaaggtatcttcgaactagatgcatcacaaagttcctgcgtgaggatctttgcgcggcaaaccgcgagatttcttgggcggagatggaaaagggagggttcaagatgttcaacttagtctcatcctggaacaagaggaggagaagcagatcacttgatcagctgaatccatgggtgtacaagtcggccgagctgtggcaggccaaggagcagagcccgccgccgaagaagcgcagctgcacgatggtgttcacgctcaaggagatggaggaggccaccaacatgttcagcgaccggaacctcatcggcaagggcggcttcggccgggtttacagaggcgtgctcaaggatggccagatcgtcgccatcaagaagatggacctgcccacctccaagcacgccgacggcgagcgcgagttccgggtggagatcgacatcctgagcaggctagagcaccccaacctggtgacgctgatcggctactgcgccgacgggaagcaccgcttcgtagtctacgagttcatgcccaaaggcaacctccaggacatcctcaatggcatcggggaggtgaagatggactggccggtgcgcctgcggatcgcgctgggcgcggcgagggcgctggcgtacctgcactcgagcacggccgtcggcgtccccgtcgtccaccgggacttcaagtccagcaacattctcctcaccgaacacttcgaggccaagatctccgacttcgggctcgccaagctgatgcagcaggaccaggacctgcacaccaccacccgagtgctgggcaccttcggctacttcgaccctgagtacgcactgacggggaagctgacgctgcagagcgacgtgtacgcgagttcagtattctttaatgaactcaacacagatgcaaatattcacaaaatttgtaaaaacatatatatggcaggagcaactacaaatattacaattttat

SEQ ID NO: 33698 - protein, 292 aa, Panicum virgatum
  misc_feature: Ceres CLONE 1953446
  misc_feature (68)..(282): Pfam Name: Pkinase Pfam Description: Protein kinase domain
  misc_feature: SWISSPROT Homolog: EC 2.7.11.1 Non-specific serine/threonine protein kinase
MEKGGFKMFNLVSSWNKRRRSRSLDQLNPWVYKSAELWQAKEQSPPPKKRSCTMVFTLKEMEEATNMFSDRNLIGKGGFGRVYRGVLKDGQIVAIKKMDLPTSKHADGEREFRVEIDILSRLEHPNLVTLIGYCADGKHRFVVYEFMPKGNLQDILNGIGEVKMDWPVRLRIALGAARALAYLHSSTAVGVPVVHRDFKSSNILLTEHFEAKISDFGLAKLMQQDQDLHTTTRVLGTFGYFDPEYALTGKLTLQSDVYASSVFFNELNTDANIHKICKNIYMAGATTNITIL

SEQ ID NO: 33699 - DNA, 1145 bp, Panicum virgatum
  misc_feature: Ceres CLONE 1953448
  misc_feature: Encodes the peptide sequence at SEQ ID NO. 33700
actgcggcccattcataggcataggctggtgatcagatcacagctccacgtctccagtctactcagccccctgcatagactgctcctccttaatttgaaggaacaagcaagaaaaggagagaaagatgaccagcgtttggaagaccaaggttctgcccggcctcaacaagatctttgacaaggatggcaagaaggcggcggcggccgagttcctaaagtccttcaacaaggaggagattggcaaggagattgaggacaagaagacagagctggagcccaaggttgtggaggcttatgaagcatctcctcctgaagttaaggctctgttcaaggacaagaaaccagtcaagatcagcaagaagaactcggctgcagctaccaagttgctcgacgagctggctaagattgagttccctggagccaagctggtgagcgacgcggtggccaagtccggcaccacgcccctctccccggcgatcaccttcatcttggacaaggttgcgccgttcatccccaaggaggagcccaaggccgagccggaggccacctcccgggaagtcgccgtcgaggagaagaagaaggaggccgagcccccggccgctgcggcgacggaggaggctgcgccggcaccggcggaggcgtcggaggcggtagaggagaagaaggctgaggaggagaagccgacggaagccgcagccgaggccgcggcggcgccaccagctgaggaggagaagaagtgatcgccacgccagtcgacactgaatgaagaagctaagcaagcaaattaagctacgtagctagctccgatcctcctcgttgctggtaaattgaagttaccttaccgtgagatttaaattaaattactccctctccttcatgtcaaccacgtcgtcgtatatatatatagtagctagctgctgcacaaattaatttgcatatatataagggtggtggatgcatgaacatttgttattcttttgtgtcacctcgatcgatggatggaccttctgtaaatttgtaatgggttttgtctttcttgtttttttttcttgatttggggtgattaaacatgcacgtgtaattatttgtattgatatgtttgctggtggtcatatttaagaaaacaactcgacgatcttgtgcat

SEQ ID NO: 33700 - protein, 204 aa, Panicum virgatum
  misc_feature: Ceres CLONE 1953448
  misc_feature (2)..(204): Pfam Name: DREPP Pfam Description: DREPP plasma membrane polypeptide
MTSVWKTKVLPGLNKIFDKDGKKAAAAEFLKSFNKEEIGKEIEDKKTELEPKVVEAYEASPPEVKALFKDKKPVKISKKNSAAATKLLDELAKIEFPGAKLVSDAVAKSGTTPLSPAITFILDKVAPFIPKEEPKAEPEATSREVAVEEKKKEAEPPAAAATEEAAPAPAEASEAVEEKKAEEEKPTEAAAEAAAAPPAEEEKK

SEQ ID NO: 33701 - DNA, 1060 bp, Panicum virgatum
  misc_feature: Ceres CLONE 1953449
  misc_feature: Encodes the peptide sequence at SEQ ID NO. 33702
atcgagcaccctccaatcttcaaggcgtcgcagcaggcaaggcatcgatcgatcaatcaccagcagcgcgtgccgcgtagagagatcgagagagagagagagagagagagagagaggagtctcaccggagaagggaggaatcgtcttcgccaccgccaccgctatgggcaaggtccgctccttcttctcccgcagcggcaagcgcggcgccggcccgtcctcgccgtcctcctccgcggcgggcagcgcgccgtcgtcgccgtccccgaggaagtcgtcggcgtcggcgccggcggccccggcggcggagaccaaggacgagatggagcgcgtgttccgcaagttcgacgcgaacggcgacgggcggatctcgcggtcggagctggcggcgctgttcgagggcgtgggccacgcggccacggacgacgaggtgtcgcgcatgatggaggaggccgacgcggacggcgacggcgccatcagcctgcccgagttcgccgcgctcgtgcgctccgccgacgccgacgccgacgccgtcgaggaggacctgcgccacgccttcatggtcttcgacgccgacggcaacggcctcatcacgcccgccgagctcgcgcgcgtcctgcgcggcctcggggaggccgccmccgtcgcccagtgccgccgcatgatccagggcgtcgaccgcaacggcgacggcctcgtctctttcgacgagttcaagctcatgatggccgccggcggaggcttcggcaggatggcctcctcctcttcttaggcactcatctgtttgggcaagatcgctgttcggctctgctcccacaaattggattcgttcgttgaattgcactgtacatacgtaacagcgagatcgaagagatcatcgccaccaaaccaaagtaattactagtactaggcccatatcacacggacaaaaccacatcgaaaaataacacgattggttttgtatatgtacatatatctccaatgcgcatccgttgtacatgatggatgttgaatgattcgttctggtttcagttcaaatcttatggtttccacttgtcac

SEQ ID NO: 33702 - protein, 202 aa, Panicum virgatum
  misc_feature: Ceres CLONE 1953449
  misc_feature (53)..(81): Pfam Name: efhand Pfam Description: EF hand
  misc_feature (163)..(191): Pfam Name: efhand Pfam Description: EF hand
  misc_feature (89)..(117): Pfam Name: efhand Pfam Description: EF hand
  misc_feature (127)..(155): Pfam Name: efhand Pfam Description: EF hand
  misc_feature: SWISSPROT Homolog: EC 2.7.11.1 Non-specific serine/threonine protein kinase
  misc_feature (160)..(160): Xaa is any aa, unknown, or other
MGKVRSFFSRSGKRGAGPSSPSSSAAGSAPSSPSPRKSSASAPAAPAAETKDEMERVFRKFDANGDGRISRSELAALFEGVGHAATDDEVSRMMEEADADGDGAISLPEFAALVRSADADADAVEEDLRHAFMVFDADGNGLITPAELARVLRGLGEAAXVAQCRRMIQGVDRNGDGLVSFDEFKLMMAAGGGFGRMASSSS

SEQ ID NO: 33703 - DNA, 1367 bp, Panicum virgatum
  misc_feature: Ceres CLONE 1953451
  misc_feature: Encodes the peptide sequence at SEQ ID NO. 33704
agagtagtaatcattcacacacagcaacagccaacagcacagggggcattccgatccgccggaaccctagcaaggagttaggtatccatggccttctggtggccgctcctcgtgctcgccgccgcctacgcgctctgccgcctgctcctcttcctcatcccgcccaccgtcccttccatcgacgtcgacgcttccgatgtcttggccaaggaggacagcttcatttacataccaagaaagggcaaagcagctcagaccggcaaggtccaatgctacgaaccagcaaccatgaaatacttgggctatttccctgcattgactcctgatgaggtcaaggagcatgttgcacaagccaggaaagctcaaaagatatgggcaaaaagcagcttcaagcaaaggcgccagttccttcgtgtccttctcaagtatatacttgaacatcaggatctcatttgcgaggtatcatctcgggacacgggaaagactatggtcgatgcttcattaggcgagataatgaccacatgcgagaagattacctggcttttggatgagggtgagaagtggttaaaacctgagtacagatcaactgggagatcaatgctgcacaagagagcaaaagttgaattctaccctcttggagtggttggtgctattgtatcatggaattatcccttccataatgtttttaatccaatgctggctgcagtattctctggtaatgcagcagttataaaggtctctgaacacgcgacttggtcaggctgcttttatttccgtatcatacaagcagctctttcagctgttggtgcacctgagaatctggtgcacataataactggttttgctgaaacaggccaagctcttgtatcttcagtagacaaaataatatttgtgggatcacctggcgttggaaggatgatcatgcaaaaagcatcggagactctaatacctgtaactcttgagcttggtggcaaagattcctttattgtgtgtgaagatgtagatttacccaatgttgttcaagtcgccattagagctgctctgcaatctagtgggcagaattgtgctggcgctgaaagattttatgtccacaacgatatctattccgcctttgtttctcaagtagtgaagatagtcaaatctatatgtgttggtccccctttatcaggcagatatgatatgggtgcaatctgtatgatagagcattctgagaaacttcagaatcttgttaatgacgctattgacaaaggtgccgaaattgctgtcagagggagttttggcaatcttggtgaagatgcagttgatcaatttttccctccaactgtcctggtgaatgttaatcacacaatgaaaattatgcaagaaga

SEQ ID NO: 33704 - protein, 426 aa, Panicum virgatum
  misc_feature: Ceres CLONE 1953451
  misc_feature (53)..(426): Pfam Name: Aldedh Pfam Description: Aldehyde dehydrogenase family
  misc_feature: SWISSPROT Homolog: EC 1.2.1.3 Aldehyde dehydrogenase (NAD(+))
MAFWWPLLVLAAAYALCRLLLFLIPPTVPSIDVDASDVLAKEDSFIYIPRKGKAAQTGKVQCYEPATMKYLGYFPALTPDEVKEHVAQARKAQKIWAKSSFKQRRQFLRVLLKYILEHQDLICEVSSRDTGKTMVDASLGEIMTTCEKITWLLDEGEKWLKPEYRSTGRSMLHKRAKVEFYPLGVVGAIVSWNYPFHNVFNPMLAAVFSGNAAVIKVSEHATWSGCFYFRIIQAALSAVGAPENLVHIITGFAETGQALVSSVDKIIFVGSPGVGRMIMQKASETLIPVTLELGGKDSFIVCEDVDLPNVVQVAIRAALQSSGQNCAGAERFYVHNDIYSAFVSQVVKIVKSICVGPPLSGRYDMGAICMIEHSEKLQNLVNDAIDKGAEIAVRGSFGNLGEDAVDQFFPPTVLVNVNHTMKIMQE

SEQ ID NO: 33705 - DNA, 632 bp, Panicum virgatum
  misc_feature: Ceres CLONE 1953451-R
  misc_feature: Encodes the peptide sequence at SEQ ID NO. 33706
gtagcagcaatcaatgattttgcatcaagttatatgtgtcagtcattgccatttggtggtgttaaagacagtggatttgggagatttgctggtgtagagggcttgcgagcttgctkccttgtgaaggctgtcgtagaagatagattctggccatatattaaaacgatgatcccaaaacctatccagtatcctgtctcggagcatggatttgcgttccaggagctgctcgtggaagctctgtatggctatagcgtttgggacaggttgcggtccctcgtgaatctggtaaagatgattmctgagcagaactctaccccagctccagctccaggtacgaggacgaagaaaaggcgatgaggctgtgccaatttgcccttatgacgcttctcccatcagcgatgggcttgtcggggatgcaggttatgtgcttggcagcctgcactgtaaacggccttaagaaattagaagtagcctccgtccatgacacaagaggaaatcaaaatcgacaacgagatccgtgactggttttcgattttggtctccgaaacaactctgttgtgttggtgcttgctgcttgggaacatagctttgagaaactgttgcctgggcaatgaatgaagtgaaattctagc

SEQ ID NO: 33706 - protein, 118 aa, Panicum virgatum
  misc_feature: Ceres CLONE 1953451-R
  misc_feature: SWISSPROT Homolog: EC 1.2.1.3 Aldehyde dehydrogenase (NAD(+))
  misc_feature (39)..(39): Xaa is any aa, unknown, or other
  misc_feature (100)..(100): Xaa is any aa, unknown, or other
VAAINDFASSYMCQSLPFGGVKDSGFGRFAGVEGLRACXLVKAVVEDRFWPYIKTMIPKPIQYPVSEHGFAFQELLVEALYGYSVWDRLRSLVNLVKMIXEQNSTPAPAPGTRTKKRR

SEQ ID NO: 33707 - DNA, 1018 bp, Panicum virgatum
  misc_feature: Ceres CLONE 1953460
  misc_feature: Encodes the peptide sequence at SEQ ID NO. 33708
ggaccccgcctccctccctgccgccgccgcctgccgcgggccgcggccaggcggcctcctctcctccgctggcccctcggtcaatccgccaggcgtcctagtccccttccccttccttccctcccgcgtgaagccgcctccctcgacagctcgctctctctcgacagtcgccggcgacggcctggcgtactccccgggcccgggtctccactctgaagtggcgacgccgggggcacactgagccgcgccactgtccgccatcaacgactggcactccctcgtctcgaccccttcctcgccgccgatcaagatcgacctaagcccttggctacaaagttccctttctgcagaccactgcttgctgttgaggtaaaaatgctgaagaacattttgagccagtcatggaggaaaggtgcacatgtactgcaggaaggaaatccagcaccagcactatatacatgctggagtcgatttcacagtggacagatcttaagctcttccaggagcttctttggcgtggaggactttgtggatgaagacaacagtagaccctacacatacaagaaggaaaagagatcgaagaacccgcacaagcacatttctttcaagcagcgcacaatcgcacacatggagcccttcacgctcgacgtcttcatctccaagcgcttcgtctcggcgtccctcacgcaccgttcgacgtgcaggcaggtcgcggtcgcgggaaccaattcgaaggacatcaaggctgcgctcaagtcgaggtccgacataccggcctgcctggccgtgggccgtttcctggcggagagggcgaaggaggccgacgtctacacctgcacctacacgccgagggagcgggacaggttcgaggggaagatcagggccgtcgtccagtcgctgatcgataacgggatcaatgtgaaactctaccttgactaagccttttgctgtacggaactatgctggattactcttccggtacttgcaaaatgagcagcctgtcgcatggtgtcctgcc

SEQ ID NO: 33708 - protein, 187 aa, Panicum virgatum
  misc_feature: Ceres CLONE 1953460
  misc_feature (65)..(182): Pfam Name: Ribosomal_L18p Pfam Description: Ribosomal L18p/L5e family
MLKNILSQSWRKGAHVLQEGNPAPALYTCWSRFHSGQILSSSRSFFGVEDFVDEDNSRPYTYKKEKRSKNPHKHISFKQRTIAHMEPFTLDVFISKRFVSASLTHRSTCRQVAVAGTNSKDIKAALKSRSDIPACLAVGRFLAERAKEADVYTCTYTPRERDRFEGKIRAVVQSLIDNGINVKLYLD

SEQ ID NO: 33709 - DNA, 1081 bp, Panicum virgatum
  misc_feature: Ceres CLONE 1953468
  misc_feature: Encodes the peptide sequence at SEQ ID NO. 33710
ctcgctcaaaaccctagccctcgcgccgccgccgccgccgccgcccctagcgctcgagctcctcgccacccgcgagctcgcgctgcatcgccgccatgaagttcaacattgccaacccgaccaccggatgccagaagaagcttgagatcgatgacgaccagaaactgcgtctctttttcgacaaaaggatctctcaggaggtcaatggtgatgctctgggtgaggagttcaagggttatgttttcaagatcatggggggttgtgacaagcaaggctttcccatgaagcaaggagtgctaacttctggccgtgttcgccttctgctacacaggggcactccatgcttccgtggttatggtaggcgtgatggtgagcgcaggcggaagtctgtccgtggttgcattgtcagccaagacctctctgttatcaacttggtgattgtcaagaagggtgagaatgatctgcctggtctgactgacaccgagaagcccaggatgaggggacccaaaagggcctccaagatcaggaagcttttcaacctgtcgaaggaggatgatgtccgcaagtatgtaaacacataccgcaggacattcactaccaagaatggcaagaaggtgagcaaggctcctaagatccagcggctggtgacccctttgactctccagaggaagcgcgctagaatcgctgacaagaagaagaggattgccaagaagaagtccgaggctgccgagtaccagaagctccttgcccagaggcttaaggagcagagggagaggcggagcgagagcttggccaagaggaggtctaagctttctgctgccgccaaggcttccgctgccacctctgcttaagattgttcagagtttgagagatgtctgaatgcctctacctaagctatagttggagaaccctcatgttctgtgttggatctgtcgaccccccctaccattaccctttagctttctcgagtgcaattttgcatgaacatgcgtcaggctttgttggtatttgagttaccatgttgttttctattgtgaaagttggacccatcagatagctttatataactttgctctctgcc

SEQ ID NO: 33710 - protein, 251 aa, Panicum virgatum
  misc_feature: Ceres CLONE 1953468
  misc_feature (1)..(129): Pfam Name: Ribosomal_S6e Pfam Description: Ribosomal protein S6e
MKFNIANPTTGCQKKLEIDDDQKLRLFFDKRISQEVNGDALGEEFKGYVFKIMGGCDKQGFPMKQGVLTSGRVRLLLHRGTPCFRGYGRRDGERRRKSVRGCIVSQDLSVINLVIVKKGENDLPGLTDTEKPRMRGPKRASKIRKLFNLSKEDDVRKYVNTYRRTFTTKNGKKVSKAPKIQRLVTPLTLQRKRARIADKKKRIAKKKSEAAEYQKLLAQRLKEQRERRSESLAKRRSKLSAAAKASAATSA

SEQ ID NO: 33711 - DNA, 633 bp, Panicum virgatum
  misc_feature: Ceres CLONE 1953472-R
  misc_feature: Encodes the peptide sequence at SEQ ID NO. 33712
gtgtgcgtcgcgcgcgggatggcgccgggcgcggacacccgcctcgggctgccggccaacgtccgccaccgcctgagcccgccgctcccacgcagcttcttcgggaacgccgtcgtgcgcgacctcgtcacggcgcgggtcggcgacctgctgggcagcccgctcgggtccgtggcggagacgatcaagaaggcggtggacggcgtgggcgacgcgttcgtgcggtccgtgctcgactacctggagctggagcaggcgaagaagcgaggcggcgacgacgacagcgcccagggcgagcagatggtgccggcgaccgacctgtgggcggtgagctggctggggatgcccatgtacagcgccgacttcggctcgggcgcgccgcggttcgtcgcgccggcgcagatgttcggcgtcggcacggcgtacatgaccccctgcgccaacaaggacgacggcatcaccgtcatcttctcgatggaggccgagcacattgagtgcttcgagaaggtcttctacggggaatgaattgaaacagctcgagataacagtactacgttttgtgctttttaatttattttaatttttccatgtaaaagaagcattttatcagggtaaatccgcataaatcgccct

SEQ ID NO: 33712 - protein, 174 aa, Panicum virgatum
  misc_feature: Ceres CLONE 1953472-R
  misc_feature: SWISSPROT Homolog: EC 2.3.1.144 Anthranilate N-benzoyltransferase
  misc_feature: Functional homolog of the protein sequence given in SEQ ID NO 50924
  misc_feature: Useful for making plants with altered carbohydrate content
VCVARGMAPGADTRLGLPANVRHRLSPPLPRSFFGNAVVRDLVTARVGDLLGSPLGSVAETIKKAVDGVGDAFVRSVLDYLELEQAKKRGGDDDSAQGEQMVPATDLWAVSWLGMPMYSADFGSGAPRFVAPAQMFGVGTAYMTPCANKDDGITVIFSMEAEHIECFEKVFYGE

SEQ ID NO: 33713 - DNA, 677 bp, Panicum virgatum
  misc_feature: Ceres CLONE 1953488
  misc_feature: Encodes the peptide sequence at SEQ ID NO. 33714
acctccctccctccccattccgccgccgtcgccttcccctcatctcccaatcccgagatctccccctccgcccgcccgctgccatggcgctctccgtggagaagacctcgtcggggcgggagtacaaggtcaaggacctgtcccaggccgacttcggccgcctcgagatcgagctggccgaggtcgagatgccgggcctcatggcgtgccgcgccgagttcggcccctccaagcccttcgccggcgccaggatctcgggctccctccacatgaccatccagaccgctgtcctcatcgagaccctcaccgcgctcggcgcggaggtccgctggtgctcctgcaacatcttttccacgcaggaccacgccgccgccgccatcgcgcgggactccgccgccgtcttcgcctggaagggggagacgctcgaggagtactggtggtgcaccgagcgatgcctcgactggggcggggccggggggcctgacctcatcgtcgacgacggcggcgacgccacgctcctcatccacgagggcgtcaaggccgaggaggagtacgagaagtccggcaagatcccggacccggactccaccgacaacgccgagttcaagatcgtgctcaccaagagcaagtttgacaacctgtacggttgccgccactccctccctgatggtttgatg

SEQ ID NO: 33714 - protein, 197 aa, Panicum virgatum
  misc_feature: Ceres CLONE 1953488
  misc_feature (12)..(197): Pfam Name: AdoHcyase Pfam Description: S-adenosyl-L-homocysteine hydrolase
  misc_feature: SWISSPROT Homolog: EC 3.3.1.1 Adenosylhomocysteinase
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGGAGGPDLIVDDGGDATLLIHEGVKAEEEYEKSGKIPDPDSTDNAEFKIVLTKSKFDNLYGCRHSLPDGL

SEQ ID NO: 33715 - DNA, 686 bp, Panicum virgatum
  misc_feature: Ceres CLONE 1953488-R
  misc_feature: Encodes the peptide sequence at SEQ ID NO. 33716
ggtgtcaagcggatcaccatcaagccccagactgatcgctgggtgttccctgagaccaacactggcatcattgtcctcgctgagggtcgtctgatgaaccttgggtgtgctactggccaccccagctttgtcatgtcctgctcattcactaaccaggtcattgctcagcttgagctgtggaaggagcggagctctggcaagtatgagaagaaggtgtatgtgctccccaagcaccttgatgagaaggttgccgccctccacttgggcaagcttggtgccaagctcaccaagctcaccaagtctcaggctgactacatcagtgtcccgatcgagggtccctacaagcccgcgcactaccggtactaggttgcccaggacgactagaagctcactcggctggccggttatattgtgtgcccttacgaagttcactacaccggctggtcaattatcatatgcgctgttgcgctggaggatttgttatgatcattgcttgagcctggttgagtggggagaggagggaagagctgtttgcttttgcggaagaacaatggcctaattggttgtagggtgtggcagtgtgcgttgccagaactatacagtttctgattatcatttgcaagcgatttgctctagttatgtgtctttcatgaataacatgctttcttaaagagcacatttagtct

SEQ ID NO: 33716 - protein, 121 aa, Panicum virgatum
  misc_feature: Ceres CLONE 1953488-R
  misc_feature (1)..(120): Pfam Name: AdoHcyase Pfam Description: S-adenosyl-L-homocysteine hydrolase
  misc_feature: SWISSPROT Homolog: EC 3.3.1.1 Adenosylhomocysteinase
GVKRITIKPQTDRWVFPETNTGIIVLAEGRLMNLGCATGHPSFVMSCSFTNQVIAQLELWKERSSGKYEKKVYVLPKHLDEKVAALHLGKLGAKLTKLTKSQADYISVPIEGPYKPAHYRY

SEQ ID NO: 33717 - DNA, 918 bp, Panicum virgatum
  misc_feature: Ceres CLONE 1953496
  misc_feature: Encodes the peptide sequence at SEQ ID NO. 33718
catcgtgacctgattgcggccctacgcgagctttccatcgtcgccgtgccgccaccaccgcccgtggccgtcggagcagggccgcgccacgccgccacctctccgacttgtgaaggttgctgcgtaggcagtaggcacatacacacaggcggcggcggcggccatggcgtcgcgcaagcttctcctgagcctcaccgccgggaggcggctccggtcccgcactcagcaactcttctgggccgccagcctccctgaagctgccacctctcgctccctcgcggccgccgttgccgcggcgcagcagtcgggcgagtctccagtggctcacctcttctcttcgaggaccatctcgtcgacgcgccccgcgacgcagtccgctggagatgcgcccggttcatctgcggtggaccacaagttgataatgcctgaggacgattttcataaattagcagatgagacgattcacgatttgcttgaaaaacttgaggaatatggtgactccattcaaatggatggtttcgacattgactacgggaatcaggttttgacattgaggctcggggatttgggaacatatgttgtaaacaagcaaacaccaaacagacaaatctggttatcttcacctgtgagtgggccttctaggtttgattgggatgcatcaacagatggttggatatacaaacggactggagcaaatcttgtgcagcttctggaaaaggagattggtgagctctgtggtaccccagtagaactttcataatatcactggaaatgccacacatctagattggacggagagtagtgtgcctgaggtacagtatgagggagacaacactcttgtaatatgttttttcacaaaattttgttgttctacacatttgcacactttggaatataaataacttccctttgctgatc

SEQ ID NO: 33718 - protein, 198 aa, Panicum virgatum
  misc_feature: Ceres CLONE 1953496
  misc_feature (87)..(198): Pfam Name: Frataxin_Cyay Pfam Description: Frataxin-like domain
MASRKLLLSLTAGRRLRSRTQQLFWAASLPEAATSRSLAAAVAAAQQSGESPVAHLFSSRTISSTRPATQSAGDAPGSSAVDHKLIMPEDDFHKLADETIHDLLEKLEEYGDSIQMDGFDIDYGNQVLTLRLGDLGTYVVNKQTPNRQIWLSSPVSGPSRFDWDASTDGWIYKRTGANLVQLLEKEIGELCGTPVELS

SEQ ID NO: 33719 - DNA, 602 bp, Panicum virgatum
  misc_feature: Ceres CLONE 1953499
  misc_feature: Encodes the peptide sequence at SEQ ID NO. 33720
aacggctatcgtcgccagatccggcagcggaggcggccgcgccgagcctcgactcgctcccgccggaaatcctcgagaaaatcatctcctgcctccacgtctgcgacgccgtgcgcacctgctctctctcccgcgcctggcgccgccgctgggagtcaacccccggcatccgcttcttctgggactcctccgccgccgccgcgcccccggccgccatcgacgccgtcctctcgcggtacgcgtgccccgtccgcaacttctgctactgggagatccccgatagaggccttcgcccgcacggacgaatggatccccgccctcgccgggaaggggggtccaatccctcgctcttcgtttcagggagtacctccgtgtggatatccacacgcttcacctcgccgtcttctcctgccaagagctcactcacctcacgctccccggctgcttcgtcccaaccgccccccccccccccccccccctctcttcgcagggtttccgaaattgacctggttaagtctcaccatggtcggctttcatgaacatggggagagagatttggaggcgatgatccacatgtctccgttgcttgagacgctggagct

SEQ ID NO: 33720 - protein, 178 aa, Panicum virgatum
  misc_feature: Ceres CLONE 1953499
  misc_feature (14)..(61): Pfam Name: F-box Pfam Description: F-box domain
RLSSPDPAAEAAAPSLDSLPPEILEKIISCLHVCDAVRTCSLSRAWRRRWESTPGIRFFWDSSAAAAPPAAIDAVLSRYACPVRNFCYWEIPDRGLRPHGRMDPRPRREGGSNPSLFVSGSTSVWISTRFTSPSSPAKSSLTSRSPAASSQPPPPPPPPSLRRVSEIDLVKSHHGRLS

SEQ ID NO: 33721 - DNA, 663 bp, Panicum virgatum
  misc_feature: Ceres CLONE 1953499-R
aactatggtgatattttttttgctacttttttttctctttcattgacattaccttctcatagctttcaggtccagttaaaacggtcttttccaattttggcagattgtggacagtcaactgaatgatgaagttgatctagaatttttcagtgcacaatgcaccaacagtctcttcccaaagctcaagactgttaccgtcacagataccccactatggtcaaatgagatgtattttattgagttcattctgtccaaagcaaggctactttgtgccctttttgtttataaggatgatgatagtgactactcaaatcccagtgaagaggtggttatccagctagcaaaatttagaagggcgtctccaaaagctagggtcttcttcagaacgatggatgaatattggaggcatgaaatagtactgagtaaaatggttgacctattgtgatgtcagatcagcggagacgattgaaggtgcaagctgcatgatcttgctagaggatcaaacggcaccaaaataattgttttagtacctagcactgatgtgaggcataaaattgtaatgtgttgcacctgagtattgtactgccattggacttctgacgagatggcatggttttttttttggtgacttgtttggccccaactttttacctgtatgcaacc

SEQ ID NO: 33722 - DNA, 1175 bp, Panicum virgatum
  misc_feature: Ceres CLONE 1953503
  misc_feature: Encodes the peptide sequence at SEQ ID NO. 33723
ggctcggctctgccccccatgcgcccagcggcccaccccatctgaccgtctcgcctcgctctgcaccagtgacctcgacttcttccgcgaacagccacctcacccaccacctcgccggagatcacgagaggagcctcgccgctgcaccccccccccccccgcccgcccatgggggacgccgcctccggccgcggccacgtcgtctaccctccccgctccgccgaggacatcttcaaggactaccgcgcccgccgctccgccatcctccgcgccctcacccacgacgtcgaggacttatacgcgcagtgcgatccagagaaggagaacctctgcctgtacgggtatgcaaacgaggcgtgggaggtggcgctgccggcggaggaggtgcccacggagctgccggagcccgcgctggggatcaacttcgcgcgcgacggcatgaaccgccgcgactggctcgcgctcgtcgccgtccactccgactcatggctcctctccgtcgctttctactacgctgctcgactcaatcggcatgaccggaagcgtttatttggtatgattaacgaattgcaaactgtttttgaagttgtctccggtgcgagacaacaacaatctaaggagaggtctattatggacaatggtgggagggccaaaccctcagtaaagatagaaaataacggaaaagcatcagaagatgcattcggagaagatgacagtgatcacggtgaaactctttgtggtacctgtggtggtatatacagcgcagatgagttctggattgggtgcgacatctgcgagaggtggtatcacggcaagtgcgtcaagataactcccgccaaggcagaaagcataaaacattacaagtgcccgagctgcagctccaagagggctaggcagtagcaaagcttatggatgcttcagaatgccggatgtatgctgcagtggttgccttgcaaagtttaccggcaggagaatgcttactttacctatgatgaagctaatgtgaggaaatttgagacatttgacaaccagaggcacttgagttgaatgcccctagataaatggggtgaaagaagaggaaacctgcgtgctgtattgaatagagcttgtttatgtcacctctacgggtcgttcttttttatgacgaatggcagcagccttgaattcctggctag

SEQ ID NO: 33723 - protein, 243 aa, Panicum virgatum
  misc_feature: Ceres CLONE 1953503
  misc_feature (189)..(239): Pfam Name: PHD Pfam Description: PHD-finger
  misc_feature: SWISSPROT Homolog: EC 1.14.11.27 [Histone H3]-lysine-36 demethylase
  misc_feature: Functional homolog of the protein sequence given in SEQ ID NO 50175
  misc_feature: Useful for making plants with altered lignin content
  misc_feature: Useful for making plants with modulated flowering time
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Functional homolog of the protein sequence given in SEQ ID NO 50174
  misc_feature: Useful for making plants with altered alkaloid content
  misc_feature: The sequence is a functional homolog of SEQ ID NO 1981 in the 11/479,226 US patent application
MGDAASGRGHVVYPPRSAEDIFKDYRARRSAILRALTHDVEDLYAQCDPEKENLCLYGYANEAWEVALPAEEVPTELPEPALGINFARDGMNRRDWLALVAVHSDSWLLSVAFYYAARLNRHDRKRLFGMINELQTVFEVVSGARQQQSKERSIMDNGGRAKPSVKIENNGKASEDAFGEDDSDHGETLCGTCGGIYSADEFWIGCDICERWYHGKCVKITPAKAESIKHYKCPSCSSKRARQ

SEQ ID NO: 33724 - DNA, 697 bp, Panicum virgatum
  misc_feature: Ceres CLONE 1953504
  misc_feature: Encodes the peptide sequence at SEQ ID NO. 33725
aaattcagcagcagcagcagcagacgcctcccttcttccacctcatcaggtagcgacctcgctagctcttgggcgcgggcgagctccagcttctgctgtgcggagatggcgtccagggcggccgtcctagcgctgctgctctcggcgctcgccgcggcggcgtcggcgcagctggacgtcaagttctacagccggtcgtgccccagcgtggaggacgtcgtccggaaggagatggtgcgcgcactcgccgctgcgcccagcctcgccggcccgctcctccggatgcacttccatgactgcttcgtcaggggctgcgacggctcggtcctcctggactccaccccgggcaacacggcggagaaggacgcgaagccgaacctgacgctgcgcggcttcggcctcatcgagcgcgtcaaggccaccgtggaggcggcttgcccggacaccgtctcctgcgccgacgtgctggcgctcatggccagggacgccgtgtggctgagcaagggcccgttctgggcggtgcccctcggccggcgcgacggccgggtgtccatctccaacgagaccgaccagctgccgccgccctcgggcaacttcaccgagctcacccagctcttcgccgccaagagcctcgacaccaaggacctcgtcgttctctccgccggccacaccaatcggcacctcgcactgcttctcc

SEQ ID NO: 33725 - protein, 197 aa, Panicum virgatum
  misc_feature: Ceres CLONE 1953504
  misc_feature (39)..(197): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51272
  misc_feature: Useful for making plants with altered carbohydrate content
  misc_feature: Functional homolog of the protein sequence given in SEQ ID NO 51443
  misc_feature: Useful for making plants with altered cell wall content and/or composition
  misc_feature: Functional homolog of the protein sequence given in SEQ ID NO 50230
  misc_feature: Useful for making plants with modulated nitrogen use efficiency
MASRAAVLALLLSALAAAASAQLDVKFYSRSCPSVEDVVRKEMVRALAAAPSLAGPLLRMHFHDCFVRGCDGSVLLDSTPGNTAEKDAKPNLTLRGFGLIERVKATVEAACPDTVSCADVLALMARDAVWLSKGPFWAVPLGRRDGRVSISNETDQLPPPSGNFTELTQLFAAKSLDTKDLVVLSAGHTNRHLALLL

SEQ ID NO: 33726 - DNA, 451 bp, Panicum virgatum
  misc_feature: Ceres CLONE 1953504-R
  misc_feature: Encodes the peptide sequence at SEQ ID NO. 33727
ccgcggcaagtgccccagcctcgacgacaacaccacgctggtggagatggacccgggcagcttcaagaccttcgacctcagctactacggccacgtggccaggcgcaggggcctcttccactcggacggcgcgctgctcaccgaccccttcacccgcgcctacgtgctccgccacgccggcggtgcctacagggaggagttcttcgccgacttcgccgcgtccatggtgaagatgggctccgtcgaggttctcaccggcacccagggcgagatcaggaagaagtgcagcgtggtgaactgagtaactgacctgaccgacgatcgatcatcgatggacgactgttagtatgtgcagcaggtgcatcgtcactcagtcagtatgggttcagacttcagacttttggtttcagaagatgtacgacgagttttacctccgtgttcttaatctctc

SEQ ID NO: 33727 - protein, 99 aa, Panicum virgatum
  misc_feature: Ceres CLONE 1953504-R
  misc_feature: SWISSPROT Homolog: EC 1.11.1.7 Peroxidase
  misc_feature: Functional homolog of the protein sequence given in SEQ ID NO 51272
  misc_feature: Useful for making plants with altered carbohydrate content
  misc_feature: Functional homolog of the protein sequence given in SEQ ID NO 50377
  misc_feature: Useful for making plants with altered cell wall content and/or composition
  misc_feature: Functional homolog of the protein sequence given in SEQ ID NO 50564
  misc_feature: Useful for making plants with modulated phosphate use efficiency
  misc_feature: Functional homolog of the protein sequence given in SEQ ID NO 50230
  misc_feature: Useful for making plants with modulated nitrogen use efficiency
RGKCPSLDDNTTLVEMDPGSFKTFDLSYYGHVARRRGLFHSDGALLTDPFTRAYVLRHAGGAYREEFFADFAASMVKMGSVEVLTGTQGEIRKKCSVVN

SEQ ID NO: 33728 - DNA, 1377 bp, Panicum virgatum
  misc_feature: Ceres CLONE 1953511
  misc_feature: Encodes the peptide sequence at SEQ ID NO. 33729
ggagtcctggtcttggttagttcatctcgctcgccacgatactgcaagcagagcagaggaaagaagcgcgccggccccattacgtgcgcacctggagcaaggatgggagcgggaagagaagggaacgcggtggcggcggcggcggcggcggcggcggcggcggtgagggtgctggtggtggacgactcccccgtcgaccggaaggtcgtcgagctgctgctccggaaccacaagggcggcgccgcgccattccacgttaccgcagttgacagcggcaggaaggcgatggagcttatcgggccaaaggggcaagggaagctgggttcatctgatactgacgctaatgagccaactgttgacatcgtgctcactgactactgcatgccggagatgactggttatgaccttctcagggccatcaaggcgttgagctccccgaacccaatcccggtggtcgtaatgtcgtcggagaatgagccccagcggatcagcagatgcttaacagccggtgctgaggatttcatcctcaagcccctcaagtccaaggatgtgcagcgcctgcgcaactgctcaaactctgccaagccaaaggacgcagttgacgctcagtgcaagagctttagcagcaggaggaagatgccctccgatcaaattgccaagaaggccacgtcggaacagagatcacaaattgcaagactagccatggtgctgaatgcctccagcatcgagttgtcacactacttccagttccttttcaagttcatcctgattgcgtacgcggtgctgtgcttgggtgagctcctccacagatggtccaacggctccttcctctccctgtggtcatcctgagactgaaaaccaagcagtatgagtgtaactaaggttgcaagcttttaatttaattttccttgtaattcaggcatgaggagctagttcctcctcggcattgctccctatatttcagttttcagcagctgttcctaggtagattattgtttgcttggaggtcctaacagcgcgcggttcgggttaatctagctccggttctttgagcgtcgcttctcctgggagaagatcagaagaaccgcgacaaaaaaaaatgtggtgatatccccttttgttgattgtataagttgcttgatttgagagggtatctagtgtcgttgttaatggagatctcggcttgatctgctgatgcaactgcccatggacagcttctctaccatttcttatggtgggtggacgcagacattcacctgctctgaacctcacactgcattagtagagtgaaacaacatgagttgaccgggatatgacgctgtaatcatcttaggggaaatggtaatgaatacaatcacatcagtacaatctttgtgc

SEQ ID NO: 33729 - protein, 248 aa, Panicum virgatum
  misc_feature: Ceres CLONE 1953511
  misc_feature (21)..(154): Pfam Name: Response_reg Pfam Description: Response regulator receiver domain
  misc_feature: SWISSPROT Homolog: EC 3.1.1.61 Protein-glutamate methylesterase
MGAGREGNAVAAAAAAAAAAVRVLVVDDSPVDRKVVELLLRNHKGGAAPFHVTAVDSGRKAMELIGPKGQGKLGSSDTDANEPTVDIVLTDYCMPEMTGYDLLRAIKALSSPNPIPVVVMSSENEPQRISRCLTAGAEDFILKPLKSKDVQRLRNCSNSAKPKDAVDAQCKSFSSRRKMPSDQIAKKATSEQRSQIARLAMVLNASSIELSHYFQFLFKFILIAYAVLCLGELLHRWSNGSFLSLWSS

SEQ ID NO: 33730 - DNA, 1288 bp, Panicum virgatum
  misc_feature: Ceres CLONE 1953516
  misc_feature: Encodes the peptide sequence at SEQ ID NO. 33731
gcgacccgagtccaaaccaccgcacccagccccagcgccgagccgcaccgcttcctccgccgccgcctctcccgcccgcacgccggcgcccgaccgcgcggaggcgagcatgcatcacgaccccaaccccttcgacgagggcagcgccgacgacggccccttctccaatggaggaggcggaggcggaggcggcaagcagcagtatgggttccggccgaccgagcccgtcggcttcgggagcgccggcaggggcgacgccgtcgccgacgtccctctcgataacatgggggaatcaaagggtaaggcgagggagctctcgtcgtgggaatcagatctgaagaggcgagaggcggatatcaagagaagggaggaggcgctgaagaatgctggagtgccgatggaggagaagaactggcctccattcttcccgatcatccaccatgatattgccaatgagataccagccaatgtgcagaggctgcagtatcttgcatttgcaagctggcttggaattgtgctttgcctgtcgtggaatttcattgctgttatagtctgctggatcaaggagggagattcaaaattgtttttccttgcgactatctatgctttgcttggaattcctctgtcatatttgatatggtacaggcccctctatcgtgcaatgaggacaaacagtgctttcagttttggatggtttttcctctgttacctgatacacattggtttttgcataattgctgccattgctccacccattgtatttcatgggaaatcattaaccggtatactggctgcgatcgacaccttctctgagcatatcataattgggatcttctactttgtggggtttgggctgttctgtttggagacgctgctgagcattgcagttcttcagagagtgtacatgtacttcagagggaacaagtgatgccagccatgattgaaaactacatttgtccaaaaataatgtggtggagaattgcttatgcatgctagtagcacctgttcgtgtgacggttttgtgcatacctgtcaagtacaccttgagtctatcgttttgtatgtcagtggtggtgcttttttaagctggtatggagtaggatggtagccctgtcattataggttggcttgcggaacggggggtgttttatttcttcattagctatgcccatatttcaacttgttagtgtagtatttgccatgttggcgaccgttatgggcttatggcacgcagtactatattattcttgaaatgcagaagaggaactgccctatgggctgatttctt

SEQ ID NO: 33731 - protein, 272 aa, Panicum virgatum
  misc_feature: Ceres CLONE 1953516
  misc_feature (98)..(272): Pfam Name: SCAMP Pfam Description: SCAMP family
  misc_feature: Functional homolog of the protein sequence given in SEQ ID NO 50850
  misc_feature: Useful for biocontainment applications
MHHDPNPFDEGSADDGPFSNGGGGGGGGKQQYGFRPTEPVGFGSAGRGDAVADVPLDNMGESKGKARELSSWESDLKRREADIKRREEALKNAGVPMEEKNWPPFFPIIHHDIANEIPANVQRLQYLAFASWLGIVLCLSWNFIAVIVCWIKEGDSKLFFLATIYALLGIPLSYLIWYRPLYRAMRTNSAFSFGWFFLCYLIHIGFCIIAAIAPPIVFHGKSLTGILAAIDTFSEHIIIGIFYFVGFGLFCLETLLSIAVLQRVYMYFRGNK

SEQ ID NO: 33732 - DNA, 354 bp, Panicum virgatum
  misc_feature: Ceres CLONE 1953533
  misc_feature: Encodes the peptide sequence at SEQ ID NO. 33733
acaagcagcaacgagccttcttcctgatcccaactccatcgagcaagctcgtcgtcgatctctctaactcgaagccccatcagtaacatgtcggacaagtgcagcaactgcgactgcgctgacaggagccagtgcacgaagggcaacagctatggcgtcgtcgtagtcgacaccgagagccgcgtcgagcgccgcgaggaggaggtcgccgagcttgctccttttgatccgaccaagaaaaagaagaagaagaaggttgtgatccaagacccgtctgatgaagtggataagttggctgataagacagagagtttggcagtttctgagtctagtgagccaagctttgcaggaatg

SEQ ID NO: 33733 - protein, 88 aa, Panicum virgatum
  misc_feature: Ceres CLONE 1953533
  misc_feature: Functional homolog of the protein sequence given in SEQ ID NO 50873
  misc_feature: Useful for making plants with modulated nitrogen use efficiency
MSDKCSNCDCADRSQCTKGNSYGVVVVDTESRVERREEEVAELAPFDPTKKKKKKKVVIQDPSDEVDKLADKTESLAVSESSEPSFAG

SEQ ID NO: 33734 - DNA, 586 bp, Panicum virgatum
  misc_feature: Ceres CLONE 1953544-R
  misc_feature: Encodes the peptide sequence at SEQ ID NO. 33735
ccctcgagaggataacgccgccggatgccgcgcagaccgtgctcatcttcgccgccgggacggggatcagtactattcgttcacttgtcgagtttggttttggtgccaacgaaagagcggatgtgagactttattatggtgccagaagtctgaagactatggcatatcaggataggtttaagaattgggagtcagcaggacttaaaataatcccagtcctatcacaaccggatgatagttggaaaggtgaacgtggatacgctcagcacgctttcttgagagccaagaacatagtaaatccatcttctacgggagcagtgctatgtggacagaggcaaatgcaagaggaagtcacgacggcccttgttgcggacggtgtatcacaggataaaattttgaccaacttctagaaaccatcgccggcctcctgtattgtactgctattcatttggcctcgttttgtaaattttattcttagacctcactgccatgttccatgaatatatatatcaacctaacgtcagagaggaacaaggcccaactattttttttgttttattcgttgaatgtattagcagagtatgtc

SEQ ID NO: 33735 - protein, 135 aa, Panicum virgatum
  misc_feature: Ceres CLONE 1953544-R
  misc_feature (14)..(119): Pfam Name: NAD_binding_1 Pfam Description: Oxidoreductase NAD-binding domain
  misc_feature: SWISSPROT Homolog: EC 1.18.1.3 Ferredoxin--NAD(+) reductase
LERITPPDAAQTVLIFAAGTGISTIRSLVEFGFGANERADVRLYYGARSLKTMAYQDRFKNWESAGLKIIPVLSQPDDSWKGERGYAQHAFLRAKNIVNPSSTGAVLCGQRQMQEEVTTALVADGVSQDKILTNF

SEQ ID NO: 33736 - DNA, 426 bp, Panicum virgatum
  misc_feature: Ceres CLONE 1953544
atctacctttcgcgctcggccggatttgccctggtcttcctctcctccctttccctatctccccccatacccgtcgaggaggccgccgagaccgagatctccacgacgccagggacgccccgcgacccgctcaacctccgcccctccccctcttctcccgccgacctagtcaggcccgtgctcccccctctcggccgccgccgccgccctggccccaaccccctccgactccttccacatcacgcacaacgtgtggagtccgggacacgccctacgctgcgcgccaagcgcgtcgcccaagggtgacatcgacccggacaacgctatccccctgtactggtcggcgatcaccgacggctaccgcgtgcacgacccctgcgctcaaggacatgtgccccgcgatgaagcagcagaaccgcaccgagg

SEQ ID NO: 33737 - DNA, 614 bp, Panicum virgatum
  misc_feature: Ceres CLONE 1953552
  misc_feature: Encodes the peptide sequence at SEQ ID NO. 33738
aactttcctccacccctctcgagactcgccgagctcgagactctgcgtgctaatggcggcggcggcggacctcacggggaccaagcgggtcatggcctacgcgctatgcaagcacctcaacgtagatcccagcactgtatcaagtattgaagagagtgatattgcaagcctgttttcacatattgtgaaatcatctcaggatgaggtgatgaagtgggtaaaattttccagtgattttgctgggagcgatggaaaacagcatgcgttgcttgataatctgaatcaggatttgtcccaaaaatctgtagtgcttggtgatggtcttaaaccatcagttgctgatattgtggtgtttgctactgttcaatctttcgtgacttgtgtcagcgacagtgagttacagaaatttcctcatgtattgcggtggatggactacattcagaacattgttgattttggtacaacttcacaaaagataaatgtggccaaatctgtctttgctccaccttctcatccgaagaaagctgataaaggagacactgaatcaagttcaaagaaagctgtttccggacagaagattgctgacaagtcaaatggaagtgctgactccaaga

SEQ ID NO: 33738 - protein, 187 aa, Panicum virgatum
  misc_feature: Ceres CLONE 1953552
  misc_feature: SWISSPROT Homolog: EC 2.5.1.18 Glutathione transferase
MAAAADLTGTKRVMAYALCKHLNVDPSTVSSIEESDIASLFSHIVKSSQDEVMKWVKFSSDFAGSDGKQHALLDNLNQDLSQKSVVLGDGLKPSVADIVVFATVQSFVTCVSDSELQKFPHVLRWMDYIQNIVDFGTTSQKINVAKSVFAPPSHPKKADKGDTESSSKKAVSGQKIADKSNGSADSK

SEQ ID NO: 33739 - DNA, 641 bp, Panicum virgatum
  misc_feature: Ceres CLONE 1953552-R
  misc_feature: Encodes the peptide sequence at SEQ ID NO. 33740
gtccaatgccagactctcaagtataacatgaagtcaagggctggcagaggctttactcttgaggagctgaaggctgcgggcattccgaagaagcttgctccaaccattggcatttctgtggatcaccgccgcaagaacaaatcacttgagggacttcaggctaatgtccagaggctgaagacatacaaggccaagctggttatcttcccaaggcgtgctcgcaaggtcaaggctggtgactctactcccgaggagcttgccagcgccacccaggtccagggtgactacatgcctattactcgtggtgagaagcgctcggttgaggttgtgaaggtcagcgatgagatgaagtcattcgcagcctatggcaagatccgccttgagaggatgaacaagaagcaccttggtgcccgccagaagaaggccgctgaggcagagaaggaagagaagaagtaaagcggccagatattggatatagtatcttctagttgatgctacagcgaagggcttgctctaagttctttttgctgctgaaaatagagaccagccgattgttttggtgtccttgtactgtttgatacctggtactcatttgcgatactctattatctaatggttcatcggacacttgccctctcctc

SEQ ID NO: 33740 - protein, 151 aa, Panicum virgatum
  misc_feature: Ceres CLONE 1953552-R
  misc_feature (1)..(128): Pfam Name: Ribosomal_L13e Pfam Description: Ribosomal protein L13e
  misc_feature: Functional homolog of the protein sequence given in SEQ ID NO 50165
  misc_feature: Useful for making plants with modulated nitrogen use efficiency
  misc_feature: Functional homolog of the protein sequence given in SEQ ID NO 50166
  misc_feature: Useful for making plants with modulated phosphate use efficiency
VQCQTLKYNMKSRAGRGFTLEELKAAGIPKKLAPTIGISVDHRRKNKSLEGLQANVQRLKTYKAKLVIFPRRARKVKAGDSTPEELASATQVQGDYMPITRGEKRSVEVVKVSDEMKSFAAYGKIRLERMNKKHLGARQKKAAEAEKEEKK

SEQ ID NO: 33741 - DNA, 1256 bp, Panicum virgatum
  misc_feature: Ceres CLONE 1953559
  misc_feature: Encodes the peptide sequence at SEQ ID NO. 33742
accgagtgacacacagagagacatcagatttgcgttgtctcccgtgcagccgagtggttcagtgctagctagctagctgttgggacctgggcgtgctcccctggaccgggaaggacaccaccccttctcttccatctctgttcgcctccatttgggtttcaggccaaagagaggccaagttcatagccaaagggagctgaattcaagggggctgcgccgagatggagcacatcgcgaggttcttcttcggagtttccgggaatgtcattgcgctcttcctcttcctgtcgcctgtcgtcaccttctggaggatcatcaagaagcgctcgacggaggacttctccggcgtgccctacaacatgacgctgctcaactgcctcctatcggcttggtacgggctgccgttcgtgtccccgaacaacatcctggtgacgacgatcaacgggacggggtcgctgatcgaggccatctacgtggtgatcttcctcatcttcgcggagcggcggatccggctgcggatgctgggcctgctgggcgtcgtcacctccatcttcgccgcggtggtgctcatctcgctgctggccctccacggcaacggccgcaagatcttctgcggcctcgccgccaccgtcttctccatctgcatgtacgcctcgccgctctccatcatgaggctggtgatcaagaccaagagcgtggagttcatgccgttcctgctctccctgtccgtgttcctctgcggcacctcctggttcatctacggcctcctcggccgcgaccccttcatcatcatccccaacgggtgcgggagcttcctgggcctggcgcagctgatcctgtacgccatctaccggaacaacaagggcgccgccgcgccggccggcaagggggaggccgccgcggaggtggaggacgcgaagaaggtggccgccacagtagagctggccgacgccacgaccaacaaggtcgccagctaggtgtagactgcgggctctgtacccaaggcttgctggtgcctgcaggttgggaggaggtggtggtggtggtgtcaggcagcctgaaaagctaggccgcctaatggacgaattagtttgctgctgatgaagaagattgttgttgctttctttgccttgcgctgtcattctaatctcgatctctccctaaaaatgtaccttctgggagagctatgacacagggttatcaaagtcgtgtctctgcaagtgtgaagttttccttttgtttcccaatggttttct

SEQ ID NO: 33742 - protein, 251 aa, Panicum virgatum
  misc_feature: Ceres CLONE 1953559
  misc_feature (129)..(215): Pfam Name: MtN3_slv Pfam Description: MtN3/saliva family
  misc_feature (7)..(96): Pfam Name: MtN3_slv Pfam Description: MtN3/saliva family
MEHIARFFFGVSGNVIALFLFLSPVVTFWRIIKKRSTEDFSGVPYNMTLLNCLLSAWYGLPFVSPNNILVTTINGTGSLIEAIYVVIFLIFAERRIRLRMLGLLGVVTSIFAAVVLISLLALHGNGRKIFCGLAATVFSICMYASPLSIMRLVIKTKSVEFMPFLLSLSVFLCGTSWFIYGLLGRDPFIIIPNGCGSFLGLAQLILYAIYRNNKGAAAPAGKGEAAAEVEDAKKVAATVELADATTNKVAS

SEQ ID NO: 33743 - DNA, 1200 bp, Panicum virgatum
  misc_feature: Ceres CLONE 1953584
  misc_feature: Encodes the peptide sequence at SEQ ID NO. 33744
aggtcaaaaaacatgaagactcgtgtcattggctgcccaaagactattgatggagatctgaaatgtaaggaggttcccacaagctttggatttgatactgcttgcaagatatactctgaaatgatcggcaatgtcatgactgatgcaaggtcaactggaaaatactaccactttgtgaggcttatggggcgtgccgcttctcacattacattggagtgtgctttgcaaacacatcctaatgctgcactcattggtgaagaggttgctgcaaagaagcaaactctcaagaatgtcacagactaccttacagatattatctgcaagcgtgcagatcttggttacaactatggtgttatccttataccagagggcctgattgatttcatcccagaggttcaaaaactcattgcggaattgaatgaaattttggcacatgatgttgttgatgaggcaggggcttggaaaagcaagcttgagccagaatccaggcagctgtttgactttttgcccaaaaccattcaggagcaacttttgcttgaaagggatcctcatggcaatgttcaggttgcaaaaattgaaaccgagaaaatgcttattaccatggttgaaactgaattggagaagagaaaagctgaggggagataccatgcaagcttcagaggacaatctcacttctttggatatgaagggagatgcggtcttcctactaattttggttctagctattgctatgcattgggctatggatctggtgcccttctccaaagtgggaagacaggacttattacctcggttggcaacctcgccgctcctgttgaagaatggactgttggtggaactgctttgacttcattgatggatgttgagaggaggcatggcaagttcaagccagtgatcaagaaggctatggtggaacttgatggtgcacctttcaagaagtttgcatcaatgcgaaatgagtgggccatcaagaacagatacatcagccctggccccatccagttcagcggacctggaagcgacgattcgaaccacactttgatgctggaacttggcgcacaggcttagagatgcgtcgatgtggcctgcgccttcaattctttttgctcttacagttttggaagcggagactggagctcctctagagcagcctgcagtctccattttgtgaaatgtcaaaaaataagagatttttaccgg

SEQ ID NO: 33744 - protein, 355 aa, Panicum virgatum
  misc_feature: Ceres CLONE 1953584
  misc_feature: SWISSPROT Homolog: EC 2.7.1.90 Diphosphate--fructose-6-phosphate 1-phosphotransferase
RSKNMKTRVIGCPKTIDGDLKCKEVPTSFGFDTACKIYSEMIGNVMTDARSTGKYYHFVRLMGRAASHITLECALQTHPNAALIGEEVAAKKQTLKNVTDYLTDIICKRADLGYNYGVILIPEGLIDFIPEVQKLIAELNEILAHDVVDEAGAWKSKLEPESRQLFDFLPKTIQEQLLLERDPHGNVQVAKIETEKMLITMVETELEKRKAEGRYHASFRGQSHFFGYEGRCGLPTNFGSSYCYALGYGSGALLQSGKTGLITSVGNLAAPVEEWTVGGTALTSLMDVERRHGKFKPVIKKAMVELDGAPFKKFASMRNEWAIKNRYISPGPIQFSGPGSDDSNHTLMLELGAQA

SEQ ID NO: 33745 - DNA, 643 bp, Panicum virgatum
  misc_feature: Ceres CLONE 1953586
  misc_feature: Encodes the peptide sequence at SEQ ID NO. 33746
aaatacacctcctccctccgtccactccctcgccgccccgtctcctccctcttctcttcacttctcctctcctcggccacaccgccacaccgtcgcctcgctgctgcctgctgccagctgctgctgccagcgcggcgcgggcgggatgaaggtcaccgtcgtgtcccggagcggccgggaggtcgtcaagggcggcatcgacctcaaggaatcggccaaggtcgcggatctgcaggaggccatccacgccaggactaagaagtattatccttctaggcagcggctcaccctccctcttcaacctggaaaaagtggaaagccagttgttctcagtccaaaggccagcctgtcagaatactgtgagaagggttctgggtcactgacagtagtcttcaaagatttaagcccgcaagtctactacagcacgctgttcttctttgagtacttgggtcctcttatcatctaccccatgttctattatttgcccgtctataaattcttcaggtatgagggagaacgggtcatccaccctgtccagacctatgccatgtactactggtgcttccactacttaaagaggatcatggagacgttcttcgtgcaccgatttagccatgctacatcacctttgtcaaatgtcttc

SEQ ID NO: 33746 - protein, 165 aa, Panicum virgatum
  misc_feature: Ceres CLONE 1953586
  misc_feature: SWISSPROT Homolog: EC 1.3.1.38 Trans-2-enoyl-CoA reductase (NADPH)
MKVTVVSRSGREVVKGGIDLKESAKVADLQEAIHARTKKYYPSRQRLTLPLQPGKSGKPVVLSPKASLSEYCEKGSGSLTVVFKDLSPQVYYSTLFFFEYLGPLIIYPMFYYLPVYKFFRYEGERVIHPVQTYAMYYWCFHYLKRIMETFFVHRFSHATSPLSNV

SEQ ID NO: 33747 - DNA, 578 bp, Panicum virgatum
  misc_feature: Ceres CLONE 1953586-R
tgtgacctgcgccaactataccaccgagatctatcagtgggtcgggttcaacattgccacacagactgtggctggctacatcttccttgtcgtggcagcaagcatcatgaccaactgggcgctaggcaagcacaaccgcttgaagaagctgtttgatggcaaggacgggaggcccaagtatcctcgccgctgggtgattctccctccgttcctgtgaagaggtggtgattgcggctggcctgtcacagttctacgtaccagccttcagaagttccaagacatgatatcatgcaaacatttgtactaattgtgccttagtaccagttgaaccttgatcacgaagtctgaatttctaatccgaaagatggatgttaaatttttctttggcttcttttgaaatgtcatgtgctcctgtcgtagtgcaatcgaaggttcatctgctgtcatatttgtcgcccctatttgtccaagcataagtaactgcaaacataacttcctattggcgcttgctgttgctgtcctatcatcctgcatatatgtcatccttggtactggaatcgagctacttccattttttc

SEQ ID NO: 33748 - DNA, 375 bp, Panicum virgatum
  misc_feature: Ceres CLONE 1953617
  misc_feature: Encodes the peptide sequence at SEQ ID NO. 33749
acccaagcaacacatcatcagcacaaagactagggcaagaaagatacacagtgagtgaacaagagagaccctaaagaggccgctgcttctccggaccgccaagcacaaattgatgatccactttgatcaattgcagcttccgcttggccggccgatcaccgatcgccatgggagtgccggtgaggagagagaggcacccggaggccgacctgaacctgccgccggggttccggttccacccaaccgactacaagctggaggagcactacctgcgccggaaggcggcggagcagcgcctcccggtacccatcatcacggaagtggacctgcactacctcgacccctgggacctgccagaacccacgctgttccgca

SEQ ID NO: 33749 - protein, 69 aa, Panicum virgatum
  misc_feature: Ceres CLONE 1953617
  misc_feature (17)..(69): Pfam Name: NAM Pfam Description: No apical meristem (NAM) protein
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: The sequence is a functional homolog of SEQ ID NO 854 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Functional homolog of the protein sequence given in SEQ ID NO 50322
  misc_feature: Useful for making plants with modulated oxidative stress sensitivity
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: Functional homolog of the protein sequence given in SEQ ID NO 50323
  misc_feature: Useful for making plants with altered cell wall content and/or composition
  misc_feature: Useful for making plants with altered lignin content
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: Functional homolog of the protein sequence given in SEQ ID NO 50324
  misc_feature: Useful for making plants with altered terpenoid content
  misc_feature: The sequence is a functional homolog of SEQ ID NO 890 in the 10/374,780 US patent application
  misc_feature: The sequence is a functional homolog of SEQ ID NO 851 in the 10/374,780 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Functional homolog of the protein sequence given in SEQ ID NO 50906
  misc_feature: Useful for making plants with modulated water use efficiency
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: Functional homolog of the protein sequence given in SEQ ID NO 50845
  misc_feature: Useful for making plants with altered alkaloid content
  misc_feature: Functional homolog of the protein sequence given in SEQ ID NO 50641
  misc_feature: Useful for making plants with altered carbohydrate content
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Functional homolog of the protein sequence given in SEQ ID NO 50327
  misc_feature: Useful for making plants with modulated light quality sensitivity
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 612 in the 11/435,388 US patent application
  misc_feature: The sequence is a functional homolog of SEQ ID NO 2694 in the 10/374,780 US patent application
  misc_feature: The sequence is a functional homolog of SEQ ID NO 662 in the 10/225,066 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 852 in the 10/374,780 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
MGVPVRRERHPEADLNLPPGFRFHPTDYKLEEHYLRRKAAEQRLPVPIITEVDLHYLDPWDLPEPTLFR

SEQ ID NO: 33750 - DNA, 475 bp, Panicum virgatum
  misc_feature: Ceres CLONE 1953617-R
  misc_feature: Encodes the peptide sequence at SEQ ID NO. 33751
tttggggccaataatgtaggaagcccaactcttgatggactggttcatgagggtgaatttcagaggcaggcagcgagatgaaaatgattggcgtgagatctttatgaaagccggcttctcagactataagattgttaagaaaataggagctcgtggtgtcatggaagtttacccgtaaattatgcccaatgtgtggttcagtatttaatggtccatgagctgcagtgaggatataaataaacgtagtgcctcatttcctatgtgctgtggggacataaataaacggagcgcctcatttccaagataaagtttgatgggatctgaaagcagatgagctgtccagctttctggcctttagatccacatgtagctgctgtttgcaatgtactagagcactctttgtggttggtttccagcagtcaagtatgtatgttggtttgactttgatcatatatatattggattgttgtttgtc

SEQ ID NO: 33751 - protein, 47 aa, Panicum virgatum
  misc_feature: Ceres CLONE 1953617-R
  misc_feature: SWISSPROT Homolog: EC 2.1.1.150 Isoflavone 7-O-methyltransferase
MDWFMRVNFRGRQRDENDWREIFMKAGFSDYKIVKKIGARGVMEVYP

SEQ ID NO: 33752 - DNA, 724 bp, Panicum virgatum
  misc_feature: Ceres CLONE 1953621
  misc_feature: Encodes the peptide sequence at SEQ ID NO. 33753
cttcacctctctcgctcgcctcccgtccgtctgtctccattctccaccagccagccaccgagccaagcaaccgcccggcccccgcgcccccccgtacgcctcgcgccggcgagcgaatgccgcgggagcactagccctcggcccccctggcccggggccggcgcgcccgacacgaaccgacccatgaggaagctgccgccggcgcaccggctccggtggatgcgcgcgctgctcctcgcgctcccgctcctctcgctccccatcctctacgcggcgcgctcctcgccgccggggcggccgccgcagcagcagcagcggcggaggctgccgccgaggctggcgtacctcatcacgggcgccggccccggggacggcccgcggatccggaggctgctgcgggcgctctaccacccctggaactgctacctcgtcggggtggccggggaggacgaccgcgcggatctcgaggccttcgtgcgcggccaggaggcgccgcgccggtacggcaacgtgcgggtggcggacgcgggggagtggggcgccgtctcgcggaggggccccaccgagctggccgccacgctccacgccgccgccgtgctgctcagggagttcgagggctggagctggttcatcaacctcagcgcctccgattacccgctcatgccccaggatgacatccttcatatcttctcatatattccaagagatctgaaattttattgat

SEQ ID NO: 33753 - protein, 179 aa, Panicum virgatum
  misc_feature: Ceres CLONE 1953621
  misc_feature (52)..(179): Pfam Name: Branch Pfam Description: Core-2/I-Branching enzyme
  misc_feature: SWISSPROT Homolog: EC 2.4.2.26 Protein xylosyltransferase
MRKLPPAHRLRWMRALLLALPLLSLPILYAARSSPPGRPPQQQQRRRLPPRLAYLITGAGPGDGPRIRRLLRALYHPWNCYLVGVAGEDDRADLEAFVRGQEAPRRYGNVRVADAGEWGAVSRRGPTELAATLHAAAVLLREFEGWSWFINLSASDYPLMPQDDILHIFSYIPRDLKFY

SEQ ID NO: 33754 - DNA, 652 bp, Panicum virgatum
  misc_feature: Ceres CLONE 1953621-R
  misc_feature: Encodes the peptide sequence at SEQ ID NO. 33755
ggcagggccaattattgtagatccagcactgcaggtcccaaataaaaccgaggttataacaacaaaggagaaaaggagtctgccatccgctttcaaaatatttgtaggttcatcttgggttgtacttagccgatcgttcttggagttttgcttattgggatgggacaaccttcctcgcacattactgatgtatttcaccaactttctctcatcctcagaaggctacttccacacagtgatctgcaactcagagtactaccagaataccaccatcaacagtgatctgcgtttcatggcatgggataacccccctcggatgcaccctgttaacctcacaacagagcatttcgactcaatggcaaacagtggggcgccttttgtgcactccttcacaaatgacagccctgtcctggatatgattgacaccaagctgttggggcgagcacctgaccgcttcaccccgggtggatggtgcttgggtagctcggtaggtgggaaagatccatgtaccttcattggaaggtcctttgtgctcaggccgaccaaaggctcggccaagctagaggagttgctgttgaaacttttggaacatgataacttcaggcctaaacagtgtaaataacattcattttacatggtagccagtttttat

SEQ ID NO: 33755 - protein, 206 aa, Panicum virgatum
  misc_feature: Ceres CLONE 1953621-R
  misc_feature: SWISSPROT Homolog: EC 2.4.2.26 Protein xylosyltransferase
AGPIIVDPALQVPNKTEVITTKEKRSLPSAFKIFVGSSWVVLSRSFLEFCLLGWDNLPRTLLMYFTNFLSSSEGYFHTVICNSEYYQNTTINSDLRFMAWDNPPRMHPVNLTTEHFDSMANSGAPFVHSFTNDSPVLDMIDTKLLGRAPDRFTPGGWCLGSSVGGKDPCTFIGRSFVLRPTKGSAKLEELLLKLLEHDNFRPKQCK

SEQ ID NO: 33756 - DNA, 1070 bp, Panicum virgatum
  misc_feature: Ceres CLONE 1953645
  misc_feature: Encodes the peptide sequence at SEQ ID NO. 33757
cctaaccagcaacaaccgcccacaccgccgccgccggtgaccggcgacggcgatccctatgggcgcgtcggcctccgtcctctcgctcccagtggccgccgcgctccccgcagccgccaccgccgtcgccggggccgcaggctgcttcgcgctgggctacctcctcgccctctcccgccacgccgcggccgtcgaccccgacggcggctccgatgacgattacgaggacgactcggaagaagatgatgacgaaaactccggcggcagccgtgccgcgaagcgagcgggcggtcagaagaggaccgggctccggctgctcttctgggcgcggaacgtggtgaccaagtccgactccgcaagggaagcgaagagggcgcaggcgcaggctgccgtcagccccctggagatcgagaacctcgccgatattatagaagatttcaagatggtgctggtcgtcaggaatgatttgaagatggggaaggggaaaatcgctgcacaatgcagccatgcaactcttggcctgttcaaaaaactccaacagagagcaccaaaatcgctaagaaggtgggaacggtgtgggcaagttaaagtggttgtaaaaatagagagcgaggaagatatgcttgttttacaagggagagcaaagtctttgaatctgccaactcacataaccatagacgctggaagaacacagattgctccaaattcaagaacagtcatggctattcttggaccagcagatatggtcgatgatgtgactggtggtctgaagctattgtaaacttcaccttatcagcattcacaagcacccaacatgtatgtttggtgtgcatgaatttacaatccacattggactggcacttcactaatctgctgttgaagaatgaatctcgacctcattggttgactaaatcttgtctgtggatttgttcgaaaggaggttgcttcttttttaattgtatcaagtgttgtctttggagctctgatttcagttttgttttggtgtcgagaacatacagaccattgtttcttctgcaacatagattaaaaaaaaaggctcggcttgcccc

SEQ ID NO: 33757 - protein, 240 aa, Panicum virgatum
  misc_feature: Ceres CLONE 1953645
  misc_feature (136)..(228): Pfam Name: PTH2 Pfam Description: Peptidyl-tRNA hydrolase PTH2
  misc_feature: SWISSPROT Homolog: EC 3.1.1.29 Aminoacyl-tRNA hydrolase
MGASASVLSLPVAAALPAAATAVAGAAGCFALGYLLALSRHAAAVDPDGGSDDDYEDDSEEDDDENSGGSRAAKRAGGQKRTGLRLLFWARNVVTKSDSAREAKRAQAQAAVSPLEIENLADIIEDFKMVLVVRNDLKMGKGKIAAQCSHATLGLFKKLQQRAPKSLRRWERCGQVKVVVKIESEEDMLVLQGRAKSLNLPTHITIDAGRTQIAPNSRTVMAILGPADMVDDVTGGLKLL

SEQ ID NO: 33758 - DNA, 652 bp, Panicum virgatum
  misc_feature: Ceres CLONE 1953652
  misc_feature: Encodes the peptide sequence at SEQ ID NO. 33759
ggaagtcctgaactccctccaggttcatctccttccccactttcccttctctcggactctctcctcccttgctcctcctttcctaccggcgacgactgggcgagcggcgccgccatttgtcacgtcttcccccagccctttgccggcgacgcgcatcctccaggtaattttcttttctgtatagcacagacaagatggtcaatgcgatcaaggggctgttcatctcctgtgatatacctatggcacagttccttgttaatctgaatgcctcaatgccggcatcagagaggttcatcgtgcacatgcttgatcctacacacatgtttgttcagcctcatgtggcagaaatgatcagaagcaagataggggagttcagggaccagaacagctacgagaagccgcagtgaaggatcagcccacctcgcagtttgcattgtttcccctccctcccaaagatgcataccttgcactcaattctgcggaactgctatagaatggatcacccgtaatgatctagaataatatgtatgtatccgtgtttttagtatcagaagctgctgtattccagtagcttatttgtatccggatcgatccttttacctggccctttgccacttggcaacgctgataaattgaagtgcagctggttgcc

SEQ ID NO: 33759 - protein, 70 aa, Panicum virgatum
  misc_feature: Ceres CLONE 1953652
  misc_feature (1)..(70): Pfam Name: Tbf5 Pfam Description: Transcription factor TFIIH complex subunit Tfb5
MVNAIKGLFISCDIPMAQFLVNLNASMPASERFIVHMLDPTHMFVQPHVAEMIRSKIGEFRDQNSYEKPQ

SEQ ID NO: 33760 - DNA, 1287 bp, Panicum virgatum
  misc_feature: Ceres CLONE 1953658
  misc_feature: Encodes the peptide sequence at SEQ ID NO. 33761
gatctccaccaccccccctcccccacacacacccaacccaacccaacccaaaaaccccaaccgcgtcggccgtcggctacagctttaccctcgcgcctcgcttcagcccggttccgcgctcaaggatcgatcggctgagataagacatgggtcagattttgggtttagtgcaagttgatcagtcaactgtagccatcaaagaaacttttggcaagttcaatgaggtcctggagcctggttgccactttctaccctggtgcatagggcagcagattgctggttacctctccttgcgtgtgcggcagctggatgtccgctgtgaaacaaagacaaaggacaatgtctttgtcactgttgttgcatctgtccaatatcgcgctcttgctgataaggcatccgatgccttctacaagctgagcaacaccagggaacaaattcagtcatatgtatttgatgtcattagagctactgttccaaagctggacctggacgatgcatttgagcagaagaatgatattgcaaaagctgttgaagatgagcttgaaaaggcaatgtctacatatggctatgagatcgtgcaaacgctcattgttgatattgagcctgatgaccgtgtcaagagagcaatgaacgagatcaatgcagctgctaggatgagggtggcagccagtgagaaagctgaggccgagaagatactccagatcaagaaagccgaaggagaggctgaatccaagtacctggctggtgtgggtattgcaaggcagcgtcaggccattgtggacgggctgagggacagtgtgctcgccttctcagagaatgtccctggcaccactgccaaggacatcatggacatggtcctggtcacccagtacttcgacaccatgaaggagattggagcctcatccaagtcctcttcagtgttcatcccccatggtcctggagctgtcaaagatgtggcggcgcagataagagatggcctcctgcaggccaatctgcagtgagagggctctgagggggaaaagaagattgcttttgattgcaaagcagtgtcgacggcatctgttatatggtgctatgaagttgtgaattatatgatatagatagacttgcatggtttgtgaaatgttagtaggctttatatcgactggagcacttgcgagtgagcctagatatccaaacctgtcatagtgtcagttattttggtgacctcctactatgctatatatttgtgtggaaagtccatctggataggactcagagctattaattgaaagtgcagcttctcag

SEQ ID NO: 33761 - protein, 284 aa, Panicum virgatum
  misc_feature: Ceres CLONE 1953658
  misc_feature (8)..(182): Pfam Name: Band_7 Pfam Description: SPFH domain / Band 7 family
MGQILGLVQVDQSTVAIKETFGKFNEVLEPGCHFLPWCIGQQIAGYLSLRVRQLDVRCETKTKDNVFVTVVASVQYRALADKASDAFYKLSNTREQIQSYVFDVIRATVPKLDLDDAFEQKNDIAKAVEDELEKAMSTYGYEIVQTLIVDIEPDDRVKRAMNEINAAARMRVAASEKAEAEKILQIKKAEGEAESKYLAGVGIARQRQAIVDGLRDSVLAFSENVPGTTAKDIMDMVLVTQYFDTMKEIGASSKSSSVFIPHGPGAVKDVAAQIRDGLLQANLQ

SEQ ID NO: 33762 - DNA, 677 bp, Panicum virgatum
  misc_feature: Ceres CLONE 1953670
  misc_feature: Encodes the peptide sequence at SEQ ID NO. 33763
gccaccacagccgcggacccacggttcacgcctcctgcctcccctccctctcctctctccccaacctcgccgcgatccggttgtggatgcagcagcgcggccgctccttcaaccgccggtcccggagcttctcccgcgcccgcctcgccatcgagggatcttaatctcgagggcctcctccccctgaccggtcccctcggttcctgaatttccgcccgaccaacgaacgaacgaacgcgcgcacgcatcgacctgcctgtacgtgatggacgccgccgccgccaacgccgccgctgttgtttctcttaacgggaagatggaggtggaggagaggcatgcacagaagagctactgggaggagcactccaaggacctcaccgtcgaggccatgatgctcgactcccgcgccgccgatctcgacaaggaggagcgccccgagatcctgtctttacttcctccatatgaaggaaaatcagtgctggagcttggtgctggaataggtcgttttaccggagaacttgctaaaacagctgggaatgttcttgctctggattttatcgaaagtgcgattaagaagaatcaaagcatcaatggtcactacaagaacacatcctttatgtgtgctgatgtgacatcccaggacctggtgattcaagctaactcaattgatctgatat

SEQ ID NO: 33763 - protein, 137 aa, Panicum virgatum
  misc_feature: Ceres CLONE 1953670
  misc_feature: SWISSPROT Homolog: EC 2.1.1.103 Phosphoethanolamine N-methyltransferase
  misc_feature: The sequence is a functional homolog of SEQ ID NO 40 in US patent 7151202
MDAAAANAAAVVSLNGKMEVEERHAQKSYWEEHSKDLTVEAMMLDSRAADLDKEERPEILSLLPPYEGKSVLELGAGIGRFTGELAKTAGNVLALDFIESAIKKNQSINGHYKNTSFMCADVTSQDLVIQANSIDLI

SEQ ID NO: 33764 - DNA, 586 bp, Panicum virgatum
  misc_feature: Ceres CLONE 1953670-R
  misc_feature: Encodes the peptide sequence at SEQ ID NO. 33765
acgaccttcatgatgtggaggcttacggacagatgctcaagaatgctggttttcatgatgtcatcgctgaggatcgaactgatcagttcctcagtgttttagagaaggaattagctaaatttgaaaagaacaaggacgatttcctttctgacttctcccaggaggactacgacgatattgtgaacggatggaaggcaaaactgcagaggagctctgcgggtgagcagaggtgggggctgttcatcgcgaccaagtaatgatccagatgtttgtggatgtgcgaataaagtggctccatttgcatgcgacccttcacttgtatttgatgttacattagctattctgaactcagcgagcccgagtcattacccactactgtgtttctttatgcgtggagaaactggtcttgtcttgcgatcctgcaattgcaatatcacgtgctgtatcagggcaacctatctgtgatgtgaatcctgaataaactgcctgcatgtttatgctttctttccctctaatagaagttcggatttgttgtgaaactaccgagtgaaccgaaatgcaatgctgattgtccattgaggagctg

SEQ ID NO: 33765 - protein, 84 aa, Panicum virgatum
  misc_feature: Ceres CLONE 1953670-R
  misc_feature: SWISSPROT Homolog: EC 2.1.1.103 Phosphoethanolamine N-methyltransferase
  misc_feature: The sequence is a functional homolog of SEQ ID NO 40 in US patent 7151202
DLHDVEAYGQMLKNAGFHDVIAEDRTDQFLSVLEKELAKFEKNKDDFLSDFSQEDYDDIVNGWKAKLQRSSAGEQRWGLFIATK

SEQ ID NO: 33766 - DNA, 1183 bp, Panicum virgatum
  misc_feature: Ceres CLONE 1953676
  misc_feature: Encodes the peptide sequence at SEQ ID NO. 33767
gcatctgctcctccactccactccactccactcatctcttctccgaggcgagcgcaaactcgcctcgcttctcgtcaaaccctagcgccccgctcgcccgcgtcgctgccccgccccggatcaagcccgcacagcgcccgagcgtgcgtctccctcccggattcgagcggcgggcggcgggcggcgggatggggtccgactccaaggagctgctcgggatcgagcccctcgagctccggttcccattcgagacaaagaagcagatctcatgctctatgcagctaacgaacagaacggatgactatatcggcttcaaggttaagacgacgagcccgaagaagtactgcgtccgaccaaacagcggcattgtgccaccacggtccaccagcgatgtcattgtgtcaatgcaagcgcaaaaggaggcaccacccgatatgcaatgcaaggacaagtttctcgtgcaaagtgttattgtggctgaaggcacgtcagcaaaggacataactggagatatgtttaccaaaaaatcgggtaatgtggtggatgaggtgaagttgagggttgtctacgtcccaccacccaaaccgccatccccggtgcgtgagggatctgaagaaggctcgtcacctagacattcattgtctgatggaagcaacttgaattatcaagagacaacaagggaatcagatgatccaccatctttggctgctgtaaaagctcaaaaagaccaagaaggctttacctctgagacatctgctttggtttcaaagttgacagaagagaggaactctgccattcagcagaacaataagcttcgacaggaactggaccttgtaaggagggagctccgcaagcagaacggcggtttctcatttgcggtcgtggcggccattgctctcctagggattctgctagggtttatcatgaacagatagatgagctggtgttaatctgcatcttcttagaccgtttccctcgtgagattatattttgtccaatgcatctattcacatgtactacagtgctacagcgctactccatagtccatagcatattcgggatctggtgtcttctgtgattgcgtgcttagtggctacctcacccaggcaacaagcctgtctccttgatcttgtgttagctcttatgtcagcttgtgcaactaagaaactgggtaactattgat

SEQ ID NO: 33767 - protein, 248 aa, Panicum virgatum
  misc_feature: Ceres CLONE 1953676
  misc_feature (8)..(115): Pfam Name: Motile_Sperm Pfam Description: MSP (Major sperm protein) domain
MGSDSKELLGIEPLELRFPFETKKQISCSMQLTNRTDDYIGFKVKTTSPKKYCVRPNSGIVPPRSTSDVIVSMQAQKEAPPDMQCKDKFLVQSVIVAEGTSAKDITGDMFTKKSGNVVDEVKLRVVYVPPPKPPSPVREGSEEGSSPRHSLSDGSNLNYQETTRESDDPPSLAAVKAQKDQEGFTSETSALVSKLTEERNSAIQQNNKLRQELDLVRRELRKQNGGFSFAVVAAIALLGILLGFIMNR

SEQ ID NO: 33768 - DNA, 949 bp, Panicum virgatum
  misc_feature: Ceres CLONE 1953678
  misc_feature: Encodes the peptide sequence at SEQ ID NO. 33769
agccgggctaaacaaaacagacacggggcgctccaccgcgcagaggcggaggaattggaattcaacgagccagcctgccaaatccgagagccccgcggcgagcagggcgcgggcggcgccggtggccggccggatctaggcggggctccggcgacgagggagctcgcgggcgggcgggcgcggggagacgggatggcgtcggaggagatgacggcgacggaggtggcggcgctgctggatctgaagccgcacccggagggcggcttctacgccgagaccttccgcgacggctccgtcacgctctccaccgcccagctcccgccccagtataaagtcgaccgtgctgtgagcactgcaatctacttcttgcttcctgcagggagtgtttcacgtctccaccgcattccctgtgcagaaacctggcacttctacaagggagagcctctcacggtctttgagctacacgatgatggccacattgacctcactgtcatcggcccacacctcgaagccggccagcgcccgcagtacactgtgccaccgaacgtgtggtttggttccttccccacgctggatgttgagtcgtttgcttccgatggcagcgttcttgtaaagtcccggaagagggatccggagcagcattactccctggtgggatgcacctgtgcacctggcttccagtacgaggactttgagatggccacgtttcaggacgtgaggtccatcgctcccaaggccgaacctttcctcaagttcctcatcccttcgaccgagtgactccttggcgacctccgttgatgccggattagtcctcagcttctctgtaccagattcccatttttaggcttgtgcttttaccatattgtagactgtaaactgtaccagggtgctggtgctgcttgtaacattttgtgcaatgaaacagaataactgcggatcttgatgttcg

SEQ ID NO: 33769 - protein, 194 aa, Panicum virgatum
  misc_feature: Ceres CLONE 1953678
  misc_feature (8)..(171): Pfam Name: Cupin_5 Pfam Description: Cupin superfamily (DUF985)
MASEEMTATEVAALLDLKPHPEGGFYAETFRDGSVTLSTAQLPPQYKVDRAVSTAIYFLLPAGSVSRLHRIPCAETWHFYKGEPLTVFELHDDGHIDLTVIGPHLEAGQRPQYTVPPNVWFGSFPTLDVESFASDGSVLVKSRKRDPEQHYSLVGCTCAPGFQYEDFEMATFQDVRSIAPKAEPFLKFLIPSTE

SEQ ID NO: 33770 - DNA, 465 bp, Panicum virgatum
  misc_feature: Ceres CLONE 1953680
  misc_feature: Encodes the peptide sequence at SEQ ID NO. 33771
aatgctagtggggcaggctcttcagaaccatcagagtttagcccagacatcccaggagcagttgacatggataacgcttggaggtcaattaacccgccccactgggcctgggcggccatggtctggattctgcattttgtgtgcatatagaaggaatggtttgaaaacacgcaggagcaaaaagctagagcactaggaaggtagagatttagagaatcaggtggtcgggccttagcttgactaagtctgtgaatgtatgaagtatgttgattgataattagggcagttgtatggtactccagttagtagtaggaactaggaactaagtagttctgatggatgcactcatcctgactgttcactcattagagtatatgtagctgatgcatgcctccttttgatctgagaaacgtcctatgtatgactgagctgaacaactagtggaatacatggtcgttttgtttt

SEQ ID NO: 33771 - protein, 49 aa, Panicum virgatum
  misc_feature: Ceres CLONE 1953680
  misc_feature: Functional homolog of the protein sequence given in SEQ ID NO 51055
  misc_feature: Useful for making plants with altered carbohydrate content
NASGAGSSEPSEFSPDIPGAVDMDNAWRSINPPHWAWAAMVWILHFVCI

SEQ ID NO: 33772 - DNA, 702 bp, Panicum virgatum
  misc_feature: Ceres CLONE 1953688
  misc_feature: Encodes the peptide sequence at SEQ ID NO. 33773
agcgcggcgtccgctccagctcctccatcccgggcgagccgagtcaaatccgaagccacacagcgagaggaaatggcggcggcggcgctccgtccggcgatcctccgccgcatccgcctctccccctccccggcgctccccctcgccgccgcggcgtcccacccgcacgccctggcgcggtggctcgcgcggcccatgtcctcccacgacgcgcacctcacccgcgaggaggtcgtcgaccgcgtcctcgacgtcctcaagagccaccccaaagtggatccttccaaggtgactcccgaggcgcacttcgagaaggatctggggctggacagcctggacaccgtcgaggtggtgatggccatcgaggaggagttcaagctcgagatcccggacaaggaggccgacaagatcgactcgctcccgctcgccatcgagtacgtcgccaaccaccccatggccggctgagcctcagctcgccggaggtgaggtctcttggttttttttttttttgtttccgagggcaaataattggccggagcggctgaggaaagcgcgtccctggcgctccgcattgcttcgcgggcggacgatgatgtcgaaatggaacattaacattttgtttctcagacgatgcaatgttagattgctgttttcggtgtgtgttatatctaaacggtgttgttgacaaactagtttggtcag

SEQ ID NO: 33773 - protein, 130 aa, Panicum virgatum; identical to SEQ ID NO: 12534
  misc_feature: Ceres CLONE 1953688
  misc_feature (56)..(123): Pfam Name: PP-binding Pfam Description: Phosphopantetheine attachment site
  misc_feature: SWISSPROT Homolog: EC 6.1.1.13 D-alanine--poly(phosphoribitol) ligase

SEQ ID NO: 33774 - DNA, 811 bp, Panicum virgatum
  misc_feature: Ceres CLONE 1953693
  misc_feature: Encodes the peptide sequence at SEQ ID NO. 33775
atcacaaccgacctccgatccacttctgctcaccagacacagacactgctaagctagctagctgctttacacttcactcactagtcactagcagcttgatcattcgacgatcagtgagtgttatcatataccagtcgtagctgcaatattaatatatatatggctcgcctctccgccgttgtcgccgtcgtcctggtggctgcgctggtggcggccgagaccgcttcggctgcggtgagctgcagccaggtgacgtcggccgtggcgccgtgcctggggtacgccatgggcagctcggcgtcgccctcgtcggcgtgctgcaacggggtgaggtcgctcaacagccgggcgtcgtcgacggcggacaggcaggcggcgtgcgcctgcctcaagaacatggcggggaggctgggtggcaacatgggcaacgccgccgccagcatccccagcaagtgcggcgtcaacgtcggcgtgccaatcagcccaaacgtcgactgcgccaagattaactgataagatgctaaggatggatgctcagctctttccttctctttgggtatgatgtcggccaacagagcagagagcagtcgtttaatttactaccacttccttttacatttgtacaacaccacgcaccacctgtgtacgtcgtcgtgtatgtgtatgtaacaacaataatcctctctctgcttatgggtttgctgggcctctgttttcatgtactactaccatgatgctgctgctactgcttgttataggcagggcaggcagctctccgctcaatcaataaacttttttttgtaatacctac

SEQ ID NO: 33775 - protein, 117 aa, Panicum virgatum; identical to SEQ ID NO: 12304
  misc_feature: Ceres CLONE 1953693
  misc_feature (28)..(113): Pfam Name: Tryp_alpha_amyl Pfam Description: Protease inhibitor/seed storage/LTP family

SEQ ID NO: 33776 - DNA, 1078 bp, Panicum virgatum
  misc_feature: Ceres CLONE 1953702
  misc_feature: Encodes the peptide sequence at SEQ ID NO. 33777
atccggcttcatcgagaaggtcaaggacttcatccacgacatcggcgagaagatcgaggaggctgtcggcttcggcaagcccaccgccgacgtctccggcatccacatcccgcacatcagcctccaccgcgccgacctcgtcgtcgacgtgctcatcaagaaccccaaccccgtcccaatcccgctcgtcgacatcgactacctcatcgacagtgacgaccgcaagctcgtctccggcctcatccccgacgccggcaccatccacgcgcagggcgaggagaccgtcaagatccccgtctccctcgtcttcgacgacatcaagagcacctacaaggacatccagccggggagcatcatcccatacctcgtccgcgtcgtcctcctcgtagacgtccccatcatcggccggatcaagatcccgctcgagaagtccggcgagatccccgtcccctacaagcccgacgtcgatgttgagaagatcaagttccaccacttctccttcgaggagaccaccgccacgctgcacatcaagctcgagaacaagaacgacttcgacctcggcctcaacatgctcgagtacgagatgtggctcggcgacgacagcatcgcctccgccgagctcacgcagagcgccaagatcgagaagcaggggttcaccaggatgcagatccccttcagcttcaggcccaaggacttcggatccgcggtctgggacatgatcaggggcagggggacaggctacaccatcaagggcaagattgatgtcgacactccctttgggaacatgaagctgcccataagcaaagagggtggaactactcgcatcaagaaggacgacgacgacgacgacgatgatgacaactgaggactgaagtgctgctgtaaccaaacacagatggcagtgaagtggagaggatgctgtaacgggtgcagtcgcctgcctgacacccttagcgctagttgagctctgcattgtcttagtagcttcatgtgtctgtcgatctgcattgtctgaacatcctctgttagtgtggactcatctgtgctgtgaattccttctccaaacttttgtggttgg

SEQ ID NO: 33777 - protein, 287 aa, Panicum virgatum
  misc_feature: Ceres CLONE 1953702
  misc_feature (1)..(156): Pfam Name: LEA_2 Pfam Description: Late embryogenesis abundant protein
  misc_feature: Functional homolog of the protein sequence given in SEQ ID NO 50373
  misc_feature: Useful for making plants with altered alkaloid content
SGFIEKVKDFIHDIGEKIEEAVGFGKPTADVSGIHIPHISLHRADLVVDVLIKNPNPVPIPLVDIDYLIDSDDRKLVSGLIPDAGTIHAQGEETVKIPVSLVFDDIKSTYKDIQPGSIIPYLVRVVLLVDVPIIGRIKIPLEKSGEIPVPYKPDVDVEKIKFHHFSFEETTATLHIKLENKNDFDLGLNMLEYEMWLGDDSIASAELTQSAKIEKQGFTRMQIPFSFRPKDFGSAVWDMIRGRGTGYTIKGKIDVDTPFGNMKLPISKEGGTTRIKKDDDDDDDDDN

SEQ ID NO: 33778 - DNA, 1219 bp, Panicum virgatum
  misc_feature: Ceres CLONE 1953708
  misc_feature: Encodes the peptide sequence at SEQ ID NO. 33779
attccagaaaccgtgagttgatcagaatttagaagcaatgagttacctgctaaagaccaggaaggagagggaaccacccctgcaggagcatgcggcttcagaagagcaggcaaagataaataaggtacgggaacttctgggtgagctgccgacagagatgccgggcttcctgtcggacgccaccatccgccgcttcctccatgcaaaaaattggagcgtggttcaggccaccaagactctgaaagaggctgtcaaatggaggcgtcagtacaagccagaaaaaatctgttgggaagatattgctgaacccgagaatgaggtgcagagagcgtatataaccgactaccttgacaaaaatgggcgtactgtgttggtagcacggccgtcagtaaagagcctaacttcagtgaaggaacagatcaaacaactagtgtacaacctggaaaatttgaccatgagctcagagaatgcaccagaaaatgttgtttgggtaattgacttccaaggatggacactatcaagtacgccattggcaatgaaccgtcaatcattggacataattcaaaactattatccagggttggtagcagttataattctttgcaatccaccaaagatatttgaayctttttgraagatactgagttacttcgtcgagccggaaatgaaagagaaagtgagatttgtgtactctaacaactctgagagcctgagaacaatgactgacatgtttgacccagacaagctcgagtctgcatttggcggacaaaatacttggggcattgacattgttgagtattctgagagaatgcgaagaagagatcaagttaggaaagctttgagaaatgcaaatgaaaatgcctattctacctgaccatgccatgattcatctggagaagtgtatatgaactccactctaaccagcgaagatgacatacgaagaagaagagactggagccctatcttttttatacgcaaatgagtgaacataagtgttcaaataacttaataagttcaattactatgaaagaatctatattacataccaaaagattgagatgtaaggcagataatatgatcctaatgacctacacaatcagatgaaatgtggattcatgagtcactgtattgtaggtaataagatgtcgatttatgataaacactagttataaaagctggaggtggaagatatatcgaaaggatgatgaaatgtggtgac

SEQ ID NO: 33779 - protein, 278 aa, Panicum virgatum
  misc_feature: Ceres CLONE 1953708
  misc_feature (93)..(269): Pfam Name: CRAL_TRIO Pfam Description: CRAL/TRIO domain
  misc_feature (14)..(83): Pfam Name: CRAL_TRIO_N Pfam Description: CRAL/TRIO, N-terminus
  misc_feature (197)..(197): Xaa is any aa, unknown, or other
  misc_feature (199)..(199): Xaa is any aa, unknown, or other
MSYLLKTRKEREPPLQEHAASEEQAKINKVRELLGELPTEMPGFLSDATIRRFLHAKNWSVVQATKTLKEAVKWRRQYKPEKICWEDIAEPENEVQRAYITDYLDKNGRTVLVARPSVKSLTSVKEQIKQLVYNLENLTMSSENAPENVVWVIDFQGWTLSSTPLAMNRQSLDIIQNYYPGLVAVIILCNPPKIFEXFXKILSYFVEPEMKEKVRFVYSNNSESLRTMTDMFDPDKLESAFGGQNTWGIDIVEYSERMRRRDQVRKALRNANENAYST

SEQ ID NO: 33780 - DNA, 1244 bp, Panicum virgatum
  misc_feature: Ceres CLONE 1953717
  misc_feature: Encodes the peptide sequence at SEQ ID NO. 33781
atctccactctcgcagcgtccccccagcttcgcctcacacgcgagagaggagcggagagctgctcgtcgccgtctcgcgtgcggcgatcgctgcagggttcgatccagaggctctccatcgccggccatggtgattctggaccgcacgccggccgcggcgccggaggtcacctccagcccgctccagaggtcctctcttagggttccgcgggagggcggtgagccgccgccctccgatcccatcctcccatacctcaggtctatcagcagggccatggatgagcttgggacagggccacagtgtgacccatcagccttagaccagctcaagtgttacttgaccgaatgcattaaaaaatatggggatgagtaccagtactccactgatccacgcctcctgaagatctggattctctatgcggatgtaactgaggcctttcccaaggtttacaagcagctggaagagaaacgaatgttcttggaacatgcactgctctatgaatcatatgcattgtatctatgtgctgaggggaaactgcaggaggctgataaggtgtatgcgattggtatctccaggaaagcagagcccctcgatcatctgaagaaaacacacttgacatttctgaaacatctggagcattttgtagaagaggcagacctggatgcacagccatcaaaaaaacagaagaatgaacctagtgcggtagatccgtggtctgtatcgtctaggaacactttactggaaacaattaacgatgacctcaggaagtttgctggctatcacaagagtaacaaagtctactacggaaaagtggccttaacttcttcactgcatattttaagaaacaaggtcattgagttaggtggcagaaagtatcagatcaaaggatctactggcactggtgcttttgctaaagtatacaaagccactgttgatggtaatgcagaagaaatggttgctctgaagattcagaatcccccatttccttgggaatttttcatgtatcgccaacttgatatgcgtatacctgaagttgagcgaccaagcttcggatacgtgcatgaagtgcatatcttctctgatgtcagcgtgctagtctgtgattacttgccatacggaacccttctggatgtcataaactcccatttagtagttgatcggcatatggatgaagttttatgtatgtattataccattgagatgctgcaaatgctggaaacactgcatagtgttggcataatcc

SEQ ID NO: 33781 - protein, 323 aa, Panicum virgatum
  misc_feature: Ceres CLONE 1953717
  misc_feature (1)..(99): Pfam Name: Mad3_BUB1_I Pfam Description: Mad3/BUB1 homology region 1
  misc_feature: SWISSPROT Homolog: EC 2.7.11.1 Non-specific serine/threonine protein kinase
MDELGTGPQCDPSALDQLKCYLTECIKKYGDEYQYSTDPRLLKIWILYADVTEAFPKVYKQLEEKRMFLEHALLYESYALYLCAEGKLQEADKVYAIGISRKAEPLDHLKKTHLTFLKHLEHFVEEADLDAQPSKKQKNEPSAVDPWSVSSRNTLLETINDDLRKFAGYHKSNKVYYGKVALTSSLHILRNKVIELGGRKYQIKGSTGTGAFAKVYKATVDGNAEEMVALKIQNPPFPWEFFMYRQLDMRIPEVERPSFGYVHEVHIFSDVSVLVCDYLPYGTLLDVINSHLVVDRHMDEVLCMYYTIEMLQMLETLHSVGII

SEQ ID NO: 33782 - DNA, 733 bp, Panicum virgatum
  misc_feature: Ceres CLONE 1953717-R
  misc_feature: Encodes the peptide sequence at SEQ ID NO. 33783
ccaacatgcttgtttgctatccaagtggggatatcacagaagaaaccttcagaagcgaaacaagagacgagcagaatcaggggctctgccttgtcgactggggccgcggcattgacctgaatcttttacgccctggcaccgtgttccacggggactgcggaacgtcgggattcagctgcgtcgagatgcaagaaaaccggaactggacgtatcaggtcgacacgtacggcctctgcgtcatagcgcacatgatgctacacggggtggccatgagcatcgagaaggtgcccagggcagggggaggctacgagtaccagccgaagctgccgtttagaaggtactggaacgtggaactgtggaggaagctcttctccacgctgctgaacgcaccctccaacgacagcgacgtggcggcgctccgggggctgcgcgcgtcgttccgggagcatatgtgcggcagccggcagctcgtcggcaagctgaaccagatgctggcgaagcagaaggcctccctgtgctcgtcctgaggcgcgccggccgatcgtacccccggtggctccgtgtcgtgacaatcgaagcgcgtccgaccggctccctgcctgttccggagcaccgcttgtgcctgtgatctccgtgtactgtatctccgactagcatgcaaatctgtcatgtatgtaagaggctgctgcttttagagattttctaaaaaagtttattctgggtttttcttctc

SEQ ID NO: 33783 - protein, 174 aa, Panicum virgatum
  misc_feature: Ceres CLONE 1953717-R
  misc_feature: SWISSPROT Homolog: EC 2.7.11.1 Non-specific serine/threonine protein kinase
NMLVCYPSGDITEETFRSETRDEQNQGLCLVDWGRGIDLNLLRPGTVFHGDCGTSGFSCVEMQENRNWTYQVDTYGLCVIAHMMLHGVAMSIEKVPRAGGGYEYQPKLPFRRYWNVELWRKLFSTLLNAPSNDSDVAALRGLRASFREHMCGSRQLVGKLNQMLAKQKASLCSS

SEQ ID NO: 33784 - DNA, 1097 bp, Panicum virgatum
  misc_feature: Ceres CLONE 1953744
  misc_feature: Encodes the peptide sequence at SEQ ID NO. 33785
tggatttgaagccgctgcctccaagccccactgataaaattgaccacccgtcgtcctccctgtccgtcatcatgctccctcgccgtttccttccccatccatccccccggcagcaggagcggcagcgtcgccagaaagggcgatatctacttcgccgtcgaccggatcccctctgctcgcctccctcctcttctccactctgcgtccccgcaataggctctgctgttgagatcatctttcttggagaagaggggggcgttcttgaagtgaaggagcaagaaagaaagggaggggctttcgggtggatgaacagttctgacggaggccgccggggccaatgccaagttcaggattgaaggtattgtcacttcaggtgacaagcaattcagtcacagaggaacagatctgattacacaacaacattcagaaatcacacacacacaaaaaaaaccaccacccttcacccttgtcagttcttggacgctcgctgtcatcgatctgcgtacacagcggcaacaaaatggcaagccgatctggcgcgatggatggaagaataggcacaagcagacagaggaggagcccagagttggtccgaagaccaaacgccgggaaacgccatctgcagcagcagcggctgcagcaggaggcggatttcaacgacaggaaggtcattgcgtcgacttacttcagcatcggagcgttcctcgtgctcgcctgcctcaccgtgtcgttgctgatactgccattggtgctgcctccattgccgccgccgccgtcgctgctgctatggctgccagtcgccctgctcatcctgctgattgtgctggccttcatgccaactgatgtgaagagcatggcgtcgtcttgtaaataggcccactggccctggagcctcttgtttgggcatttcgactaggatgattgcaatgtgaagcatcttttcaggagtagatttcgagtgaaaaagtttggcagctataaatgttgtttaacgggatttggtaattcgatgcaaatgtgctaacaaagttaagcaggttttctgtcaggcaccattctttccaagagatagacagacatgttccattattcgtact

SEQ ID NO: 33785 - protein, 117 aa, Panicum virgatum
  misc_feature: Ceres CLONE 1953744
  misc_feature: Functional homolog of the protein sequence given in SEQ ID NO 50534
  misc_feature: Useful for making plants with modulated biomass
  misc_feature: The sequence is a functional homolog of SEQ ID NO 2 in US patent 7151206
MASRSGAMDGRIGTSRQRRSPELVRRPNAGKRHLQQQRLQQEADFNDRKVIASTYFSIGAFLVLACLTVSLLILPLVLPPLPPPPSLLLWLPVALLILLIVLAFMPTDVKSMASSCK

SEQ ID NO: 33786 - DNA, 1067 bp, Panicum virgatum
  misc_feature: Ceres CLONE 1953758
  misc_feature: Encodes the peptide sequence at SEQ ID NO. 33787
acccaatccaccacacaccagccagaactcacgcgacacttcgcctcctcctcttagatccccatccagatgacgatgcttagggtttccccgtcaccggccgccgccgccgccgccaccgccaaccatgtctctcggcccgccgtgaccccggcttccgtccgggtgccggcgccgcgcgtcttgccgtcggccgcggccgcgtgcagggcggcgggcaagggcaaggaggtgctcagcggggtcgtcttccagcccttcgaggagatcaagggggagctctccctcgtgccccagaccgcggacaagtccctcgcgcgccagaagttcgtcgacgaatgcgaggcggccatcaacgagcagatcaatgtggagtacaatgcctcctatgcgtaccactccctctttgcctacttcgaccgcgacaacgtggctctcaaaggatttgccaagttctttaaggaatcaagcgatgaggagagagagcatgctgaaaagttcatgaagtaccagaacacacgtggaggcagggtcagtctccagtccattgtcactcccttaacagagtttgaccaccctgagaaaggcgatgctttgtacgccatggagctggctctagctctggagaaattggttaatgagaagctgcacaacctgcatgctgtggcgaccaggtgcaatgaccctcagctgacagacttcatcgagagtgaatttctctcggagcaggttgaaagcatcaagaagatctccgagtatgttgcccagttgaggagagtgggcaagggacacggggtgtggcactttgatcagaagctgctggaggaagaggcctgaaggaaggaaacaccgtggagtagtaggggtgggaagctgctccaggatcagattatgcggcgggagcaaccaagcgctagggttgtgtagtagcattagggccgaccgtgttgcttagatgcactgagaagcagaacttgggatgttattacagtaccttattgcaagtaccgtggaaagtgggctctgtttagtttgcgaaaatgtttggattttgacacagtagcact

SEQ ID NO: 33787 - protein, 255 aa, Panicum virgatum
  misc_feature: Ceres CLONE 1953758
  misc_feature (92)..(237): Pfam Name: Ferritin Pfam Description: Ferritin-like domain
  misc_feature: SWISSPROT Homolog: EC 1.16.3.1 Ferroxidase
MTMLRVSPSPAAAAAATANHVSRPAVTPASVRVPAPRVLPSAAAACRAAGKGKEVLSGVVFQPFEEIKGELSLVPQTADKSLARQKFVDECEAAINEQINVEYNASYAYHSLFAYFDRDNVALKGFAKFFKESSDEEREHAEKFMKYQNTRGGRVSLQSIVTPLTEFDHPEKGDALYAMELALALEKLVNEKLHNLHAVATRCNDPQLTDFIESEFLSEQVESIKKISEYVAQLRRVGKGHGVWHFDQKLLEEEA

SEQ ID NO: 33788 - DNA, 526 bp, Panicum virgatum
  misc_feature: Ceres CLONE 1953759
  misc_feature: Encodes the peptide sequence at SEQ ID NO. 33789
ctagcccctgttcctcccccccgcacaagcgccacgcacggtgacatggatcagaacaccagggacatcatcatgagggagttcaggtctgggtcttcccgtgtgctcatcaccacggacctgcttgcccgcggtattgatgtccagcaggtttccctggtcatcaactacgacctgccaacccagcctgagaactacctccatcgcattggccgtagcggtcggttcgggaggaagggtgttgccatcaactttgtcacccgcgacgacgagcggatgctgtttgacatccagaggttctacaacgtgaccattgaggagctgccggccaatgttgcagatcttctctagattgtgtcctaggatattgctgctaaggtgctggataaagaagtctgttttagttaaatatcgccaacttttctcttcctggaggagtggtaatgtcgggttatctactatttgcattgtggctaaggatggtttctaagcttttcttctatgcaacgtttgggaaaaattttgc

SEQ ID NO: 33789 - protein, 116 aa, Panicum virgatum
  misc_feature: Ceres CLONE 1953759
  misc_feature (1)..(77): Pfam Name: Helicase_C Pfam Description: Helicase conserved C-terminal domain
  misc_feature: Functional homolog of the protein sequence given in SEQ ID NO 51444
  misc_feature: Useful for making plants with altered terpenoid content
  misc_feature: Functional homolog of the protein sequence given in SEQ ID NO 51085
  misc_feature: Useful for making plants with altered alkaloid content
  misc_feature: Useful for making plants with altered lignin content
LAPVPPPRTSATHGDMDQNTRDIIMREFRSGSSRVLITTDLLARGIDVQQVSLVINYDLPTQPENYLHRIGRSGRFGRKGVAINFVTRDDERMLFDIQRFYNVTIEELPANVADLL

SEQ ID NO: 33790 - DNA, 740 bp, Panicum virgatum
  misc_feature: Ceres CLONE 1953763
  misc_feature: Encodes the peptide sequence at SEQ ID NO. 33791
agtccgccggcgtcgctccgcatcccccagcaggttgagcagcctgccctgttgagaaactgcaatggcgcctaaagctcccccaaagaaggctgatagcaaggctcaagccttgaaggttgccaaggctgttaagtctggaaccaccaagaggaaggccaagaagatccgcacatctgtgacgtttcaccggcccaagaccctcaagaagccaagggaccccaagtacccaagaatcagtgcacctgggaggaacaagcttgatcagtaccaaatcctcaaatacccccttacgactgagtctgcgatgaagaagattgaagacaacaacacccttgtcttcatcgttgacctcaaggcggacaagaagaagatcaaggcagccgttaagaagatgtatgacatccaggcgaagaaggtcaacactctgatcaggcccgatggcaagaagaaggcttacgtgaagcttacaccagactatgacgctcttgatgtggccaacaagatcggcatcatctaaattttgtagttttgtgtgccagcgtgttgcagtttcagagttttggtgtgctaggtcttgtatctgtttggacagaatcgcatagctaagcctgtgaactggtactgatgatggaaatttgcaatgttctgcattttaattttgttgttggatgttagtggttattgcgatatgaggctactggtattttatcatggtcaaatcaagcaaaagtcagttc

SEQ ID NO: 33791 - protein, 151 aa, Panicum virgatum
  misc_feature: Ceres CLONE 1953763
  misc_feature (69)..(148): Pfam Name: Ribosomal_L23 Pfam Description: Ribosomal protein L23
  misc_feature (10)..(63): Pfam Name: Ribosomal_L23eN Pfam Description: Ribosomal protein L23, N-terminal domain
  misc_feature: Functional homolog of the protein sequence given in SEQ ID NO 50387
  misc_feature: Useful for making plants with modulated nitrogen use efficiency
MAPKAPPKKADSKAQALKVAKAVKSGTTKRKAKKIRTSVTFHRPKTLKKPRDPKYPRISAPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 33792 - DNA, 951 bp, Panicum virgatum
  misc_feature: Ceres CLONE 1953769
  misc_feature: Encodes the peptide sequence at SEQ ID NO. 33793
accacccctcccatctcctccgcccatcctcctcctcaggtctcccccccccctctcctcctcccccgatccccaaatcctcctccagatttcgaactcagccgcggcgcaggtggtgaaggggggcagagaggggaaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaaccgttgagtacaagaacattagcttcaccgtctgggatgtcgggggtcaggacaagatcagacccctctggaggcattacttccagaacacacagggtcttatctttgttgtggacagcaacgatcgtgaccgtgttgttgaagccagagatgagctccacaggatgctgaatgaggatgagctacgtgatgctgtgctgcttgtttttgccaacaagcaagatcttcccaacgctatgaatgctgctgagatcactgacaagcttggattacactccctgcgccagcgacactggtacatccagagcacttgtgccacaactggtgagggtctgtatgagggcctggactggctgtccagcaacattgctagcaaggcttgaggccaggctttcgatatcaactgcgaactgactaggagctccggatgtatcatggaaacttaggacagaatcgcctctgcaacctgttaggtgtcttctgccggcacgatatattttttgtttggaatatgtaatgatgtcactatcaaatgtttgttcaaccctactctactgttggatgttctttggacctgttcattttgcacaaggattggagttccaatatcatggtactttgggaagttattatatacaacattcctac

SEQ ID NO: 33793 - protein, 181 aa, Panicum virgatum; identical to SEQ ID NO: 16418
  misc_feature: Ceres CLONE 1953769
  misc_feature (5)..(177): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content

SEQ ID NO: 33794 - DNA, 697 bp, Panicum virgatum
  misc_feature: Ceres CLONE 1953775
  misc_feature: Encodes the peptide sequence at SEQ ID NO. 33795
gccgccacctccttccgagtctccgctccgcacccccccgccgccgcccgacgcccgccgcgcagccatggcggaacagactgagaaggctttcctcaagcagcctaaggtgttcctcagcacaaagaaatctgccaaggataagaagccaggcaagggaggcagccgcttctggaagagcattggcctgggcttcaagacccccagggaagcaattgaagggacctacattgacaagaagtgcccattcactggaactgtttccatcagaggcaggattattgccggagcatgccatagtgcaaagatgaacagaaccatcattgttcgcaggaactacctccactttgttaagaaatatcagaggtacgagaagaggcactccaacattccggctcacatctccccatgcttccgtgtcaaggaaggtgaccatgtcatcattggccagtgcaggcccctctccaaaactgtgaggttcaacgtggtgaaagttatcccagctggatccactggtggcagcggcgggaagaaggcattcaccgcggcctgagctttagactatgttccaagagtagtctatagaatgatgtctttttgctaaaaaatcctgctaggctggtgttttcgactatggtttggagattgttcgctgtctgaatggagtctcatcaccggaacatgttactctttacgg

SEQ ID NO: 33795 - protein, 161 aa, Panicum virgatum
  misc_feature: Ceres CLONE 1953775
  misc_feature (74)..(143): Pfam Name: Ribosomal_S17 Pfam Description: Ribosomal protein S17
MAEQTEKAFLKQPKVFLSTKKSAKDKKPGKGGSRFWKSIGLGFKTPREAIEGTYIDKKCPFTGTVSIRGRIIAGACHSAKMNRTIIVRRNYLHFVKKYQRYEKRHSNIPAHISPCFRVKEGDHVIIGQCRPLSKTVRFNVVKVIPAGSTGGSGGKKAFTAA

SEQ ID NO: 33796 - DNA, 784 bp, Panicum virgatum
  misc_feature: Ceres CLONE 1953778
  misc_feature: Encodes the peptide sequence at SEQ ID NO. 33797
ctggacaacaaacaaatccacaggctccacttactcaggctgcagctgcaccaccattgcagccatcccctgcctctgcagggcctaatgcaaatcctctaaacctttttcctcagggtgttccaagtggtggggccaatccagctgctggtgctggtgctggtgcaggagctggttcccttgatgccttgcgacagcttccacagtttcaagcactgcttcaattggtccaggctaatcctcaaatcttacagccaatgcttcaagagcttggcaaacaaaacccacaaatcctgcggttgattcaggaaaatcaggctgagtttctccgcttggtgaatgaaagtcctgagggtggtgctggaggaaacatactaggtcaactagcagcagccatgccacaagcggtgacagttactccggaggaacgggaggctatccagcggctcgagggaatggggttcaatcgtgagcttgtgctggaggtattctttgcgtgcaacaaggacgaggagcttgctgccaactacctcctggatcacggccatgagtttgacgagccgccgcaatagatgctagattggtgatatatcgtgggggtggaggtggtgaaactcagggagaagcagagcagctcagtgtcagttcttattccttgtggcagttgagaaatacctggtcgtctatgatgtgctgctgactatgttttttttccatatatgtctggaatgctttctaagtacatattaattccatatttcgtgccctcttggtgtttgtgcag

SEQ ID NO: 33797 - protein, 189 aa, Panicum virgatum
  misc_feature: Ceres CLONE 1953778
  misc_feature (60)..(118): Pfam Name: XPC-binding Pfam Description: XPC-binding domain
  misc_feature (141)..(177): Pfam Name: UBA Pfam Description: UBA/TS-N domain
GQQTNPQAPLTQAAAAPPLQPSPASAGPNANPLNLFPQGVPSGGANPAAGAGAGAGAGSLDALRQLPQFQALLQLVQANPQILQPMLQELGKQNPQILRLIQENQAEFLRLVNESPEGGAGGNILGQLAAAMPQAVTVTPEEREAIQRLEGMGFNRELVLEVFFACNKDEELAANYLLDHGHEFDEPPQ

SEQ ID NO: 33798 - DNA, 914 bp, Panicum virgatum
  misc_feature: Ceres CLONE 1953781
  misc_feature: Encodes the peptide sequence at SEQ ID NO. 33799
gactcgaccatccggacaaaataccagcccatcctccccggcctgcggtctcccgtctccccacctcctcctcctcgccttccccgctcggccctcccctcctcgggtgcctccaccgtcgagagggcgagcgaggtgggcggagaagaaggcgaagcgcgaccatgggcttcatctcgttcgtcggccgggtgctcttcgcctccctcttcctcctctccgcctaccaagagtttatagaatttggaaatgatggtggaccagcggcaaaggtcttgaagccaaaattcaatctctttatcaagcaagtgtccaagaacactggattgggggtgccgcatattgatgtaaaaactgtcattgctgctaccatgtttcttaaaggctttggtgggcttttgttcatctttagcagctcatttggagctttcctactgcttatttacttggcatttataacccctgttgtgtacgacttctacaactatgaaatggagtcagcacaatttgtccagctgtttttcaagttctcacagaacttggcgtttatcggtgccctgcttttcttcctgggaatgaagaactctattccaagaaggcgctccaaaggaaggacaacaaagaccaagacaaattgaagtcagcagttgtaggatgggaggctattaagctccttatgtttgcatactatacagcggtagatgtcccacttttgttcttggcacgccaattgaattgtgaattggggggacttacagaacttagcatgtagggtatttaagttgtcttggacgattctattttgtatgtctcatttgtgtttatgtaatgatacattttgctacaagaactgctttgtcagtttaaaatcgaaagttgcagtctctgtgggccaatgtgcggttttgaaactt

SEQ ID NO: 33799 - protein, 157 aa, Panicum virgatum
  misc_feature: Ceres CLONE 1953781
  misc_feature (1)..(138): Pfam Name: HR_lesion Pfam Description: HR-like lesion-inducing
  misc_feature: Functional homolog of the protein sequence given in SEQ ID NO 51445
  misc_feature: Useful for making plants with modulated nitrogen use efficiency
MGFISFVGRVLFASLFLLSAYQEFIEFGNDGGPAAKVLKPKFNLFIKQVSKNTGLGVPHIDVKTVIAATMFLKGFGGLLFIFSSSFGAFLLLIYLAFITPVVYDFYNYEMESAQFVQLFFKFSQNLAFIGALLFFLGMKNSIPRRRSKGRTTKTKTN

SEQ ID NO: 33800 - DNA, 1139 bp, Panicum virgatum
  misc_feature: Ceres CLONE 1953785
  misc_feature: Encodes the peptide sequence at SEQ ID NO. 33801
gactaccaccacaccgtcacccccatcacagaaagaaagagagagagccctacctacaatggcggcggccctcgagtctgcctggcaggtcctgaccgccaacttctccgagttccagctcgccaccgtcttcaccttcctgatccacgagaccgccttcttcctctccggcctcccctccctcctcttcgagcgcttcggactcttcgccaagtacaagattcaaaagaagagcaacacctctgcttatgaaaacagatgtgtcctgcgcctcatactctaccatgtctgtgtgaacttgcctgtcatcattttctcctaccctgccttcaaattcatgggccttaggagctctcttcctctgccacactggacggttgttgtatctcaagttgcattctactttgtactggaggattttgtattctactgggggcaccgggcactgcacaccaaatggctatacaagcatgtccacagcgtccaccacgaatatgctacaccctttgggttaacttctgaatacgcccaccctgctgagattttgttcctgggattcgccacagttgttggtcctgctcttactggccctcatttgttgaccctgtggctttgggtggtgttgagggtattggagacagttgaagctcacagcggctaccacttcccatggagcccctcaaatttcctgccactgtatggaggctcggacttccatgactaccatcaccgtgtgctctacaccaagtcagggaactatgcctcgacttttgtgtacatggactggttgtttgggacggacaaggattaccgcaaggcgaaggccatggaggagaaggaagggaacaaggatacgtagatcgatcatgcatgggagctgcgaataatgaagacaggcggagctagcaatacgtactgtctgtgtactacaatcgtacgtacgtaatccttggggtttgccgtttgcgttcctgctttgtttaatttggccgggatcggatgtatatatacatttggatcggagctagctagtagcaagatggtcgatgaggttgatgtgaccttagtttgcttgtgtgatgaattaacaataatgtcagcaattaaataaagccacaactatagccggcctgttcagc

SEQ ID NO: 33801 - protein, 266 aa, Panicum virgatum
  misc_feature: Ceres CLONE 1953785
  misc_feature (112)..(225): Pfam Name: FA_hydroxylase Pfam Description: Fatty acid hydroxylase
  misc_feature: SWISSPROT Homolog: EC 1.14.13.72 Methylsterol monooxygenase
  misc_feature: Functional homolog of the protein sequence given in SEQ ID NO 51442
  misc_feature: Useful for making plants with modulated cold sensitivity
  misc_feature: Functional homolog of the protein sequence given in SEQ ID NO 51441
  misc_feature: Useful for making plants with altered sterol content
MAAALESAWQVLTANFSEFQLATVFTFLIHETAFFLSGLPSLLFERFGLFAKYKIQKKSNTSAYENRCVLRLILYHVCVNLPVIIFSYPAFKFMGLRSSLPLPHWTVVVSQVAFYFVLEDFVFYWGHRALHTKWLYKHVHSVHHEYATPFGLTSEYAHPAEILFLGFATVVGPALTGPHLLTLWLWVVLRVLETVEAHSGYHFPWSPSNFLPLYGGSDFHDYHHRVLYTKSGNYASTFVYMDWLFGTDKDYRKAKAMEEKEGNKDT

SEQ ID NO: 33802 - DNA, 622 bp, Panicum virgatum
  misc_feature: Ceres CLONE 1953787
  misc_feature: Encodes the peptide sequence at SEQ ID NO. 33803
ggctgcactccactcctgaggcgcaggcgcttgtcttccaaatcgtcgccgccggtgtccgatcctccttgcccgtctctccggcggcccccgacctagccgtcgagggatagcctaggacctgaatcgtcggaaatggaggcctcgccgcgtcgccgcaggctccgttcgtcgcttcgccgcaggcgccgttcgccgtcgccggacgcggaggtggcgtcggggtggctggactccctcccgcctgagctgcgcaacgagatcctctcccgcctacccctccgctgcgccgtccgcaccgccgcgctcgcccgggcctggcgccgccgctgggagtccgtcccctccctccgcatcaaatggcccgccggcgcggaccccgacgccatcaccggcgtcctccgacgctactcctgccccgtccgcgagttctgcccctcgcacatcggcgaggcgtctttccgccactccgaccgctggctccgcctcctggcgctcaggggagtccaaaccctcagccttgatttcgagaggtcggatgaggagtcggcccatacgctgcacccctccatcttctcgtgccgtgggctcacggtcctgagactccgtggttgcgacatcc

SEQ ID NO: 33803 - protein, 162 aa, Panicum virgatum
  misc_feature: Ceres CLONE 1953787
  misc_feature (30)..(77): Pfam Name: F-box Pfam Description: F-box domain
MEASPRRRRLRSSLRRRRRSPSPDAEVASGWLDSLPPELRNEILSRLPLRCAVRTAALARAWRRRWESVPSLRIKWPAGADPDAITGVLRRYSCPVREFCPSHIGEASFRHSDRWLRLLALRGVQTLSLDFERSDEESAHTLHPSIFSCRGLTVLRLRGCDI

SEQ ID NO: 33804 - DNA, 619 bp, Panicum virgatum
  misc_feature: Ceres CLONE 1953787-R
gtagcaccaagaagctcaaattcgctataccgcctgaagatgttaatgttgtagagggactctcatgccaattcaataacctgaagagtttgtcactgcaaacaagtttgcacttattttctggtgctctatccttattttgtctgctcaggaatgctcctaaccttgaagttttggacattgagctgtatgatctctactctgtggaggaagatggtgaagtagatagtgactttctgaatgcacaatggactgacgatttgttctccaacctcatacgcgttggtgtgacccatctgatgtgcaggttaagtgagatgtgttttattaagtttattttgtccaaggcaagacgacttcgagaattccatgtgtgtctggatgaaggctgtccaaaatccaacgaagatgcagttacagagtttgtaaaatataggagagcttctccaagagccaaggttttcttcagccgcgcggagtatgactgactcctgtaaaagagtacattaggtttggatgtttggtcctaactcttgggaagtttgaagtttagaatatctgctttgtatgatgtagaatgacacttttttatcaaatatgttgtaaaatgacatgaatg

SEQ ID NO: 33805 - DNA, 755 bp, Panicum virgatum
  misc_feature: Ceres CLONE 1953790
  misc_feature: Encodes the peptide sequence at SEQ ID NO. 33806
acccatcagccatcgccctcacctagctccctcctttcagtttcagtgccactcgtcatcaccagcaacagagccgctccgtttccaagcaatttaccagccaatctcgcccttctttgcttaccacacagcatcaacgatgtcgactgtgagccatgcgtcccttgaccagaagctcgccctcgccaagcgctgctcgcgagaggcgacccttgcaggagccaaggcggcagccgtggccaccatcgcctccgcgatcccaacgctggcgagcgtgcggatgctgccgtgggccaaggccaacatcaaccccaccggccaggccctcatcatctccacagttgctgggatggcatacttcatcgccgctgacaagaagattctgtcactggcgagaaggcactcgttcgaggaagctcccgaccacctcaagaacacctcctaccagggcgccggccgccctcacccggctttcttcaggccatgatgaggcatcttgagagatggcgccctcttggaagttgctgtactctgtgccgtagatgtccgaataaactaatgctattagctcgccaatatcatcaatcactacgggagacagggggtttgccgtgtgcctgttgcacatggcaaagcccaataaacacacggctgctccaatggtacactaatacttcaatggatcaatgtaattagtttgtactactgctgctccaattgaaaaggaatgcaacttggtcttacagtactgatcg

SEQ ID NO: 33806 - protein, 115 aa, Panicum virgatum
  misc_feature: Ceres CLONE 1953790
  misc_feature (11)..(89): Pfam Name: ENOD93 Pfam Description: Early nodulin 93 ENOD93 protein
MSTVSHASLDQKLALAKRCSREATLAGAKAAAVATIASAIPTLASVRMLPWAKANINPTGQALIISTVAGMAYFIAADKKILSLARRHSFEEAPDHLKNTSYQGAGRPHPAFFRP

SEQ ID NO: 33807 - DNA, 489 bp, Panicum virgatum
  misc_feature: Ceres CLONE 1953795
  misc_feature: Encodes the peptide sequence at SEQ ID NO. 33808
cccgaaaccctagctttcctcacgctgcgccgccgacggtgactaggagcaggagccgccgagccggaagagggatctgcgatggccaagtcaaagaaccacacggcgcacaaccagtcgttcaaggcgcacaagaacggcatcaagaagcccaagcgccaccgccagacctccaccaaggggatggacccaaagttcctgaggaacctgaggtactcgaggaagaacaacaagaagagcggtgaggctgaggctgaggctgaggagtaaactggtggaatttcagatgatgaattcctgttttgtatcgctagggtctactgcagtcttgaatttaatgctctgttctgtatgatctaaggagattccttagttggtactaaagcttttctttctttcttttttgtcttgctgcctggctggattttgaattaaaatcgttatttgcagcgttatgagaattggtaacctgagtccgtcgttctagtt

SEQ ID NO: 33808 - protein, 62 aa, Panicum virgatum
  misc_feature: Ceres CLONE 1953795
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFLRNLRYSRKNNKKSGEAEAEAEE

SEQ ID NO: 33809 - DNA, 773 bp, Panicum virgatum
  misc_feature: Ceres CLONE 1953799
  misc_feature: Encodes the peptide sequence at SEQ ID NO. 33810
tcctgcccgttcgtgtcttccccctgttcaatcgttccccacctcgcctcgcgccgcctcgctagggtttcctccgccgcccgttccagtcgccaccatgcctcgccgcagctcaggaaggtcagcaccacgccctgctccgcgtgctgctcctatgaggaacccaccacagccagcacgccaggctcctcctccagccccttctcagagtggtggtggctccatccttggaggaattgggtccacaattgctcaaggtatggcgtttggtactggcagtgccatggcacacagagctgttgatgctgtaatgggcccccgtaccattcagcatgagactgttgtctcggaggctgctgctgctgctcccgcttctccaatgatgaacgctgatgcttgcggcaaccattctaaggccttccaagattgtctcaaccactatggcagcgacatcagcaagtgccagttctaccttgacatgctgaacgagtgccgccgcggtggcgcaattgcataagctgctgcttcattggtgttgattcgtgggttcccttttcactttcatgatatcttattaataagactaagtgaaactatgaactacagccacaacttgatgttttgtgtgccgtgaccactatcactggtgcatgaggttgtggttatgttctgttgtcctgggagtagtacattctgctatcctatattgttggtccagacttgtatggcaccgatgattataaatatttgaatcaagcagtgatcttgggact

SEQ ID NO: 33810 - protein, 139 aa, Panicum virgatum
  misc_feature: Ceres CLONE 1953799
  misc_feature (94)..(135): Pfam Name: CHCH Pfam Description: CHCH domain
MPRRSSGRSAPRPAPRAAPMRNPPQPARQAPPPAPSQSGGGSILGGIGSTIAQGMAFGTGSAMAHRAVDAVMGPRTIQHETVVSEAAAAAPASPMMNADACGNHSKAFQDCLNHYGSDISKCQFYLDMLNECRRGGAIA

SEQ ID NO: 33811 - DNA, 1890 bp, Panicum virgatum
  misc_feature: Ceres CLONE 1953805
  misc_feature: Encodes the peptide sequence at SEQ ID NO. 33812
aaaaaaaaaaaatcagtcttccgtctcacgattccacccaaacccctctccccatccgtctcgttgcaaccctaactgcgaccgccggcctcaggcgatcgcattgttgggcgttcgatggcgacgcatgcctccaagagttacctctgcgcgggcagctcatcgttcgatgatcccgacgtggttgaggtgtctccatcggtcgccgcggccgggggctggacctccggccaccataagaggaagcgcagtcaggttgttcctcatgaagttattgaaattgatgctgatgatgagcctgaaggggctgtgattattggtgagacagcatcagttgacaagaataagaaagctgttgtacaccctattgattggccaaagcattccaagagtagtttgcttcatgatgttgctggcccaagcacatgtacttttaagaaaacagatccatggcttggtgctttaaacaaaacagagtcatggtttggaactttaaacaaaacagatccatggtttggccacaaaccaatacaggatgaatcagtttacaactattctgatgattacccttatgagggatatgaagactatgcttatgatgaagatgagtatgaagacgacagttacsacgcttcacttatcgaaagcgaatataactatagtttgactgcaaaatttgatggtctggctgcacctggtgcagaggcttctttaccatggctgcagaagacttctattgagaatgcaagcaaggccaaaccaacaaagaccatgaatgaaataactgataaaaaatacaaggcatttaagcgattcgatactgtcgatgatcacagtgatcattactatttaaagccagagttaagaaaggttcagatagtgaaaaagccatcaaaagactgggcgaaacgcattcagcatgaatggaaagttctggagaaggatttgccagacacaatatttgtgagggcatacgaggatagaatggacctgcttagagcggtcattatgggaccagctggcactccttaccatgatgggctcttcttctttgacatttacttcccccctcagtatccaagtgtacctccgctggtgaactaccgtgctggtgggttgcggcttaatccaaacttgtatgcttgtgggaaggtgtgccttagcctcttaaacacctggtctggcagtggatgtgaaaggtggaatccatccaattcaaccatgctgcaggtcctggtctccattcaggctttggttttgaatgcaaaaccttatttcaatgagcctggttatgctatgcatgcaaatacacctcacggggagaagaaatccttgacatataatgaagatactttcctcctatcctgcaggacaatgttgtattcgcttcgaaacccaccaaagaactttgaggattttgttgctggccatttccgcaagtatggacgtaacattcttgtagcttgctgtgcctacctggagggtgcgcaagttggatgtcttgttggaaacggaatccaggatgttgatgagggtgacaagagctgctcagtgaagtttaagcactcactgaagaggctatttgaggaacttctgattgaactaactgggaagggtgcagattgtgatgaattctttacccagaaggcgagatctggatcttcttcagcggacaccacattgaggctataatgccgaactggcttccaagagtaataattttgccattcaagctatttgagctaccgctcctataagattgatagtctaactgtcccctgtaggtagtctatgtaaatattcttgtttagctcttctgttaaaacatgattgatatgcccatgcgttttagggtattattgtacaagtatttatcagcggattccctct

SEQ ID NO: 33812 - protein, 524 aa, Panicum virgatum
  misc_feature: Ceres CLONE 1953805
  misc_feature (265)..(414): Pfam Name: UQ_con Pfam Description: Ubiquitin-conjugating enzyme
  misc_feature: SWISSPROT Homolog: EC 6.3.2.19 Ubiquitin--protein ligase
  misc_feature (171)..(171): Xaa is any aa, unknown, or other
MATHASKSYLCAGSSSFDDPDVVEVSPSVAAAGGWTSGHHKRKRSQVVPHEVIEIDADDEPEGAVIIGETASVDKNKKAVVHPIDWPKHSKSSLLHDVAGPSTCTFKKTDPWLGALNKTESWFGTLNKTDPWFGHKPIQDESVYNYSDDYPYEGYEDYAYDEDEYEDDSYXASLIESEYNYSLTAKFDGLAAPGAEASLPWLQKTSIENASKAKPTKTMNEITDKKYKAFKRFDTVDDHSDHYYLKPELRKVQIVKKPSKDWAKRIQHEWKVLEKDLPDTIFVRAYEDRMDLLRAVIMGPAGTPYHDGLFFFDIYFPPQYPSVPPLVNYRAGGLRLNPNLYACGKVCLSLLNTWSGSGCERWNPSNSTMLQVLVSIQALVLNAKPYFNEPGYAMHANTPHGEKKSLTYNEDTFLLSCRTMLYSLRNPPKNFEDFVAGHFRKYGRNILVACCAYLEGAQVGCLVGNGIQDVDEGDKSCSVKFKHSLKRLFEELLIELTGKGADCDEFFTQKARSGSSSADTTLRL

SEQ ID NO: 33813 - DNA, 596 bp, Panicum virgatum
  misc_feature: Ceres CLONE 1953811
  misc_feature: Encodes the peptide sequence at SEQ ID NO. 33814
gaggtcgagatcggcgacactgtcgccaccgttaaggcgaagatccaggacaaggaaggtatcgccgcggaccagcagcggctcatcttcgcggggacgcagctggaggacggccgcaccatggccgactacggcatccagaaggagtccacgcttcacctggagcttggcctcctcggcggcgcctacttctgctggcggatctcgccagccctcctggccctcgcgtacaagtacaacgtcaacaagatgatctgccgcaaatgctatgctcgcctgccgcttggcgccaagaactgccgaaagaagaaatgtggccacagcaaccagctaaggcggaagatgtccagggacgaccggcacgtgttcctttgaatcaaatatctcagtagtactggagttagtatcgtcttctttagtttttgccgtggtgtaaagttgcttctggatactgaacatggaatcatggacaacgctaatgcttgggttatgttgatagcatggttaagaaatgctagttaacatggtagtttaacccatttcttggctgaatgaacactcccggctatgaatgctgctacgttttctcgtctttt

SEQ ID NO: 33814 - protein, 124 aa, Panicum virgatum
  misc_feature: Ceres CLONE 1953811
  misc_feature (67)..(118): Pfam Name: Ribosomal_L40e Pfam Description: Ribosomal L40e family
  misc_feature (1)..(59): Pfam Name: ubiquitin Pfam Description: Ubiquitin family
EVEIGDTVATVKAKIQDKEGIAADQQRLIFAGTQLEDGRTMADYGIQKESTLHLELGLLGGAYFCWRISPALLALAYKYNVNKMICRKCYARLPLGAKNCRKKKCGHSNQLRRKMSRDDRHVFL

SEQ ID NO: 33815 - DNA, 814 bp, Panicum virgatum
  misc_feature: Ceres CLONE 1953820
  misc_feature: Encodes the peptide sequence at SEQ ID NO. 33816
atcacaaccgacctccgatccacttctgctcaccagacactgctaagctagctagctgctttacacttcactcactagtcactagcagcttgatcattcgacgatcagtgagtgttatcatatatcagtcgtagctgcaatattatatatagaattttatatatggctcgcctctccgccgttgtcgccgtcgtcctggtggctgcgctggtggcggccgagaccgcttcggctgcggtgagctgcagccaggtgacgtcggccgtggcgccgtgcctggggtacgccatgggcagctcggcgtcgccctcgtcggcgtgctgcaacggggtgaggtcgctcaacagccgggcgtcgtcgacggcggacaggcaggcggcgtgcgcctgcctcaagaacatggcggggaggctgggtggcaacatgggcaacgccgccgccagcatccccagcaagtgcggcgtcaacgtcggcgtgccaatcagcccaaacgtcgactgcgccaagattaactgataagatgctaaggatggatgctcagctctctatcgtctttgggtatgatgtcggccaacaagagcagagagcagtcgtttaatttactacctcttccttttacatttgtacaacaccacgcaccacctgtgtacgtcgtcgtctatgtacaacaataatcctctctctgcttatgggtttgctgggtctctgttttcatgtactactaccatgatgctgctgctactgcttgttataggcaggtcatgcagctttccgctcaatcaataaactttttttttttttgtaatacctacat

SEQ ID NO: 33816 - protein, 117 aa, Panicum virgatum; identical to SEQ ID NO: 12304
  misc_feature: Ceres CLONE 1953820
  misc_feature (28)..(113): Pfam Name: Tryp_alpha_amyl Pfam Description: Protease inhibitor/seed storage/LTP family

SEQ ID NO: 33817 - DNA, 814 bp, Panicum virgatum
  misc_feature: Ceres CLONE 1953822
  misc_feature: Encodes the peptide sequence at SEQ ID NO. 33818
atttttcgcgaccccacagcaagccctctcggccggcctcaccctcgctgcgcaccaccgagttcgaccgctcgctccaggctagggtttccggcggcgatggcgggcaagggaggtaagggtctcctggcggcgaagacgacggcggccaagagcaccgacaaagacaaggacaaggacaagaagaaggctcccgtctcccgctcctcccgcgccgggctccagttcccggtgggccgcatccaccgccagctcaagtcccgcgcctccgcgcacggccgcgtcggcgccaccgccgccgtgtactccgccgccatcctggagtacctcaccgccgaggtcctggagctggccggcaacgccagcaaggacctcaaggtgaagcgcatcaccccccgccacctccagctcgccatccgcggggacgaggagctcgacaccctgatcaagggcaccatcgccggcgggggcgtcatcccgcacatccacaagtcgctcatcaacaagaccgccaaggagtgaggggggccggtcgaccgcccgcccgcccgcccgcgtgtggatctgtgttcttgccggtccctgagcctgacgatgcagtccatgcggtttaccgtcagttatcgtgtcgtggtaatttaagtgcctctgtggtcagagtggtggtaaactaatactgtttgccggtgcgtttaattaagtaatgtttgggacaggttctctgcttcctgcttgttgaactctcttcaatctgtatgcctaagtacctgaagttataaaccagttatatggttaagtataagctattcagtct

SEQ ID NO: 33818 - protein, 140 aa, Panicum virgatum
  misc_feature: Ceres CLONE 1953822
  misc_feature (35)..(109): Pfam Name: Histone Pfam Description: Core histone H2A/H2B/H3/H4
  misc_feature: SWISSPROT Homolog: EC 2.7.7.7 DNA-directed DNA polymerase
MAGKGGKGLLAAKTTAAKSTDKDKDKDKKKAPVSRSSRAGLQFPVGRIHRQLKSRASAHGRVGATAAVYSAAILEYLTAEVLELAGNASKDLKVKRITPRHLQLAIRGDEELDTLIKGTIAGGGVIPHIHKSLINKTAKE

SEQ ID NO: 33819 - DNA, 863 bp, Panicum virgatum
  misc_feature: Ceres CLONE 1953826
  misc_feature: Encodes the peptide sequence at SEQ ID NO. 33820
gaaacgaaatcacacgcagctcggccaccgcarcrggccascagcatgggcgtggtggcccttctccgcgcgcggcctcatcccggctctccccacgcagaggcggcgcgcgtctcctgcggtgcctctgccgcccgcatccagaaatttgtagctgagactttcttcgagaacaagcaagagctttgcctgtcttcacattaaaggagaactgaagtgaacaacagcaaagggaaaatggcactatcacgtastatgagaacatgtttgcacagtggaaggcttgcccttcttgccatattggtctctggtggaattgtgttgcagatcttggcttgtgctctctataacaactggtggccaatgctaacagttctgatgtatcttatcctaccaatgcccctcatattcttcctgggctctgatacttcctcgatgatgtctaatgggggagatggctgggtgaacttcacgaaattcttgacgggagcatcaatagtggggagcatcgccattccgtcgatcctgaagcacgccggtatcattggatggggagcgctgacgatggagctgtcatctttcgtggtctttggcgtggcaatcatgtggtttctccagatgaacagtgaagacgagtacagcagtgtggtctagacttctagtttcagttctcacatcctcttacccgtgaacttgtttgtacagctgytggaggagcattacttagggaaagatcggatacaatggtacatgtttggtytgcattttgttcgtcccgggaatccgtgatgctgtgcctcacattcagaaaaaaaactgttcgggtggtatttgatttcccgatkgcctgccccagttsgttc

SEQ ID NO: 33820 - protein, 138 aa, Panicum virgatum
  misc_feature: Ceres CLONE 1953826
  misc_feature (16)..(133): Pfam Name: Vps55 Pfam Description: Vacuolar protein sorting 55
  misc_feature (6)..(6): Xaa is any aa, unknown, or other
MALSRXMRTCLHSGRLALLAILVSGGIVLQILACALYNNWWPMLTVLMYLILPMPLIFFLGSDTSSMMSNGGDGWVNFTKFLTGASIVGSIAIPSILKHAGIIGWGALTMELSSFVVFGVAIMWFLQMNSEDEYSSVV

SEQ ID NO: 33821 - DNA, 807 bp, Panicum virgatum
  misc_feature: Ceres CLONE 1953844
  misc_feature: Encodes the peptide sequence at SEQ ID NO. 33822
gcgaagcggtgttcggtaatcctccctaattcttcctccccttcattcgcttccgcttctcgcagcgcggcgaatcccaaatccgcgccgatccgactcgaatcaaccgagagccagggggcactattcgaatcgagacgagcgccatgaacccgagaggctaccgaagcaacagaacttctctcttcgatggcattgaggagggtggaatccgagcaacatcctattcttcccatgagatagatgaacatgaaaatgatcgagctattgatggactgcaggatcgtgtcagcattcttaagcggctgtcaggtggcatccatgaggaggtggagactcataacagaatgctagaccgaatggggaatgatatggatacatcaaggggttttctctctggaactgtagacaaattcaagatggtgttcgagaccaaatcaagtcggaggatgggaaccctggtcgcatcattcgttgcgctttttctgctggtttattacttgaccaggtagaagcatccccgaggaaaccgtatgttggcttggtgtgttgaagaacatgctggaaattgatgtaccggtcgacttacgatgcagtatattatacctttgtgaactcactttcctgaatgcaaagtatgttgatcctggtgtcgcgaattctgcactgtataacgatcacacagcgtgtgttggatggactctttgcactgttgctgtaactagaggaactggaatactgggttcacctttgttgtctgttgctctgtcatgctgttcgtatggtataagcagttggttgccttgc

SEQ ID NO: 33822 - protein, 121 aa, Panicum virgatum
  misc_feature: Ceres CLONE 1953844
  misc_feature (36)..(98): Pfam Name: SNARE Pfam Description: SNARE domain
MNPRGYRSNRTSLFDGIEEGGIRATSYSSHEIDEHENDRAIDGLQDRVSILKRLSGGIHEEVETHNRMLDRMGNDMDTSRGFLSGTVDKFKMVFETKSSRRMGTLVASFVALFLLVYYLTR

SEQ ID NO: 33823 - DNA, 423 bp, Panicum virgatum
  misc_feature: Ceres CLONE 1953847
  misc_feature: Encodes the peptide sequence at SEQ ID NO. 33824
aaaaccccaatcaagtggagcccttcttgaacgagagcgcgacgccaccgcctgcttgcccgagcatcgttaatgcgaaacaactcggcctgccatcttcaaagctttaggggccaatgacgttgctactgcatactaagttacaagtgaagtatacatacttggaaggcatctatctatatatcagaatgatgagcagctgcagtctccattaatatcatatataatatcataatcgccctccaacttattaattagctatatgttagtatatagcagtatctgcaacttaatttttgatccatgcatgtatgtatctggaataatgaagccatgcaccatgtatatatatgtatatgtatgtatctttaatttcttctccatggatatatatgcatatgcttgctgtggaccggcctgcag

SEQ ID NO: 33824 - protein, 35 aa, Panicum virgatum
  misc_feature: Ceres CLONE 1953847
  misc_feature: SWISSPROT Homolog: EC 1.1.1.29 Glycerate dehydrogenase
NPNQVEPFLNESATPPPACPSIVNAKQLGLPSSKL

SEQ ID NO: 33825 - DNA, 764 bp, Panicum virgatum
  misc_feature: Ceres CLONE 1953856
  misc_feature: Encodes the peptide sequence at SEQ ID NO. 33826
aaaaccctcgcgctttgcccccatctccgccccgccgctgcagcgctccgcctccctctcccctcgcacccgcaggctagggttctcctcgagaggcggtgccatgttggtctaccaggatctgctcaccggcgacgagctgctctcggactcgttcccgtacaaggagatcgagaacggcgtgctctgggaggtcgagggcaagtgggtcgtccaaggagcagtggaggtgaacattggtgccaacccgtctgccgagggtggcgaggatgagggcgtagacgatcaggctgtgaaggttgtggacattgtcgacaccttccgtctacaggaacaacctgccttcgataagaagcagtttgtcacatttattaagcgctacataaaaaacctcaccgccaagctggagccggagaaggctgatgagttcaagaagggcattgagggtgccaccaagtaccttcttggcaagttgaaggacctacagttctttgttggcgagagcatgcatgacgatgggagtctcgtgttcgcgtactacaaggaaggagccaccgacccgaccttcctctactttgcgcatgggctgaaggagatcaagtgctaggtgcccccgaccatacaggtgttatcgtgttcttatggttttgttcgtattgtgctgagaaatattgtgctgagaaacggttgtcggcttttaccgccaaaagatactcttactttctggatgtgatctgttactccgtgtttctgttactttccgg

SEQ ID NO: 33826 - protein, 167 aa, Panicum virgatum
  misc_feature: Ceres CLONE 1953856
  misc_feature (1)..(164): Pfam Name: TCTP Pfam Description: Translationally controlled tumour protein
MLVYQDLLTGDELLSDSFPYKEIENGVLWEVEGKWVVQGAVEVNIGANPSAEGGEDEGVDDQAVKVVDIVDTFRLQEQPAFDKKQFVTFIKRYIKNLTAKLEPEKADEFKKGIEGATKYLLGKLKDLQFFVGESMHDDGSLVFAYYKEGATDPTFLYFAHGLKEIKC

SEQ ID NO: 33827 - DNA, 757 bp, Panicum virgatum
  misc_feature: Ceres CLONE 1953858
  misc_feature: Encodes the peptide sequence at SEQ ID NO. 33828
cgagacgaccgcatcggccaggaaagagacgactccgagcacgcgttgtacgggtcgagtcgagtcgtcgacagcggcttcggattcgatgtggattgggtggttttgatgcaagtcttggtcgccagtcctctcgcgcgtgcgaacccagcaccatatcctccccctcttcgtgttctgctgccaaagatatggtcgcaatcgtcggagatgcggatgaagcagctggaggcggtggcggtgccggacctcgttggcgcggcggcagcgcgggagctgaagagagccgctgcgtgggtcggcaagggcgcgacggcggcggcggcgcgggtcagcaggggctcgatggcggtgagaggtgcaaaggcgggtacggcggcgcgggtgggaagacggggacagcagcgcattaccggatttatgtggtggaggtgtgccgaacttgggcgttcaacaacggggggcaccgtgcgctgcagatcaggcctttctcttacggcgagggggtctctcaggcgttagatttcgtgatcagcgaggcaagaaagcaaaatatgcggcagatactcttactctgtaataattgggaacactatggagggaaagcacaatatgtacggtggagaaatgaggccggccaagaactaacctctgattcaacagttaagagctgctacaaagcttttgttcaggtagacaagtacgcattcatcttgtctggctcaagtggcgtaataaaaattatcatattcgtagc

SEQ ID NO: 33828 - protein, 188 aa, Panicum virgatum
  misc_feature: Ceres CLONE 1953858
  misc_feature: SWISSPROT Homolog: EC 3.2.1.78 Mannan endo-1,4-beta-mannosidase
MVAIVGDADEAAGGGGGAGPRWRGGSAGAEESRCVGRQGRDGGGGAGQQGLDGGERCKGGYGGAGGKTGTAAHYRIYVVEVCRTWAFNNGGHRALQIRPFSYGEGVSQALDFVISEARKQNMRQILLLCNNWEHYGGKAQYVRWRNEAGQELTSDSTVKSCYKAFVQVDKYAFILSGSSGVIKIIIFV

SEQ ID NO: 33829 - DNA, 594 bp, Panicum virgatum
  misc_feature: Ceres CLONE 1953873
  misc_feature: Encodes the peptide sequence at SEQ ID NO. 33830
ataggaacccaagcgtgctcctcttgctctacctagctccgggatagtttctcactacacatctttcaccttttctctctctatcttgattgagagccagagagagattgagggagacctagatgatgaagaagcagaggggatcaggaggaggaggagggctcagcaaggtggtgagggagcacaaggccaggctctacatcatccacagatgcgtcgtcatgctcctctgctggcacgactagctcgctactgccagtgccagcactgctggttcatccatcccctcttgacctctctctgaatgacagcacatcggccatcggccgtggattattggaagacgatgaagaaagaatccattgcaagctcgatctacatcgaaacacatctcatcagcgtgcatttgactactactttgaattttctccatttttttccattcctttgttttgactagcatagcgagagcctatctagactctactagctatagttttttgtatataaatgtatattaattgctaatttgctaacttcctgatcgatgtactatataaactccctagctagctacctagctatcaatgtact

SEQ ID NO: 33830 - protein, 40 aa, Panicum virgatum
  misc_feature: Ceres CLONE 1953873
  misc_feature (19)..(37): Pfam Name: DVL Pfam Description: DVL family
  misc_feature: Functional homolog of the protein sequence given in SEQ ID NO 50388
  misc_feature: Useful for making plants with modulated biomass
MMKKQRGSGGGGGLSKVVREHKARLYIIHRCVVMLLCWHD

SEQ ID NO: 33831 - DNA, 1152 bp, Panicum virgatum
  misc_feature: Ceres CLONE 1953874
  misc_feature: Encodes the peptide sequence at SEQ ID NO. 33832
agcaacccgcaaccaccgcacgttaggtatcgaggcaagaacagagcagggcagggcagagcaaagcaaggcgactgccaagtctatcgttggaaagaaggttcagagatggaggggtcgacgactgaagggcatgtggtcgggatcccggtgagcagcagggcttacggcatcgaggagccggagttcccggaggaacagacgcccgatcatggagaattcccgagctccttccaatccagctacgatgcgaacagctccacgacgaccgccgaccggccgacgagcaagcacgccaggaagggagacaagatcgctcagggcatcaaagagcatgtgacgctcgggcccaaactctccgacactgttaaggggaagctcacgctgggcgccaagatcctccaggccggcggcgtggagaaggtgttccggcagtggttctccgtggacaagaacgagaagctgctcagggcctcgcagtgctacctctcgacgacggccggcccgatcgccgggctgctcctcgtgtccacggcgcgggtggccttccgcagcgaccggaccctggcggtgtcctccccgcgcggcgacaaggcgcgcgtgccctacaaggtcaccatcccgctgcggaaggtgaaggcggtgcgccccagcgagaacaagcaccggccggagcagaagtacgtgcagctcgtcaccaacgacggcttcgagttctggttcctgggcttcgtcagctacaaccggtcgctgcactacctggagcaggccgtcgcgtacgcgcagcagcaggcgcaatgacggcgggggctcgacgcacgcgtggcgtggtggagctgctgctgctgctgctgatgatgatgatgatgatggggagtggtttcttcatgtgcgcgccgtgtgtcgtcgtcgtcgtgtaagttgggatagttctgtctgtgtatgtgtagggctgcagcatgtcgttgtacatttggggatcggtcgcctcgcggattaatcggcggtggctagcaagttggttggaggcgatcgatcaagggcatgtgatctttttgggggtttggggaagaggaaaattcatgaattttgcatcagaaaatggttgtgcgccgatggcaaaagttccattaatatccattcttttcccag

SEQ ID NO: 33832 - protein, 230 aa, Panicum virgatum
  misc_feature: Ceres CLONE 1953874
  misc_feature (105)..(183): Pfam Name: GRAM Pfam Description: GRAM domain
MEGSTTEGHVVGIPVSSRAYGIEEPEFPEEQTPDHGEFPSSFQSSYDANSSTTTADRPTSKHARKGDKIAQGIKEHVTLGPKLSDTVKGKLTLGAKILQAGGVEKVFRQWFSVDKNEKLLRASQCYLSTTAGPIAGLLLVSTARVAFRSDRTLAVSSPRGDKARVPYKVTIPLRKVKAVRPSENKHRPEQKYVQLVTNDGFEFWFLGFVSYNRSLHYLEQAVAYAQQQAQ

SEQ ID NO: 33833 - DNA, 781 bp, Panicum virgatum
  misc_feature: Ceres CLONE 1953876
  misc_feature: Encodes the peptide sequence at SEQ ID NO. 33834
aaaacatcagctgcgccattggaggagcctactgacgcaaggtgccaaaggttagaaaaggaccgtgtctctgaccggcaacagctggaggaatcgaatgtgagattcgcagccctcgagatggagtgtgacctgctgagggacaagaactcgtccctgcagcaggagctctctgactccaagcgggaggccagccttctcgtcgcagagaagaaggcgcagctggatgactcggtagccaggtgtgcggcgcttgagagggagctctccgtgtgtaggcaggacgccgagcgcctcgccaccgagaagcaggagctggccggtgagctgggcgtggagaggcagaagatggaggagctgaagcaggacatccgggtgattagccgggccttctcgcagcgggaagggcagctcacgtcgctgtacaccaagtccaaggccatcctggagaactgcaaggcctcgcacgccgctaccctgccttgatggctgagcgagacgcgcgggggcactgctgggtaaggaatgtctctgcaaccgtgtgttggctttaggtgtgctggatttgtgttgtgtgaaaagttcgttcggtggaatacttgtaacaagtgtttgcaagcggtatgtaagttgtgtgtcaacttgaagggtttgccactagcgttctgtgagcgtcaaatgtatttgacctgggaacgagctgtgctaagtattgttataaaccagtcagattgcctttagtgtacaagcattcacaaaagtatagatttgtcacttgttt

SEQ ID NO: 33834 - protein, 161 aa, Panicum virgatum
  misc_feature: Ceres CLONE 1953876
  misc_feature: SWISSPROT Homolog: EC 2.7.11.1 Non-specific serine/threonine protein kinase
KTSAAPLEEPTDARCQRLEKDRVSDRQQLEESNVRFAALEMECDLLRDKNSSLQQELSDSKREASLLVAEKKAQLDDSVARCAALERELSVCRQDAERLATEKQELAGELGVERQKMEELKQDIRVISRAFSQREGQLTSLYTKSKAILENCKASHAATLP

SEQ ID NO: 33835 - DNA, 929 bp, Panicum virgatum
  misc_feature: Ceres CLONE 1953882
  misc_feature: Encodes the peptide sequence at SEQ ID NO. 33836
accccaacggcctccagcatcctcctcagctccttgcgccgccgccacctcctcccccctcgccggccgccgcatccctcaccggaccgccgcatatttctgtcctcctgaaccgccatcgcgaacccgcgcgggagagcaggcggctccaaggaagatggggtggaaggctgcagagaagctcatcaggcactggaaggtcctccgcggtgacaacgttatgatcatcagaggcaaggacaagggggagaccgggctcatcaagcgggtcattcggtcgcagaatcgcgtcatcgtcgagggcaagaacttggttaagaaacacattaagcaaggggaagggcacacaggtggtattttctccattgaagctccacttcatgtttcaaatgtccaagtagttgatcctgtcactgggaaaccatgtaaggttggatacaagtatttggaagatgggaccaaagtcaggtttgctagagggatgaatgcatctggtgctgtgatcccccggccagaaattctgaaggagagaagaaaaccaagacctacatcacctggcccaaaggatacaccaattgagcttgtgctggagaagacctacgatgaaaaagctggaattggaatgcccgatctatagctgccgtgttgtttcatgtttgtgctgagagttcagtatatgtgactaagtcggcaagtcctagttaaggtattagggtgtcatggtgtcaatggtcgttgggcagttgtactgtgcttccctcataataatcatgtactaaaggtcgaaagagacattgctagcatgcatgctttccttatttgttttcttggtgtttggttctgcagaaacgcattcttggatgagatatggccaagatttctttttgctataagtcactgctattggaactgtgattctgaattttcag

SEQ ID NO: 33836 - protein, 159 aa, Panicum virgatum
  misc_feature: Ceres CLONE 1953882
  misc_feature (17)..(48): Pfam Name: KOW Pfam Description: KOW motif
MGWKAAEKLIRHWKVLRGDNVMIIRGKDKGETGLIKRVIRSQNRVIVEGKNLVKKHIKQGEGHTGGIFSIEAPLHVSNVQVVDPVTGKPCKVGYKYLEDGTKVRFARGMNASGAVIPRPEILKERRKPRPTSPGPKDTPIELVLEKTYDEKAGIGMPDL

SEQ ID NO: 33837 - DNA, 637 bp, Panicum virgatum
  misc_feature: Ceres CLONE 1953886
  misc_feature: Encodes the peptide sequence at SEQ ID NO. 33838
gggaattcggaccggggtcgccattgctagctagcttatggtgtactcggatagatcgatgcgtgtgtctcgcacccacagagagagaggatgatcttggtctgagtgagcgttccccttagcacacagatcctcccattcttgtccgcctttgcaacttcttgatcgcttcattgcatctctagctacttcctgctacaccttctaccttcgtcttcggccgatctatagcttcatgaaaaatctgcagatctgcacagatcagtaacactgagctagaatcgggttgtaatcttggtgcagctaattaaggtccttaattcgcagcatatagaccgtacagtatcaggaaatactgcggcgatggcactgtcagcttctctggttcggcaagaagtgccgccggggaggcagttgaggaaccagcttgctgcagccgcgaggagcatcaactggagttatgctctcttctggtccatctcaagcactcagccagggtacgtaattaatgtgtcatgtgtgcaatagagtcaatatttggcggccgcatgtacaaccgcatctatcatttgcatgagcatgagtgcgaatgtatgtaggttatcatccacttattgtcaaattttacatccaattg

SEQ ID NO: 33838 - protein, 54 aa, Panicum virgatum
  misc_feature: Ceres CLONE 1953886
  misc_feature: The sequence is a functional homolog of SEQ ID NO 959 in the 10/374,780 US patent application
  misc_feature: The sequence is a functional homolog of SEQ ID NO 960 in the 10/374,780 US patent application
  misc_feature: The sequence is a functional homolog of SEQ ID NO 116 in the 10/666,642 US patent application
  misc_feature: The sequence is a functional homolog of SEQ ID NO 2036 in the 10/374,780 US patent application
  misc_feature: The sequence is a functional homolog of SEQ ID NO 898 in the 11/479,226 US patent application
MALSASLVRQEVPPGRQLRNQLAAAARSINWSYALFWSISSTQPGYVINVSCVQ

SEQ ID NO: 33839 - DNA, 953 bp, Panicum virgatum
  misc_feature: Ceres CLONE 1953894
  misc_feature: Encodes the peptide sequence at SEQ ID NO. 33840
accacctgcaactatcgctcacccacccataatcgggcgcccgctgcgctccctccgccgccgcgaccaccaaggcgacgagacgatgctgcggatctaccgcttcctcccatccgcctccaggagaggttttgatctaaaagaacctctttggagtggttcgttgacattccaacaagctgtctcaacttcagcaggaaatcttgatgagaacctgtctggtaaaaagtttgcaagctatactgtgttcaagggaaaggctgcattttctattcatcctatactgccaagtttcagcaaaatggaatctggagcatatcggatgaacagaaatggatcagtaatgttgaccttccttcctgctgttggacaaaggaagtatgactatacaaagaaacagctttttgctctgtcacctactgaagttggaagcttgataagtcttgggcctgctgaatcctgtgagtttttccatgatccgtccatgaaatcaagtcatgaaggacaggtgaaaaaatcgctgtcgcttactccccttggcagtgacagtggatactttgttaatataaccgttctgaacaacgtgcagaagactaccgatcgcctttcagtccctatcacaaaagctgagtttgcggtgatgcgcacagcactgagttttgcgttgccacacatcatgggctgggatcaggtgttgacgcaccatccagctcccctagccagcagcaagcctaggatgaagcgtccacacccggattctgaatgggaaaggtgaagctttccttgtagcagcaagatggagtattttgggcatcacgatgaagttgctgctgcaaagtttggaatgttggtgtgcgttgattcagaacacttgtctgctttagatttctgtaacttgagattgaaggcacgatggagcatattttttgttcagtgcatgtataacttcaccg

SEQ ID NO: 33840 - protein, 229 aa, Panicum virgatum
  misc_feature: Ceres CLONE 1953894
  misc_feature (53)..(191): Pfam Name: Whirly Pfam Description: Whirly transcription factor
MLRIYRFLPSASRRGFDLKEPLWSGSLTFQQAVSTSAGNLDENLSGKKFASYTVFKGKAAFSIHPILPSFSKMESGAYRMNRNGSVMLTFLPAVGQRKYDYTKKQLFALSPTEVGSLISLGPAESCEFFHDPSMKSSHEGQVKKSLSLTPLGSDSGYFVNITVLNNVQKTTDRLSVPITKAEFAVMRTALSFALPHIMGWDQVLTHHPAPLASSKPRMKRPHPDSEWER

SEQ ID NO: 33841 - DNA, 582 bp, Panicum virgatum
  misc_feature: Ceres CLONE 1953901
  misc_feature: Encodes the peptide sequence at SEQ ID NO. 33842
ggtgctctctcagaggtgggttggctcctcctccccctcttaccaagtcctcggctctagggttttagtggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggcggcggctacggcggcggtcgtcagggtggctacggcggcggcggcggcggctacggaggcggtggtggctacggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgc

SEQ ID NO: 33842 - protein, 132 aa, Panicum virgatum
  misc_feature: Ceres CLONE 1953901
  misc_feature (17)..(124): Pfam Name: GRP Pfam Description: Glycine rich protein family
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: Functional homolog of the protein sequence given in SEQ ID NO 50144
  misc_feature: Useful for making plants with altered terpenoid content
  misc_feature: Functional homolog of the protein sequence given in SEQ ID NO 50179
  misc_feature: Useful for making plants with modulated phosphate use efficiency
VLSQRWVGSSSPSYQVLGSRVLVGRSRGFGFVTFSSEQSMLDAIEAMNGKDLDGRNITVNQAQSRGGGGGGYGGGRQGGYGGGGGGYGGGGGYGGGRREGGYGGGGGGGRREGGYGGGGYGSRGDSGGNWRN

SEQ ID NO: 33843 - DNA, 636 bp, Panicum virgatum
  misc_feature: Ceres CLONE 1953903
  misc_feature: Encodes the peptide sequence at SEQ ID NO. 33844
ctgattctcatgcgaaccttaccggtgtacggaacggcgtccctataggccctcagggcggttcatcttggctctatatctaccctcaagggttccgtgatctgctgctgtatatcaaaaagtactacggcaatccgcccatctacatcactgaaaatggcgttgatgaaaaaaacaacaagagcctgccactgaaggaggctctcaaggatgacactaggatatattactatcgcacgcacctcctctccatgctaagtgctataaaggagggggcaaacgtgaaagggtacttcgcgtggtcgctgctggacaacttcgagtgggcgaacggctacacggtccggttcgggatctacttcgtcgactataacgacgggtacaagcggtaccccaagaaatctgcttactggttcaagaagttcctcgagaaatgagcatgagcgagatgcgctgggacaaataaatgaaccgtgcggttgatttatgtttaccctgagagagtgctgcaataaaagggtccacattttgttgcaattgtatgtgtattgatgagtgtagatggagatgagcgctcatatgctttctttcagagaaaacgtacaactttcggctgaaataaattgggaatttggc

SEQ ID NO: 33844 - protein, 144 aa, Panicum virgatum
  misc_feature: Ceres CLONE 1953903
  misc_feature (1)..(144): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 51446
  misc_feature: Useful for making plants with altered cell wall content and/or composition
  misc_feature: Functional homolog of the protein sequence given in SEQ ID NO 50615
  misc_feature: Useful for making plants with modulated biomass
  misc_feature: Functional homolog of the protein sequence given in SEQ ID NO 50586
  misc_feature: Useful for making plants with altered carbohydrate content
DSHANLTGVRNGVPIGPQGGSSWLYIYPQGFRDLLLYIKKYYGNPPIYITENGVDEKNNKSLPLKEALKDDTRIYYYRTHLLSMLSAIKEGANVKGYFAWSLLDNFEWANGYTVRFGIYFVDYNDGYKRYPKKSAYWFKKFLEK

SEQ ID NO: 33845 - DNA, 651 bp, Panicum virgatum
  misc_feature: Ceres CLONE 1953912
  misc_feature: Encodes the peptide sequence at SEQ ID NO. 33846
accactcctccccttccaccccagcacccggcggcggcggcgagcggcgagcggcggagatgacgacgagcctgaagaagaaccggaagaagcgcggccacgtgtccgcggggcacggccgcatcggcaagcaccggaagcacccgggaggccgcgggaacgccggtggcatgcaccaccaccgcatcctcttcgacaagtaccacccgggctacttcggcaaggtgggcatgcgctacttccacaagctccgcaacaggttctcctgcccgtcggtcaacgtcgagcggctctggtcgatggtgcccgccgacaaggccgcggaggcggcggccggcgcggacaaggccccgctggtggacgtgacgcagttcggctacttcaaggtgctcggcaaggggatgctgccgcccaagcccatcgtcgtcaaggccaagctcatctccaaggtcgcggagaagaagatcaaggccgccggcggcgccgtcgtgctcaccgcataggtctttttacatcttgtttcgtctatctgtgctaagagaacttatgaatttgttgtggattctgagttttgagaaccccccccccccccccctttttttttggtgcacttggtaacgaatggtaacgaatgccagttcatttacctgg

SEQ ID NO: 33846 - protein, 147 aa, Panicum virgatum; identical to SEQ ID NO: 13747
  misc_feature: Ceres CLONE 1953912
  misc_feature (109)..(141): Pfam Name: L15 Pfam Description: Ribosomal protein L15

SEQ ID NO: 33847 - DNA, 613 bp, Panicum virgatum
  misc_feature: Ceres CLONE 1953913
  misc_feature: Encodes the peptide sequence at SEQ ID NO. 33848
cttctcgcgccgccggaacggaacactcccaacccgaatcgccgcccctcggagcagagcggaggagaggagatggccgagaagaagggagcagcggcgaggaaggaggaggtggtcaccagggagtacaccatcaacctccacaagcgcctccacggctgcaccttcaagaagaaggcgcccaatgccatcaaggagatcaggaagtttgcacagaaggctatgggcaccacagatgtccgggttgatgtgaagctcaacaagcacatctggagcagcgggatcagaagcgttccgcggagggtgcgtgtgagaatcgcccgcaggaggaatgatgaggaggatgccaaggaggaactctactcccttgtcactgtcgctgagatccctgctgagggtttgaaagggctgggaaccaaggtcatcgacgaagcggattaagctctcacatcctctacatctttagaacgagtgtagcttgtattggcaacagcaaaccttttgtgccccaaagaagttctgaactcttgtactgtgatgcgacatcacacagttgtctatttccttaaatcgaattcaatggttagttattcatttcttcaaaattgccctt

SEQ ID NO: 33848 - protein, 122 aa, Panicum virgatum; identical to SEQ ID NO: 13505
  misc_feature: Ceres CLONE 1953913
  misc_feature (10)..(104): Pfam Name: Ribosomal_L31e Pfam Description: Ribosomal protein L31e

SEQ ID NO: 33849 - DNA, 924 bp, Panicum virgatum
  misc_feature: Ceres CLONE 1953918
  misc_feature: Encodes the peptide sequence at SEQ ID NO. 33850
aacaagctctgctccattccccattccagttccccacactcgccccgctccccgattcccgacgacgagctcggagctccccctccccagctcggtgctcgccgcgacaaccgcagccatggccgccgccaaccagctgaccgccctcctcaacagcatgtacgccacgggtttgctggatgagcaattccagcagttgcagatgctccaggacgccagctcccctgacttcgtctccgaggtcatcaccctcttctgcgaggacggcgacaggatcatcagcgagctcgccaagctgctggagaagcccagcgtggattttgacagggtcgacgcatatgtgcatcagctcaaggggagcagtgcaagtgtcggtgcccagaaagtcaaaaacacctgcatccagtttcgagagttctgccagtcaaggagcagggatggatgcctcaaaacactggactcagtaaggactgagttttatgatctacgtggcaagttccagaccatgctgcagctgcaaaggcagctccatggcttctaccccaagtaaaccagagttggggagtggagctgcatgtcgggatgatgcttacacctctcaagtttcaagaacatgccgattgcgctcctcagttggcttctgtgaagcctgcaataacgtagctgcgagattagcgctgacacctttgacgtcatcatcctagtatcatccgtgtcaggtgatccatgttcctgcaaccagtcgcaggtcatatggtcactcctagtagtagtcatcatttcgtattctcttaggtacccaatccgcatagcggtttgagctgaaacggtgtcaagctagtccatcgcctgtgccctggtgatgttatttggtgaagcagaacaatgctctggttaatgtggatgaatctgttgcttggtgac

SEQ ID NO: 33850 - protein, 143 aa, Panicum virgatum
  misc_feature: Ceres CLONE 1953918
  misc_feature (41)..(126): Pfam Name: Hpt Pfam Description: Hpt domain
MAAANQLTALLNSMYATGLLDEQFQQLQMLQDASSPDFVSEVITLFCEDGDRIISELAKLLEKPSVDFDRVDAYVHQLKGSSASVGAQKVKNTCIQFREFCQSRSRDGCLKTLDSVRTEFYDLRGKFQTMLQLQRQLHGFYPK

SEQ ID NO: 33851 - DNA, 679 bp, Panicum virgatum
  misc_feature: Ceres CLONE 1953930
  misc_feature: Encodes the peptide sequence at SEQ ID NO. 33852
accactcagctcaaccagtcaagctcaacgcaagcgaccacaagcactgaagcagccactcgactccacataccaagctcaagcatccacctgaagaaaacagcagcagcagccagcaggaagcagccatggacatgggccgcctcgagcgctcgacctcctcctcctcgtcctccaccacctcggcgtcctcgtcctcgtcgggcaggaacgacaaggcgtcgccgccctcgaggccgtcgcggacttccagcgccgctccggtgccaatgacagcgccgccgccgcggtcgacaaggcgacctcgagcatgtcggctccgccgccgttgccgggcatttccgggtcgctggcgacgtcccttgagcacgtacccgcgaaggctgatgagacggcggcgttggacggcggcgcgttcgagcccgactggttcggcgacatggacctggacacgtactacgccagcctcgcggagggtctgctcatggagccgccgccgcccccggcggccgcctgggaacatggcgactttggcgacggcggagcggacgtcgcgctctggagctactagagagtttcaaataagcttgccgatcccccaactgattgtactgtaatctgtacttctgtaacaaaattcaaacttcaacggttcaaagaattttgtctcaaactttcc

SEQ ID NO: 33852 - protein, 86 aa, Panicum virgatum
  misc_feature: Ceres CLONE 1953930
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
  misc_feature: The sequence is a functional homolog of SEQ ID NO 752 in the 11/435,388 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 1228 in the 10/374,780 US patent application
  misc_feature: The sequence is a functional homolog of SEQ ID NO 722 in the 11/435,388 US patent application
  misc_feature: The sequence is a functional homolog of SEQ ID NO 1227 in the 10/374,780 US patent application
  misc_feature: The sequence is a functional homolog of SEQ ID NO 706 in the 11/435,388 US patent application
  misc_feature: The sequence is a functional homolog of SEQ ID NO 2 in US patent 7138277
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
MSAPPPLPGISGSLATSLEHVPAKADETAALDGGAFEPDWFGDMDLDTYYASLAEGLLMEPPPPPAAAWEHGDFGDGGADVALWSY

SEQ ID NO: 33853 - DNA, 814 bp, Panicum virgatum
  misc_feature: Ceres CLONE 1953952
  misc_feature: Encodes the peptide sequence at SEQ ID NO. 33854
gagccctctcttcttccttcccaccccacccccaagcgtctcgctagggtttccctcttttaatcccctgccgccaccacccgccactctcaggacccgaccctcctcccacctcctcgccccgccgccgccgcccgagggaccattcgccgcgtcaccaatggcttccgagaagaagcaggctaaccctatgcgggagatcaaggtgcagaagctggtgctcaacatctccgtcggagagagcggggatcgtctcacccgcgcctccaaggtcttggagcaactgagtggccagtcaccagtgttctctaaggctaggtacactgtccgttcctttggtatcaggcgtaatgagaagattgcctgctatgttactgtaaggggtgagaaggcaatgcaacttctggagagtggattgaaggtcaaggaatatgaactgctaaggaggaacttcagtgagacagggtgctttggttttggtatccaggagcacattgatcttggcatcaagtatgatccttccactggtatttatggaatggacttctacgtcgtccttgagcgcgctgggtaccgcgtcgctcgccgccgcaggtgcaagtcccgtgttgggatccagcacagggtgaccaaggaggatgccatgaagtggttccaggtgaagtacgaaggtgtcatcctcaacaaggcccaggctaacacttagaaccgtgatgtgtagtcccagccgttagacatgttaccttgacagacgatttcacctctatggaagttctcggtctactttgtgcaatgtcggataatattatttacc

SEQ ID NO: 33854 - protein, 181 aa, Panicum virgatum
  misc_feature: Ceres CLONE 1953952
  misc_feature (66)..(165): Pfam Name: Ribosomal_L5_C Pfam Description: ribosomal L5P family C-terminus
  misc_feature (9)..(62): Pfam Name: Ribosomal_L5 Pfam Description: Ribosomal protein L5
MASEKKQANPMREIKVQKLVLNISVGESGDRLTRASKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQANT

SEQ ID NO: 33855 - DNA, 497 bp, Panicum virgatum
  misc_feature: Ceres CLONE 1953958
  misc_feature: Encodes the peptide sequence at SEQ ID NO. 33856
atcgctccgtctccctctccaccacagcaggctagctagggttttctgggatttgcgagggggttgctcgtgctccggtccggcgggaggggggagatggcggcggagcgggctcaggggacggtgaagtggttcaacgggaccaaggggttcggcttcatcagccccgacgacggcggccaggacctcttcgtccaccactcctccgtcaaggccgacggcttccccaacctcaaggacggtgacgccgtcgagttcacagtcggcgccgacagcgacggccgcgccaagggcatcgacgtctccgcgcccggcggcggcgcgctcgccggcggggagcgcccggacaacggctacggcggacgcggcgaccgcggctacggcggacgaggtgaccgcggctacggcggaggcggcggcgaccgcggctgcgggggaggaggtggctacggaggaggcggcgaccgtggctacggcggcggcggcggaggcggccg

SEQ ID NO: 33856 - protein, 133 aa, Panicum virgatum
  misc_feature: Ceres CLONE 1953958
  misc_feature (5)..(72): Pfam Name: CSD Pfam Description: 'Cold-shock' DNA-binding domain
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
MAAERAQGTVKWFNGTKGFGFISPDDGGQDLFVHHSSVKADGFPNLKDGDAVEFTVGADSDGRAKGIDVSAPGGGALAGGERPDNGYGGRGDRGYGGRGDRGYGGGGGDRGCGGGGGYGGGGDRGYGGGGGGG

SEQ ID NO: 33857 - DNA, 618 bp, Panicum virgatum
  misc_feature: Ceres CLONE 1953975
  misc_feature: Encodes the peptide sequence at SEQ ID NO. 33858
acaggagcccgcggagtgataaaaaaagcaagtaacaagagaagatgaccgacgttgtgatgaccatcagtactaccacggatttggaaagagaactgaataaacccgacaagctgattgtgctggagttcatggcgccgtggagtgagccatgcaaggtcatgaaggaaccttataggcgaatcgccagagcaagaaaagacagagtcaacttctacacgctcaacgtcgacaagttcaaagatttggcggaggaagctggcgtggaggcgctaccgacgtacgttctactgaagaatgacgatgtgatggacatggtcgttggcgtcaggaggcacgagctcgagaacgccataaaaaacaatacctaacgactgatccgatcagatcatccatgcgtcgagaacgaacgggaaatgaattattcatagttaattaagcccactactgtacgtcccatgtgttgtatcacggatactgaaactcgtgtgtgcatgtacgtatggatctcgattatcgattgtcccatgtttgatttcctaaacttctgtggaactagatccccatgttatgtatactctggtttgaaacagtttgcaataaatcaatgtctggctg

SEQ ID NO: 33858 - protein, 108 aa, Panicum virgatum
  misc_feature: Ceres CLONE 1953975
  misc_feature (4)..(107): Pfam Name: Thioredoxin Pfam Description: Thioredoxin
  misc_feature: SWISSPROT Homolog: EC 1.8.1.8 Protein-disulfide reductase
MTDVVMTISTTTDLERELNKPDKLIVLEFMAPWSEPCKVMKEPYRRIARARKDRVNFYTLNVDKFKDLAEEAGVEALPTYVLLKNDDVMDMVVGVRRHELENAIKNNT

SEQ ID NO: 33859 - DNA, 632 bp, Panicum virgatum
  misc_feature: Ceres CLONE 1953977
  misc_feature: Encodes the peptide sequence at SEQ ID NO. 33860
aaccggttgccagttagggtttggccgcgcgcgaaaaatggcgagcacctcctccactccggcggcggcgtagcagcagcagaaggacccgaagatggtgaagttcctgaagcccggcaaggccgtgatcctcctccagggccggttcgccggccgcaaggcggtgatcgtgcgcgtgttcgaagagggtacccgcgaccgcccctacggtcactgcctcgtcgccggcctggccaagtaccccaagaaggtgatccgcaaggactccgccaagaagaccgccaagaagtcccgcgtcaagtgcttcatcaagctcgtcaacttcacccacatcatgcccacccgctacacgctcgacgtcgacttcaaggacgtcgcctcgggcgggcccgacgcgctctctacccgggacaagaaggtcgccgcttgcaaggccgccaaggcgcgcctcgaggagaggttcaagaccggcaagaacaggtggttctttaccaagctccgcttctagatgcttggcgtcccgcatagtgcctgctttaggtgtcagtttcttgtatcggacactctttaagctatctctgctttggtattgccatgaagacttcgtgcttagtattacggatctcggagat

SEQ ID NO: 33860 - protein, 137 aa, Panicum virgatum
  misc_feature: Ceres CLONE 1953977
  misc_feature (52)..(137): Pfam Name: Ribosomal_L27e Pfam Description: Ribosomal L27e protein family
  misc_feature (7)..(40): Pfam Name: KOW Pfam Description: KOW motif
MVKFLKPGKAVILLQGRFAGRKAVIVRVFEEGTRDRPYGHCLVAGLAKYPKKVIRKDSAKKTAKKSRVKCFIKLVNFTHIMPTRYTLDVDFKDVASGGPDALSTRDKKVAACKAAKARLEERFKTGKNRWFFTKLRF

SEQ ID NO: 33861 - DNA, 751 bp, Panicum virgatum
  misc_feature: Ceres CLONE 1953978
  misc_feature: Encodes the peptide sequence at SEQ ID NO. 33862
cttaagggtaaacatagaaagatccatcttttcgacattgatattccagggaagattactttcaaggaatcaaagactcttactgctgggcagaatcctactgttgtagacacagatgtcggccgaattggtattggtatatgctatgacatccgcttccaggaattagcaatgatgtatgctgcaagaggtgctcatttgttgtgctatcctggtgcattcaacatgactaccgggccattgcactgggagttgctgcaaagggcgagggctgcggataaccagctgtttgtggcaacatgtgctccagctcgagatgccagtgcaggttatgttgcttggggacactccactcttgttggaccttttggagaggtgattgcaacaactaagcatgaggaggcaactataatagcagaaatagactattcattgattgagcagaggaggcaatttcttcctctgcaataccaacggcgtggcgatctctatcagctcgtagatgttcagagactgggttctcagtagcaatctcgtacggcttcgttcgtgagatgcacatgcatgcccttgtctggacagatctgatcgagctggtttgtgaagagaagatgaataaggtgactcaataacttgtagaccttcatcctcccgagtcgccaaagatgattactcctgtgtattaagacgatgtattgtcttcatgaaacaaagataatgaaagatgtccctctaatttctttcttggctc

SEQ ID NO: 33862 - protein, 175 aa, Panicum virgatum
  misc_feature: Ceres CLONE 1953978
  misc_feature: SWISSPROT Homolog: EC 3.6.1.29 Bis(5'-adenosyl)-triphosphatase
LKGKHRKIHLFDIDIPGKITFKESKTLTAGQNPTVVDTDVGRIGIGICYDIRFQELAMMYAARGAHLLCYPGAFNMTTGPLHWELLQRARAADNQLFVATCAPARDASAGYVAWGHSTLVGPFGEVIATTKHEEATIIAEIDYSLIEQRRQFLPLQYQRRGDLYQLVDVQRLGSQ

SEQ ID NO: 33863 - DNA, 608 bp, Panicum virgatum
  misc_feature: Ceres CLONE 1953986
  misc_feature: Encodes the peptide sequence at SEQ ID NO. 33864
atagttcttgctttgacacacgcatcatccatccggcgaaacagtgtgctagcagctgatcaatcgatcgaatccatccatccgtcatgagctaccaagcaggctacccgccgccgggccagcaggcctacggcggcgcgcccccgccgccggcctacgtcgcgccgccgccggcgtacccgcccacccaggacggcgggtaccagcagcagcagcagccggagaccaccagccgcggcggcgacggcttctggaaaggatgctgcgccgccgtctgctgctgctgcctcctcgacatgtgcttctgaggacgacgacgagtggcgacaccagctagttgctcatcacgatgattcattgctcaatttgtgtggttgtacctttgttcagtattattgttccatttattggtagtatgactactaggagcgtcacgggtgatttgttgatttcgagtatgtgctggctcaatgttttgaaggtgtttgtagaggtagaatgatgtgtgtatttaccagagtgagtgtacgcgcgtgtttgagagtttctacgtgtacactacgtggtccactacgtgtacaaacttctttttaaaagaattttctcat

SEQ ID NO: 33864 - protein, 73 aa, Panicum virgatum; identical to SEQ ID NO: 14742
  misc_feature: Ceres CLONE 1953986
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: Functional homolog of the protein sequence given in SEQ ID NO 50152
  misc_feature: Useful for making plants with altered carbohydrate content

SEQ ID NO: 33865 - DNA, 557 bp, Panicum virgatum
  misc_feature: Ceres CLONE 1953987
  misc_feature: Encodes the peptide sequence at SEQ ID NO. 33866
atcatcgcatcggcactcctctctgcaaagagagctatcggaggaggaggagagcttttgggcttttgggggtgcgtggtgcgccatgggggaggtgaagcacctgtgcctggtgaagttcaaggagggcgtcgtggtggaggacgtcctcaaaggcatgaccgaccttgtcgcccggatggacatggtcaaatccttcgagtggggccaggacgtgctgaaccaggagatgctgacgcagggcttcacgcacgtcttctcgctcaccttcgcctccgccgacgacctcgccacctacatgggccattgtacggtgccttttcaggtagcagatcatcgcctattttgcagcggtgatgtactgcgtgtctaagtacgtactatgtactaagctccttattactactcgttctgcctgatgctgtgtcccgtactctaggacgtttattgtagctgtaaggccaagatatctatagcgtacgtgcagcactccgtgctccacagtccctaatggttggttggttatctttggaataaattttggtgatctttctggt

SEQ ID NO: 33866 - protein, 95 aa, Panicum virgatum
  misc_feature: Ceres CLONE 1953987
  misc_feature (4)..(92): Pfam Name: Dabb Pfam Description: Stress responsive A/B Barrel Domain
MGEVKHLCLVKFKEGVVVEDVLKGMTDLVARMDMVKSFEWGQDVLNQEMLTQGFTHVFSLTFASADDLATYMGHCTVPFQVADHRLFCSGDVLRV

SEQ ID NO: 33867 - DNA, 950 bp, Panicum virgatum
  misc_feature: Ceres CLONE 1954018
  misc_feature: Encodes the peptide sequence at SEQ ID NO. 33868
acacatttccaccgccgcctgccgccgcctcatcatcatcatcggcagccgcaatccgcgcacgcggcgcgccgctcgccgctcgccgctcgcttccaccgctgcccgcccgtcgctggcctcgcctggcagcagatccacccgccgatgcgccgctcctgatctccgaaggcaactgccaccggcggtgcccccgtcccgtcccgtccgtccccgagcgcggtgacgctcgtgatcctcgtcgccaagctcgtcgtccgatccgtagatcactgtcccccaggctgaatcgtggctggtattggcgatataagcgctcattagctgttttatctttgttcctgggtctttgattaagagtaattgagaagactgtgcatgagaaaacgcttttgttcaaacatttctctcctgtaatataaataacctggtggcatattaatcttggatacttggtcaactgcaaacttggagcttcgtgttcatgtcatcaatggagagcctagcacagttagaggtgctgtgtgaaaagctttataattctagagactcggctgagagagcgcatgcagaaagcaccctcaaatgcttctcagagaacagcgagtacatttcacagtgtcaatacatattggacaatgcttcaactccatacgctctgatgttggcgagttcaagcttgttgaagcaagtttcggaccgcagtctttctttgcagctccgcctcgatatacggagttatgtcataaactatcttgctggaaggggtcccaatttgcagaactttgtcattgtgtccctaattcagctggtttgtcgaattacaaaatttggatggtttgatgatgacagattcagagagactgtgaaggaagcgatggatttcttaggtcttgcatctcaggatcattatttcataggattgaagatactaaacaatctcgtgacag

SEQ ID NO: 33868 - protein, 152 aa, Panicum virgatum
  misc_feature: Ceres CLONE 1954018
  misc_feature (26)..(90): Pfam Name: IBN_N Pfam Description: Importin-beta N-terminal domain
MESLAQLEVLCEKLYNSRDSAERAHAESTLKCFSENSEYISQCQYILDNASTPYALMLASSSLLKQVSDRSLSLQLRLDIRSYVINYLAGRGPNLQNFVIVSLIQLVCRITKFGWFDDDRFRETVKEAMDFLGLASQDHYFIGLKILNNLVT

SEQ ID NO: 33869 - DNA, 754 bp, Panicum virgatum
  misc_feature: Ceres CLONE 1954034
  misc_feature: Encodes the peptide sequence at SEQ ID NO. 33870
cgtcgagcgacgtgacgatcccggtggtggacctgagctacaaccggttctggggccagctgtcgccgctgctggccggcgtcgggcagctgtacctgaacaacaaccggttcaccggcgaggtcccgtcgcggctggtgcaggagctggtgggctccggcgggctgcaggtgctgtacctgcagcacaacttcctgacgggcatcgagatatcgccgtcgtcgtcgctcccctccaccgtctcgctctgcctcatgtacaactgcatggtgccgccggtgtacgcgccgtgcccgatcaaggccgggtcgcagaacacgcggccggcagaccagtgcccggagtggaggggctgagcaccgagctagctccaggctgatcgtgcctcagcaacgccaatgccaatgccggatcgcctcggatcatcggtcggaaatcgaagaactgatgaagaacagactgaacagtggagattgcaaagcgccgtgtggtctctgattctttgattgatttgtccagttgttacttgtgttcttgattcttttttttttttctggtttgggaggatagttacagacaagtaagtgcctcaataatcgggtgttacaggtgtagtaagtttttgcttaggtgtactccgatgtgcattgtgtctcccccctctgcttgtatagtgagctagctactgtcacactggctcctgatgctgctggatcagacgagaagatggatggtgctgagagccggtgacgct

SEQ ID NO: 33870 - protein, 117 aa, Panicum virgatum
  misc_feature: Ceres CLONE 1954034
  misc_feature: SWISSPROT Homolog: EC 2.7.11.1 Non-specific serine/threonine protein kinase
SSDVTIPVVDLSYNRFWGQLSPLLAGVGQLYLNNNRFTGEVPSRLVQELVGSGGLQVLYLQHNFLTGIEISPSSSLPSTVSLCLMYNCMVPPVYAPCPIKAGSQNTRPADQCPEWRG

SEQ ID NO: 33871 - DNA, 829 bp, Panicum virgatum
  misc_feature: Ceres CLONE 1954076
  misc_feature: Encodes the peptide sequence at SEQ ID NO. 33872
ctcgagtttcttggagatgctgtattagatcatattttcactgattatttctaccatctgtaccctgaatgcactccagaattgttgacagatctgagatctgcttctgtgaacaactattgctatgctcatgcagcagttaaagcaggattacataagcatgttcttcattcgtcatctgcactgtacaataggatggatgactaccttaaaactttcgggcagccattttcaggtccatcatatggctgggaagctggcatcggtctacccaaggttctcggcgacgtaattgaatctattgccggtgcaatatatgttgacagcaagtgcaacaaagagattgtttggagaagcatgaaacggttactggaacctcttgctacccctggcactctggagatggaccctgtgaaagagctgcaggaattttgcaatagcaaagcttacagcattacttacacggtgactcatgataaccgagtatcatcagtaatcgcagaagtgcagaccaaagggactgcatacaaggccactcagaggggcataaccgcggatgacgccaaaaagttggcagccaaagccgtcctcaaagatatgaaggctgctgatggaagtaatttgcaaatggtgtgatcatgtttactagaatctcttagttgcatagtagacttttgtataggtttcatggttcagaaaatgtcatatcagtgaagtacgggcatatatatctcagacaattaattgtacagtacaggtgcccgcgctacagtttctctacttttgctactagtcattcttactgtacagaaatgttttgttttggttc

SEQ ID NO: 33872 - protein, 211 aa, Panicum virgatum
  misc_feature: Ceres CLONE 1954076
  misc_feature (1)..(110): Pfam Name: Ribonuclease_3 Pfam Description: RNase3 domain
  misc_feature: SWISSPROT Homolog: EC 3.1.26.3 Ribonuclease III
LEFLGDAVLDHIFTDYFYHLYPECTPELLTDLRSASVNNYCYAHAAVKAGLHKHVLHSSSALYNRMDDYLKTFGQPFSGPSYGWEAGIGLPKVLGDVIESIAGAIYVDSKCNKEIVWRSMKRLLEPLATPGTLEMDPVKELQEFCNSKAYSITYTVTHDNRVSSVIAEVQTKGTAYKATQRGITADDAKKLAAKAVLKDMKAADGSNLQMV

SEQ ID NO: 33873 - DNA, 463 bp, Panicum virgatum
  misc_feature: Ceres CLONE 1954079
  misc_feature: Encodes the peptide sequence at SEQ ID NO. 33874
atcctcacaccacgccgtgccacgaatcgcgtcgatcctcctgcgcgccatggccaccgcgtctctgtccgccgtcgcgtcgccgctgtccgtcgccgggctcaggaagccgctcggcgccgcggcggcgtcgtcgttccagcccctgcagccgagggcggccgtggcggcggctctcgtgctgcctgacgtcgctgaggccgcgcagtccgggctgacgccgtcgctcaagaacttcctgctcagcatcgtgtccggcggggtcgtcctcgtggccatcgtcggcgccgtcgtcgccgtctccaactttgacccggtcaagcgggcctgagggatcattcgttcgcagtggcggatgcacgttgggagataaggggggctgaaacaataaaaatgttgatttgtgtgaagatttaatggtgatttgggacttttgctacggtgttttacgtgtaattagggg

SEQ ID NO: 33874 - protein, 93 aa, Panicum virgatum
  misc_feature: Ceres CLONE 1954079
  misc_feature (56)..(93): Pfam Name: PsbX Pfam Description: Photosystem II reaction centre X protein (PsbX)
  misc_feature: Functional homolog of the protein sequence given in SEQ ID NO 50416
  misc_feature: Useful for making plants with modulated nitrogen use efficiency
MATASLSAVASPLSVAGLRKPLGAAAASSFQPLQPRAAVAAALVLPDVAEAAQSGLTPSLKNFLLSIVSGGVVLVAIVGAVVAVSNFDPVKRA

SEQ ID NO: 33875 - DNA, 653 bp, Panicum virgatum
  misc_feature: Ceres CLONE 1954088
  misc_feature: Encodes the peptide sequence at SEQ ID NO. 33876
accatcgcagctagggttttcggctcgccgatctcgcgccgccgccaggactctcagaagggcggagaggaggaagctacagatcggcagccatggtgaacgttccaaaaaccaagaaaacctactgcaagaacaaggagtgcaggaagcacaccctgcacaaggttacccaatacaagaaaggaaaggatagcctctcagctcaagggaagcgtcgttatgaccgcaaacaatcaggatatggtggtcagacaaagcctgttttccacaagaaggccaagacaacaaaaaagattgtgctgaagttgcagtgccagagctgcaagcactactctcagcacccgatcaagaggtgcaagcactttgagattggtggcgacaagaagggcaagggaacctctctcttctaaactgatgataaacttgttttttgcccccaagttgtctgcccgaagttaccattaggaatgttctatgttatccatatagtgagatacatcgatggcaacccttatgctttgtatctgcatcagctgttctgttggataaatttggtacgatatttgtatgagaccagatgatgaatatgttttatgctgcaagttcttagccagcattgatcgggttctcttacagtggttaagatagttctc

SEQ ID NO: 33876 - protein, 105 aa, Panicum virgatum; identical to SEQ ID NO: 12877
  misc_feature: Ceres CLONE 1954088
  misc_feature (19)..(95): Pfam Name: Ribosomal_L44 Pfam Description: Ribosomal protein L44

SEQ ID NO: 33877 - DNA, 1014 bp, Panicum virgatum
  misc_feature: Ceres CLONE 1954106
  misc_feature: Encodes the peptide sequence at SEQ ID NO. 33878
agcttctccttctcgctcgctccgtcgccctccccgagccgaaccctaaccaagggagttgagttgagtcaccggttgcagccatgagtaagttgcaatcagaggccctcaaggatgccatctcccagatcgttggggatgccaaggagaagaataggaagttcaccgagactgttgagcttcagattggtctgaagaactacgacccgcagaaggacaagcgtttcagtggctctgttaagctgcctcacatcccccgcccaaagatgaaggtgtgcatgcttggtgatgcccagcacgttgaggaggctgagaagattggacttgactacatggatgttgaggcactcaagaaaatgaacaagaacaagaagcttgtcaagaagcttgccaagaagtaccatgctttcttagcatcagaggccatcatcaagcaaattccccgtctccttggtcctggtctcaacaaggcaggcaagttccctacactggttacccaccaggagtctcttgaatccaaagtgaatgagacaaaagctacagtcaagttccagttgaagaaagttctttgcatgggtgttgctgtgggtaacctgtccatggaggagaagcagatccagcagaacatccagatgagcgtcaacttccttgtgtcccttctgaagaagaactggcagaatgtgagatgcctgtacatcaagagcaccatggggaagccatacagggtgttctaagtcttgccgcgatcctagtgaagttactaggcctctccagctgggcttgtcttaaaacttagatatgtacccatcagttttgtgcctgtcaatgagaatgtttaagtatttggtccttgatctagtgtttcctttaatagaacctgaggagcaatgtttttgggattatgcagttgcatcttatgttaaggttctttcgatgctccttgtctcttatttgcagctccgcagttttgatattattggcatcctgactggtattagaatgagatcgttggtc

SEQ ID NO: 33878 - protein, 216 aa, Panicum virgatum; identical to SEQ ID NO: 9838
  misc_feature: Ceres CLONE 1954106
  misc_feature (10)..(212): Pfam Name: Ribosomal_L1 Pfam Description: Ribosomal protein L1p/L10e family

SEQ ID NO: 33879 - DNA, 535 bp, Panicum virgatum
  misc_feature: Ceres CLONE 1954116
  misc_feature: Encodes the peptide sequence at SEQ ID NO. 33880
aagaaatcgcgacagccaaaccaagaaatcgcgatgctgccccctgctcgcttcgtcctcgccgccgccctcctcgccctccggctaccggcacggcgcggtggcggagctggagcgcagcctgcgggagctgcagcaggtgttcaacgacatggcggtgctggtggcggcgcagggggagcagctggacgacatcgagggcaacgtggggcgcgccaggtccttcgtcgaccgcggccgggagcagctgcaggtggcgcggaagcaccagaggagcacgcgcaagtggacgtgcatcgccatcctcatcctcctcgtcatcgtcctcgtcatcgtcctccccatcgtgctcaagaacgtcaacaagagcaactagcagcagcagcctggctgattggccatggcgatccggcggtgctcttgtggacgcaatacaatacgccgggagagattattagctgtttgttcgtggcgtttgtatcatactccgtatatggctagctgattacattatcggtgatttttgtttcatgtc

SEQ ID NO: 33880 - protein, 124 aa, Panicum virgatum
  misc_feature: Ceres CLONE 1954116
  misc_feature (29)..(91): Pfam Name: SNARE Pfam Description: SNARE domain
RNRDSQTKKSRCCPLLASSSPPPSSPSGYRHGAVAELERSLRELQQVFNDMAVLVAAQGEQLDDIEGNVGRARSFVDRGREQLQVARKHQRSTRKWTCIAILILLVIVLVIVLPIVLKNVNKSN

SEQ ID NO: 33881 - DNA, 453 bp, Panicum virgatum
  misc_feature: Ceres CLONE 1954131
  misc_feature: Encodes the peptide sequence at SEQ ID NO. 33882
ctcctccgccgtcgcctctccactttccccatccttcgccgacgtcgcggtcgtctcgcagtccgaagagcccccgactccgatggccagccgctgggtccgacccgaggtgtacccgctgttcgcggcgatgggcgtggccgtcggcatctgcggatttcagctcttccggaacatcaccggcaacccggaagtcagggtaaacaaggcagggagggcagctggtgtgcttgagaatcatgaggaggggaggcgttacgcaatgcacagcctcagaagctttgtgcatgacaagacccctgaaataatgccatccatcaacaagttcttcactgagccgaagtgaagcgatttgctggggtgctgctgctggagtcactattaaggcattcaatgtcatgtcatccataaattggaggacagccgaagtgtatggtttatgagtgttgcatc

SEQ ID NO: 33882 - protein, 87 aa, Panicum virgatum; identical to SEQ ID NO: 13010
  misc_feature: Ceres CLONE 1954131
  misc_feature (2)..(87): Pfam Name: B12D Pfam Description: B12D protein

SEQ ID NO: 33883 - DNA, 573 bp, Panicum virgatum
  misc_feature: Ceres CLONE 1954139
  misc_feature: Encodes the peptide sequence at SEQ ID NO. 33884
aaaaaacgcccccgcttggctgctgagcttcttcttccgcaaggaggaaaaaaaggatccagaggccagggttcgtttcttaccggaccgtgtcgcgagtcccgatggcggagccggcgaagcccgaggtgacggaggaggctaagatggacctgctcgaggacgacgacgagttcgaggagttcgagatcgaccaagagtgggacgacaaggaagaaggcaacgaagcacttcagcaatgggaggatgactgggatgatgatgacgtcaatgacgacttctcgctgcagttgaggaaggagctggagagcaatgcgccgaagaactagccagcgtatgcagccttgtattgagttggagagtggtgtgatggtgtccaaggactagttagcttatgcagccttgtatccattattgtcagataggaactgctgtacggtgaccatggttgggaaactgctactgttgttccgttctcgtccttgttggcatggtcactgatgttgtcgttccgtttgcttttaatggatcatttccctgtttccgactactaataactgatgaaccttggtt

SEQ ID NO: 33884 - protein, 74 aa, Panicum virgatum
  misc_feature: Ceres CLONE 1954139
  misc_feature (8)..(70): Pfam Name: DSS1_SEM1 Pfam Description: DSS1/SEM1 family
MAEPAKPEVTEEAKMDLLEDDDEFEEFEIDQEWDDKEEGNEALQQWEDDWDDDDVNDDFSLQLRKELESNAPKN

SEQ ID NO: 33885 - DNA, 734 bp, Panicum virgatum
  misc_feature: Ceres CLONE 1954142
  misc_feature: Encodes the peptide sequence at SEQ ID NO. 33886
aaacaccagtgttagctccgcaccacgcgcggagagggcagctgtggcggcggctgcgattaacgccagacagataggtggtagaggaagaaagggggagaggggaagggccagcgagagctagctgagaggcgaactgaaggagaggcgaactgaaggagagggcagccgcaagtactgtatagcttgtaggcaatgaggtcgagggcgccgtcgttgcggcggagcgtggttgcggcggccgtagtggcgctgacggcggcgtggtgcgcggcggcgcagctgagccagagctactacgcgtcgacgtgccccaaccagaccgccttcttcaacgccttcgtcgccgccatggccaagctcggccgcgtcggggtcaagaccggctccgtcggcgagatccgccgtacatttctggctatactagaaaggtcaactagctactacctacctgcagctggatcgatctgcaccgccgtacatttctggctatactagaaaggttgtctgagaagaatgcccaccatgtccatgtcatgcagagtctcaagagtccatgatcacagtcacagtgtattaattcgttaatccgccgattctttccttgattgtgtatgtagtaaaaatcatgtaacaagaagaggtagccccatacagtacggtcttaggataaatattttcagctcatggcctacccaccatgtgaatgtgataggaaaagaaggtactactac

SEQ ID NO: 33886 - protein, 100 aa, Panicum virgatum
  misc_feature: Ceres CLONE 1954142
  misc_feature: SWISSPROT Homolog: EC 1.11.1.7 Peroxidase
MRSRAPSLRRSVVAAAVVALTAAWCAAAQLSQSYYASTCPNQTAFFNAFVAAMAKLGRVGVKTGSVGEIRRTFLAILERSTSYYLPAAGSICTAVHFWLY

SEQ ID NO: 33887 - DNA, 924 bp, Panicum virgatum
  misc_feature: Ceres CLONE 1954152
  misc_feature: Encodes the peptide sequence at SEQ ID NO. 33888
ccacagtgaagtcagccatggccctcgcgctcgccacgaccccactcgcgcacctcgccctcgccccgcccccgatctccggctcccagtcctcgctgctgctgctcccgcgccgcccgtcacccgcaggcgtctcactctccctacgttcgcgcctcaccgcggccctcgcgaccaaggaacccgagctcgggggcggcggatcggagggcggtgacggtgcaggagggagcggaggcggcggtggtgacagcgagccgagggaaggaggtccggaaggggaaggggagggggaggaagagaagatggggcaggggctatccatgtcgcagaagctcactctcgcctacgccgcgctcgtcggagctggtggtgcgatgggatatatgaagagtggaagccagaaatccttggctgcaggaggcatatcagctctcgtcctgtacttcgttcacactcaactcccagtgaggcctgtctttgcatcatcaattggtctaggcatatcggctgcgctactgtcagtgatggggtctcgcttcaagaagtccgggaagatattcccagccggtgttgtgtcactcgtgtccctggtcatggtcggaggctacttccatgggatcttgcgtagctcccatgcttgatagaatccgtttccatcacaccatctgcaccacgcattgggatcactatcaagttttatgtttcatccgctttaggcaccctttgttgttttaaattccgatgaactctttcactttttggtggatgtttcaagtgttcttagagttgccgttctcaagtttagttcatgttcagtgcctctgtgggacagatagccaataagcacatgactgagtagctggtagttgtgaaagacgagaatgtatttctttttttggaattttgaaagacgaacttttt

SEQ ID NO: 33888 - protein, 208 aa, Panicum virgatum
  misc_feature: Ceres CLONE 1954152
  misc_feature (105)..(202): Pfam Name: TMEM14 Pfam Description: Transmembrane proteins 14C
MALALATTPLAHLALAPPPISGSQSSLLLLPRRPSPAGVSLSLRSRLTAALATKEPELGGGGSEGGDGAGGSGGGGGDSEPREGGPEGEGEGEEEKMGQGLSMSQKLTLAYAALVGAGGAMGYMKSGSQKSLAAGGISALVLYFVHTQLPVRPVFASSIGLGISAALLSVMGSRFKKSGKIFPAGVVSLVSLVMVGGYFHGILRSSHA

SEQ ID NO: 33889 - DNA, 746 bp, Panicum virgatum
  misc_feature: Ceres CLONE 1954156
  misc_feature: Encodes the peptide sequence at SEQ ID NO. 33890
cttaaccagctatacagctcaataagtgggcaaagcaatgctaagattgaggagcttctccaagaagaccataatgctaagcgcagaagggagaagtaccaaaaacaatcatctctcctgtcaaaacttactcgtcaactcagtatccatgacaacagggcatctgtttcctcttattctaacgacacctctgaagctgagagccctcgaatacccagccgcccaggtgaggactggaggtctgccttcgattctgcatctaatgggcctgctgctgccagctcaaacagcgagtcaaggtcgagaagcgctgatggtcgcagccggcgctacgagaatggggatgtgagcacaggtgccaactctggcaaccgacgcacgccaaaccggttgcctccagcaccaccaagatactagtcgtgctgattggtatccatgaacatgtattcttgcctggcacacgccctgtttgtcgtatcgattattggagcgtattccggatcggctgctagagattccaacgtagtggagtcgggtgatttcatgaatgttgtctttacaggtagctgggactcgagagttgtttatagaaatatataggtaatctatggtctctattgttaatgatctcttctgcatatttatgtcctgttgctgtgtcccagcctttgggattttgtggatcagggacgattgttcttaacttgcggttcatcaggctatgatttgatatgttgtttccctcc

SEQ ID NO: 33890 - protein, 138 aa, Panicum virgatum
  misc_feature: Ceres CLONE 1954156
  misc_feature: SWISSPROT Homolog: EC 3.6.5.5 Dynamin GTPase
LNQLYSSISGQSNAKIEELLQEDHNAKRRREKYQKQSSLLSKLTRQLSIHDNRASVSSYSNDTSEAESPRIPSRPGEDWRSAFDSASNGPAAASSNSESRSRSADGRSRRYENGDVSTGANSGNRRTPNRLPPAPPRY

SEQ ID NO: 33891 - DNA, 860 bp, Panicum virgatum
  misc_feature: Ceres CLONE 1954159
  misc_feature: Encodes the peptide sequence at SEQ ID NO. 33892
agacaaaccaagacaagagattaatcgtcacaaactcagagagccatgcatcctcattttcctgatgatcacggcgatgggcgagtgggcggtccatttcatagccagaagtcgattcataagcttcttggtggagggaaagtggcggacgttctgctgtggaaggacaggaacttatctgcaggagtcctcctcggagctacgctgatatggtacctgtttgaagtcgaatacaacataatcccgctcctttgccagatagccatccttgccatgttggtcatcttcatttggtcaaacgctgcaccgctcttgaacatagcacctccaagaatcccggaagtcatcatctccgagcatgccttccgacaagtagcagagaccatccattacaaactggcacacactgtggctgctctttatgatattgcgtgtggaaaggatctgaagaaattcctcttggtgatcatgtccctactaatattgtcagagattggaagttcttacagcttcacaagtctgctatatcttggatttctatgtgcccacactttgccggcattgtaccaaagatatgagacagaggtggaccatttagctgcaaggggtagtgaagacatcaaaaggttctacaggaggattgattccaatttgctcaacaaaataccaagaggccctgtcaagacaaaagttaactaaaatatactccctgaagatagccatcataatttgcaaaatcattcgtgaacaaaatcccacattgtgaagaagttacaccaattgagcttgaagaattcagacctgaatgctactagcaaccaaatgtacctatcctgcatggataaaagcatattttcatc

SEQ ID NO: 33892 - protein, 217 aa, Panicum virgatum
  misc_feature: Ceres CLONE 1954159
  misc_feature (33)..(215): Pfam Name: Reticulon Pfam Description: Reticulon
MHPHFPDDHGDGRVGGPFHSQKSIHKLLGGGKVADVLLWKDRNLSAGVLLGATLIWYLFEVEYNIIPLLCQIAILAMLVIFIWSNAAPLLNIAPPRIPEVIISEHAFRQVAETIHYKLAHTVAALYDIACGKDLKKFLLVIMSLLILSEIGSSYSFTSLLYLGFLCAHTLPALYQRYETEVDHLAARGSEDIKRFYRRIDSNLLNKIPRGPVKTKVN

SEQ ID NO: 33893 - DNA, 1057 bp, Panicum virgatum
  misc_feature: Ceres CLONE 1954167
  misc_feature: Encodes the peptide sequence at SEQ ID NO. 33894
acccaactccgtttcgaattctagggttttgctgctcttccgtgctctgaaggccgcatcgccgcatcaggtgcggttcctcgcgtgcgaccgtaatggcgctgccgaaccaggggactgtcgattaccccagcttcaagctcgtcatcgttggcgatggcggaacaggtaaaaccacattcgtgaagaggcatctcactggagagtttgagaaaaaatatgagccaaccattggtgtggaagttcatccattggattttactactaactgtggtaagatccgtttctactgctgggatactgctggacaagagaagtttggtggcctcagggatggatactatatccatggccagtgtgcgatcattatgtttgatgttacctcaaggctgacttataagaatgttcctacatggcatagggacttgtgcagggtgtgtgaaaacatccccattgtcctgtgtggtaacaaggttgacgtgaagaacaggcaggtgaaggccaagcaggtcaccttccacaggaagaagaacctgcagtactatgaaatttctgccaagagcaactacaacttcgagaagcctttcctttaccttgcaaggaagctggctggggatcccaacattcactttgttgaagctgtcgctcttaagcctccggaagttaccattgatttggccatgcagcaacagcatgaagctgagcttactgctgctgcagcacaacctcttcctgatgacgatgatgatttgattgagtagaaagtggataatgagtatcagacttgagctgatggagtggtgccttgcccaagagttgtcttggggccgaactctctctagagttagtgttgtctgaacctggatcttttcccgcctctcggtcatgttgctacttttgaatgtctgaaatcttgatggacatgccgccatgaatttgctggctctttatacattgctttgtaactctggtactctagttattgatggtgaacgttgttgtggcagtctgccttctactttctcgacaatctatcatatgaagctgcttcggacgt

SEQ ID NO: 33894 - protein, 221 aa, Panicum virgatum
  misc_feature: Ceres CLONE 1954167
  misc_feature (15)..(173): Pfam Name: Ras Pfam Description: Ras family
  misc_feature (15)..(128): Pfam Name: Miro Pfam Description: Miro-like protein
MALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNIHFVEAVALKPPEVTIDLAMQQQHEAELTAAAAQPLPDDDDDLIE

SEQ ID NO: 33895 - DNA, 481 bp, Panicum virgatum
  misc_feature: Ceres CLONE 1954168
  misc_feature: Encodes the peptide sequence at SEQ ID NO. 33896
atggaaggttggcagaatgatcttgatgccaaatccaaagctctgaagagatgggaggaatcattgaaaaatgatgacaagaggttactggaagaaaagcagcgtatggatcaggaaaaacatcaagttgagatgtcaaaattagagcttgaaaggatcaaatccacactagaagctgaaaaggaaagaatattagaagagcagaataatctgaaactcacagaggaagagaggcaggagcatagcgtgctgacagaaaaactcaagaaggagattgaggagtacagaatgcgaagcaactccctctctgaagaaattgaagatttgaggaagcagcggcagaagtttgaagaagagtgggaacagctagatgaaaaaagagctcacctagtagaggaaggcaaaaagttgaatattgagaggatgaatttagaacggtggcgtgacactgaagaaaagaggttaaatgatgcaaagctcg

SEQ ID NO: 33896 - protein, 160 aa, Panicum virgatum
  misc_feature: Ceres CLONE 1954168
  misc_feature: SWISSPROT Homolog: EC 2.7.11.1 Non-specific serine/threonine protein kinase
MEGWQNDLDAKSKALKRWEESLKNDDKRLLEEKQRMDQEKHQVEMSKLELERIKSTLEAEKERILEEQNNLKLTEEERQEHSVLTEKLKKEIEEYRMRSNSLSEEIEDLRKQRQKFEEEWEQLDEKRAHLVEEGKKLNIERMNLERWRDTEEKRLNDAKL

SEQ ID NO: 33897 - DNA, 986 bp, Panicum virgatum
  misc_feature: Ceres CLONE 1954179
  misc_feature: Encodes the peptide sequence at SEQ ID NO. 33898
aaatcaccagctgaatcgcaccatctcgttcctcttcctccgtccccaatcccctctcctcccgcagtcccccacaggtcacaaccctagctgcccccaaatccatggatcccaccaaatccagcacccctccgcctcccccagtcatgggcgcccccgttgcctaccctccggcggcttaccctcccgctgcggccgccggcgccgccgcctacgccccgcagctctacgcgccgcccgccgcagctgcagcccagcaggcggccgcggcgcagcagcagctgcagatgttctgggcggagcagtaccgcgagatcgaggccaccacggacttcaagaaccacaacctcccgctcgcccgcatcaagaagatcatgaaggccgacgaggacgtccgcatgatcgccgccgaggcccccgtcgtgttcgcgcgcgcatgcgagatgttcatcctcgagctcacccaccgcggctgggcgcacgcggaggagaacaagcgccgcacgctccagaagtccgacattggcgccgccatcgcccgcaccgaggtgttcgacttcctcgtcgacatcgtgccgcgcgacgacgccaaggacgccgacgcggccgctgccgcagccgccgcggctgcggctgccgggatcccgcgccccgccgccggtgtgcctgctaccgacccgtttgcctactactatgtccctcagcagtaatgtatcatcgccgtcttcttagtcgtttcccaagcgcagaatgtgttgtcgtgctgtttcgtgactgtcgtagttgctactgctgttgttgccgcgtaataagacttgttgatgattgatgggcatccccctgagcttaagaattgagctgtttcattctagaatctcgactaagtttgttgtattggcggatgccctctgattgggttggtagtgtatgcctaagcctaactcatccgatgctgtaatccgacaagtattatgcgggtgtttggt

SEQ ID NO: 33898 - protein, 201 aa, Panicum virgatum
  misc_feature: Ceres CLONE 1954179
  misc_feature (80)..(144): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 1109 in the 10/374,780 US patent application
  misc_feature: The sequence is a functional homolog of SEQ ID NO 1108 in the 10/374,780 US patent application
  misc_feature: The sequence is a functional homolog of SEQ ID NO 1188 in the 10/412,699 US patent application
  misc_feature: The sequence is a functional homolog of SEQ ID NO 835 in the 10/374,780 US patent application
  misc_feature: The sequence is a functional homolog of SEQ ID NO 1107 in the 10/374,780 US patent application
  misc_feature: The sequence is a functional homolog of SEQ ID NO 1190 in the 10/412,699 US patent application
  misc_feature: The sequence is a functional homolog of SEQ ID NO 837 in the 10/374,780 US patent application
  misc_feature: The sequence is a functional homolog of SEQ ID NO 102 in the 10/225,068 US patent application
  misc_feature: The sequence is a functional homolog of SEQ ID NO 230 in the 10/714,887 US patent application
  misc_feature: The sequence is a functional homolog of SEQ ID NO 230 in the 11/435,388 US patent application
  misc_feature: The sequence is a functional homolog of SEQ ID NO 310 in the 10/412,699 US patent application
  misc_feature: The sequence is a functional homolog of SEQ ID NO 727 in the 11/479,226 US patent application
  misc_feature: The sequence is a functional homolog of SEQ ID NO 94 in the 10/374,780 US patent application
  misc_feature: Functional homolog of the protein sequence given in SEQ ID NO 51229
  misc_feature: Useful for making plants with altered lignin content
  misc_feature: Useful for making plants with altered terpenoid content
  misc_feature: Functional homolog of the protein sequence given in SEQ ID NO 51228
  misc_feature: Useful for making plants with altered alkaloid content
  misc_feature: The sequence is a functional homolog of SEQ ID NO 1908 in the 11/479,226 US patent application
  misc_feature: The sequence is a functional homolog of SEQ ID NO 2126 in the 10/374,780 US patent application
  misc_feature: The sequence is a functional homolog of SEQ ID NO 314 in the 10/374,780 US patent application
  misc_feature: The sequence is a functional homolog of SEQ ID NO 846 in the 10/225,066 US patent application
  misc_feature: The sequence is a functional homolog of SEQ ID NO 712 in the 11/479,226 US patent application
  misc_feature: The sequence is a functional homolog of SEQ ID NO 122 in the 10/225,068 US patent application
  misc_feature: The sequence is a functional homolog of SEQ ID NO 1957 in the 11/479,226 US patent application
  misc_feature: The sequence is a functional homolog of SEQ ID NO 344 in the 10/374,780 US patent application
  misc_feature: The sequence is a functional homolog of SEQ ID NO 380 in the 10/225,066 US patent application
  misc_feature: The sequence is a functional homolog of SEQ ID NO 670 in the 11/435,388 US patent application
MDPTKSSTPPPPPVMGAPVAYPPAAYPPAAAAGAAAYAPQLYAPPAAAAAQQAAAAQQQLQMFWAEQYREIEATTDFKNHNLPLARIKKIMKADEDVRMIAAEAPVVFARACEMFILELTHRGWAHAEENKRRTLQKSDIGAAIARTEVFDFLVDIVPRDDAKDADAAAAAAAAAAAAGIPRPAAGVPATDPFAYYYVPQQ

SEQ ID NO: 33899 - DNA, 929 bp, Panicum virgatum
  misc_feature: Ceres CLONE 1954199
  misc_feature: Encodes the peptide sequence at SEQ ID NO. 33900
atatccggctgtgtaaaagcaggcctacgcctgtgcgttctactatacacataaaacctagccacctctctgcttgtatgcttgttaccattgtgtccaaacctgtacgaggcaccatcgttcgatggcttgcttctctatcagaaggttgaataaatgttatttcgctaaaaaaaaaaaaaaataaaaaaaaataggaggcatcgacgccaagaagagggaggagcaccaaggacttccggcgcctgttcaggatctacatcttcccgagcgagttcttggttgatctcttcctcttcgaccacctcccaggcccttggtgtagcttgccactctcgccagtcaagttttcatgtctgatcttggcattcagatcccaactgccttcgatccctttgctgaggccaatgctggggactctggtgcggcagcaggatcaaaggactacgttcatgtacgcagccagcagcgtaatggtcgcaagagtctgactactgtccagggattgaagaaggaattcagctacagcaagatcctaaaagatctcaagaaagagttctgctgcaatggtacagtggttcaggacccagagcttggacaggtcattcaactccagggtgatcagaggaagaacgtctcaaatttccttgtccaggccggcattgtgaagaaggaacatatcaagattcatggtttctgagcaaccgtcgggtctatagcaagccctgcatgcaaagcagctatatatccggggtggagcatatccggctgtgtaaaagcaggcctacgcctgtgcgttctactatacacataaaacctagccacctctctgcttgtatgcttgttaccattgtgtccaaacctgtacgaggcaccatcgttcgatggcttgcttctctatcagaaggttgaataaatgttatttcgct

SEQ ID NO: 33900 - protein, 115 aa, Panicum virgatum; identical to SEQ ID NO: 12590
  misc_feature: Ceres CLONE 1954199
  misc_feature (27)..(108): Pfam Name: SUI1 Pfam Description: Translation initiation factor SUI1
  misc_feature: Functional homolog of the protein sequence given in SEQ ID NO 50445
  misc_feature: Useful for making plants with modulated biomass
  misc_feature: Useful for making plants with modulated flowering time

SEQ ID NO: 33901 - DNA, 460 bp, Panicum virgatum
  misc_feature: Ceres CLONE 1954201
  misc_feature: Encodes the peptide sequence at SEQ ID NO. 33902
gtgctctctcagaggtgggttggcttctcctccccctccggttcgcggttcggttcggtccgggttcgtgaggttcttgggggtgagaggaagagatggcggcgtcagatgttgagtaccgctgcttcgtcggcggccttgcctgggccaccgacgacaactcgctccacaacgccttcagccccttcggcgaggtcctcgagtccaagatcatcctcaatcgtgagacccagatgtcccgcggcttcggcttcttctccttctcgagcgagctcgcgatgctcgatgccttcgaggggatgaacggcgcggagctggacggccgccgcttcaccgtcaacgatgcccatgcccgcggtggcccgcgctccgccggcggccgtcgatggcacgggtgccgccagggcggcggacgctgctgcggcggtggcttcagtggattccgttgtggttcccggcg

SEQ ID NO: 33902 - protein, 121 aa, Panicum virgatum
  misc_feature: Ceres CLONE 1954201
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
MAASDVEYRCFVGGLAWATDDNSLHNAFSPFGEVLESKIILNRETQMSRGFGFFSFSSELAMLDAFEGMNGAELDGRRFTVNDAHARGGPRSAGGRRWHGCRQGGGRCCGGGFSGFRCGSR

SEQ ID NO: 33903 - DNA, 329 bp, Panicum virgatum
  misc_feature: Ceres CLONE 1954201-R
cggcggcgtcggctacggcaactcgcgatgggaattggaggagttgagcggcgggcccccgcgtggccaagttatcctgtccttgctcctgttacctgagttatcctgtgccatgatctacctgtgtttggtgtctttcgtgttcgttgttgcccatctgtgtttttgatcgcaagctcgttcgtctagtggtcgtgttgttgtctgtcagagctatcttgacctccatcccatgaaccggggtgttggaattggatgctgttatcttgtgtaacttgttaccgtttcagttaatcgaatggaaaaaaaaggtgctacttggtgctgcc

SEQ ID NO: 33904 - DNA, 806 bp, Panicum virgatum
  misc_feature: Ceres CLONE 1954218
  misc_feature: Encodes the peptide sequence at SEQ ID NO. 33905
acgccttcactcccttggtctcggccttcctagcggcggcgacagggcgagtggcgccgcccgccagttcttcgtcgggcgcttcaccggcgacgagcatccgacagggatctgtaaagcagtaacatggcaactctcaaagatgcagcagcaagaaaaccaattttagcaacaatccgtcttatagttcctgctggcgctgcacgccccgcaccaccagttggaccagctctgggtttctataggcttaatttgatggcattctgcaaagatttcaatgccaggacacagaagtacaaggcggatactccgatgcaagttactttgactgcctacaaggatagtacattcgagtttgtagtcaagtcaccttcagtttcatggttcctgaagaaagcagcaggaattgagactgccagcagtcgcccaggccacaacacagtgtcatccctcactcttcgccatgtgtatgagattgcaaaactgaagcagtctgatccattttgcaagcacatgtcaatcgaggcattatgcaaaaccatcattgggacggctaactccatgggcattgaaattgttaaagacctttgagtgggctggcagtctaatctcaagcacaatttgtcagaccaaattccaagcttagttcgctctctcatctgtatgagttcggttttgtttgatctggacgaaatagagacatttgattactgtaggaagtatgttgcttcttctgtatcagcttctatctgcaccctctttcagaggcagcaactaatatatttcttcctatgtcttgcactttc

SEQ ID NO: 33905 - protein, 154 aa, Panicum virgatum
  misc_feature: Ceres CLONE 1954218
  misc_feature (80)..(150): Pfam Name: Ribosomal_L11 Pfam Description: Ribosomal protein L11, RNA binding domain
  misc_feature (16)..(75): Pfam Name: Ribosomal_L11_N Pfam Description: Ribosomal protein L11, N-terminal domain
MATLKDAAARKPILATIRLIVPAGAARPAPPVGPALGFYRLNLMAFCKDFNARTQKYKADTPMQVTLTAYKDSTFEFVVKSPSVSWFLKKAAGIETASSRPGHNTVSSLTLRHVYEIAKLKQSDPFCKHMSIEALCKTIIGTANSMGIEIVKDL

SEQ ID NO: 33906 - DNA, 841 bp, Panicum virgatum
  misc_feature: Ceres CLONE 1954228
  misc_feature: Encodes the peptide sequence at SEQ ID NO. 33907
accaacgcgcctccattccccgttcctctcctgcctagggttctagccccccctcgccgccgccctccggcacccaccaccaccatgacggccgagaccgcgacgccggaggagcagctccgcgcccagctcgaggagcagaagatccacgagggagatgacccgattgttgaggatgatgatgatgaggaagatgacgatgatgaggatgacaaggatgacgatgatgctgagggagttgatgctagtgggagatctaagcagagccgcagtgagaaaaagagcaggaaggccatgctgaagcttggcatgaaggccatcactggtgtaagccgtgtaactgtcaagaagagcaagaatatgctctttgtcatctccaaaccagatgtcttcaagagccctgcatcagacacctatgtgatctttggggaggccaagattgaggacctgagctcacagctgcagacacaggctgcagagcagttcaaggcaccagacatgagcagcgtcctgtcaaagccagaggtctccacagcggcccaggatgacgatgaagctgtcgatgagactggtgtggaggagaaggacattgagttggtgatgacccaggctaccgtgtcgagggctagggcggtgaaggcgctgaaggcggccgacggggacatagttagtgcaatcatggagctgacaacttagccagttgtgcgcgtacttgtgatatcatgttagttttatcttgtttaatggatctatgatctgaacacatgttgtcatgttgagctgttctgcatgttgtgtgattggaaacaaatgggaatgtcttcaaggctctttttcgtgc

SEQ ID NO: 33907 - protein, 203 aa, Panicum virgatum
  misc_feature: Ceres CLONE 1954228
  misc_feature (62)..(121): Pfam Name: NAC Pfam Description: NAC domain
  misc_feature (164)..(201): Pfam Name: UBA Pfam Description: UBA/TS-N domain
MTAETATPEEQLRAQLEEQKIHEGDDPIVEDDDDEEDDDDEDDKDDDDAEGVDASGRSKQSRSEKKSRKAMLKLGMKAITGVSRVTVKKSKNMLFVISKPDVFKSPASDTYVIFGEAKIEDLSSQLQTQAAEQFKAPDMSSVLSKPEVSTAAQDDDEAVDETGVEEKDIELVMTQATVSRARAVKALKAADGDIVSAIMELTT

SEQ ID NO: 33908 - DNA, 730 bp, Panicum virgatum
  misc_feature: Ceres CLONE 1954236
  misc_feature: Encodes the peptide sequence at SEQ ID NO. 33909
tgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcctccgagcagtcgatgctcgacgccatcgaagccatgaacggcaaggatctcgacggccgcaacatcaccgtcaaccaggctcagtcccgcggcggcggcggcggcggcggcggcggctatggcggcggtcgtcagggtggctacggcggcggcggcggctacggaggcggtggtggctacggcggtggtcgccgtgagggcggctacggcggaggcggtggcggcggtcgccgcgagggcggctacggtgatggtggctacggcagccgcggtgactccggtggtaactggaggaactgatggggtggccctcccgtgctggcagccaagttatcctatatatctattagtgttcgtgtcactgtttgatccgagttacccctgagttttgttcgtgtgttaccgttcgattaggtgttggttcccatgtttaccgttcccgagttgtttccgcaataaaatgagaagaaaagagtgtccgc

SEQ ID NO: 33909 - protein, 156 aa, Panicum virgatum
  misc_feature: Ceres CLONE 1954236
  misc_feature (10)..(81): Pfam Name: RRM_1 Pfam Description: RNA recognition motif. (a.k.a. RRM, RBD, or RNP domain)
  misc_feature (48)..(148): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 22 in US patent 7244875
  misc_feature: Functional homolog of the protein sequence given in SEQ ID NO 50144
  misc_feature: Useful for making plants with altered terpenoid content
  misc_feature: Functional homolog of the protein sequence given in SEQ ID NO 50179
  misc_feature: Useful for making plants with modulated phosphate use efficiency
MAAADVEYRCFVGGLAWATDNASLQQAFASYGDVLDSKVITDRETGRSRGFGFVTFSSEQSMLDAIEAMNGKDLDGRNITVNQAQSRGGGGGGGGGYGGGRQGGYGGGGGYGGGGGYGGGRREGGYGGGGGGGRREGGYGDGGYGSRGDSGGNWRN

SEQ ID NO: 33910 - DNA, 664 bp, Panicum virgatum
  misc_feature: Ceres CLONE 1954248
  misc_feature: Encodes the peptide sequence at SEQ ID NO. 33911
cgccgccgacctataccccgtcgccgaagccgaagccgacccccacccccacccccaagccgacacctccgacctacaccccgtctccgaagccgaagccgaagccgacgcccaccccaacccccaagccgactcctccgacctacacgccgacccccaagccgacgccgccgacctacaagcctgctcccaagccgacgccgccgacctacaagccggctcccaagccgacgccgccggtgtcctacacccccagcccgccgccgccctactacaagtgacatctctgctgctcagctgtgtcgagctcggagcataggacgaaggtgatggaagagtttgtgccagccagccggccaagagagatgagctgaagatgagaggccttccctgatcctcctcttacgttcgctgccgtccatctatcctagctagagaggagagaataatgcaagcagagctctgcagcaccatctgttttgtgttgtctgtttaattcgtgttcgtcgccagtgtcgtctgtcttaattagcagccgtattgtgtgtgtgggtaatggtattgctactattggtgtcatcaggaggaggtttactgtgaaagtaaaaccaataaccatgtaaatgcaagtgaaagctagtatgtttactgtgttctcctgctc

SEQ ID NO: 33911 - protein, 92 aa, Panicum virgatum
  misc_feature: Ceres CLONE 1954248
  misc_feature: Functional homolog of the protein sequence given in SEQ ID NO 50776
  misc_feature: Useful for making plants with altered carbohydrate content
PPTYTPSPKPKPTPTPTPKPTPPTYTPSPKPKPKPTPTPTPKPTPPTYTPTPKPTPPTYKPAPKPTPPTYKPAPKPTPPVSYTPSPPPPYYK

SEQ ID NO: 33912 - DNA, 788 bp, Panicum virgatum
  misc_feature: Ceres CLONE 1954266
  misc_feature: Encodes the peptide sequence at SEQ ID NO. 33913
attctctctcggtctccctagtctccgggggcggcggcggttcccgtggcacgccgcgctgctgcgagcctgcctgctctcatccaccactcccagcaccacgccgtcgcccgctgtgcctcccgcggcctcatctgcgtcgcgccgtcgcccttctcccgctacaaatccgtgccggcaccgtcgccctcacctcgtacagggagtccgggatccaggcagcacggccacgctgggttgatccttctcaatttctgctacatcaagatgcactgccattgcccgcggcagagagaggaagataaggagacatgtctagcatagcagccctctgcatctgctgtgattgaacctactgcaagtttcagattatcaggctgatccttcaatacccagtgcaattcgttccctgcttcgctcaaccaccaaatctactcatgtgcataaggagcatgagatggagattgggtaccctacagatgtaaagcatgtggctcacataggtctaggcaccagtgacacatctccaagctggataagaatatcataacaatatgcagcattaatcatgctttatttattgtcatgagttcacattattcacgtagttctttaactgatggtgatgaaccttttttttacttttagatggctgaattcaaggaaacagatgatttaccagcaggctctacgagcacagctttgcagtcaagacagacttcttgggcctctgcaggtgatgctcacctctgacatttgtttgcccttcaaaaatattcagtcaagac

SEQ ID NO: 33913 - protein, 30 aa, Panicum virgatum
  misc_feature: Ceres CLONE 1954266
  misc_feature: Functional homolog of the protein sequence given in SEQ ID NO 51447
  misc_feature: Useful for making plants with modulated cold sensitivity
  misc_feature: Functional homolog of the protein sequence given in SEQ ID NO 51448
  misc_feature: Useful for making plants with altered cell wall content and/or composition
MEIGYPTDVKHVAHIGLGTSDTSPSWIRIS

SEQ ID NO: 33914 - DNA, 1034 bp, Panicum virgatum
  misc_feature: Ceres CLONE 1954294
  misc_feature: Encodes the peptide sequence at SEQ ID NO. 33915
gcttctccagttctcctactcctacctcccctcccactcctgctcgctcgccacctcccgccctttttaaaccaccacccgctgccaaatttgctttgcctccccaccaccaccgcttcgctgctgcggtctatagctgataaagctagctcgttaggtcgcgcttaattggcaggcaggcagccagccgcgcgtctcggaggagggagggaagcgatcgacacgaggccggcggctctagctcggcgggtcggctagctgggcagcaggtgctgcggtggttctggtttaggttcctccgatcgatggggtcgtcggcggaccacggcggcgccggcgggaggggcaagaagcaggggacgcagctctggaagaaggcgctgctgcattcctgcctctgcttcgtcatgggcttcttcaccggcttcgcgccgtcgtcggtgtccgactggacgtccgcggcggtctcggcgggcggggwgggcagcagccacgtcgtccgagcgctgcagacggccgcgggcggggccgtcaaccggagcctcctggcgcacggcggcgcggacctgctcgacgccgaggcggcgaccccgcggccgctgctggtgatcgtcacgacgacggagtccgcgcccgcggcgtccggggagcgcgccgcggcgctgacgcgtatggcgcacacgctgcggctggcggcgccgccgctactgtgggtggtggtggaggccgccccggacgtgccggccacggcgcggctgctgcgcgccacggggcttgtgtaccggcacctgacgtacaaggacaacttcacggccgccgacgccgccgcgggcaaggagcggcaccaccagcggaaggtcgcgttcggccacatcgagcaccaccgcctcgccggcgtcgtcctcttcgccggcctcggcgacgtcttcgacctccgattcttcgaccagctccgccagatcaggtacgtccctgtaataccctgctgccaacaaacagccaccatcctcgcttcgcatggcatcgtcgcctcc

SEQ ID NO: 33915 - protein, 242 aa, Panicum virgatum
  misc_feature: Ceres CLONE 1954294
  misc_feature (123)..(242): Pfam Name: Glyco_transf_43 Pfam Description: Glycosyltransferase family 43
  misc_feature: SWISSPROT Homolog: EC 2.4.1.135 Galactosylgalactosylxylosylprotein 3-beta-glucuronosyltransferase
  misc_feature (59)..(59): Xaa is any aa, unknown, or other
MGSSADHGGAGGRGKKQGTQLWKKALLHSCLCFVMGFFTGFAPSSVSDWTSAAVSAGGXGSSHVVRALQTAAGGAVNRSLLAHGGADLLDAEAATPRPLLVIVTTTESAPAASGERAAALTRMAHTLRLAAPPLLWVVVEAAPDVPATARLLRATGLVYRHLTYKDNFTAADAAAGKERHHQRKVAFGHIEHHRLAGVVLFAGLGDVFDLRFFDQLRQIRYVPVIPCCQQTATILASHGIVA

SEQ ID NO: 33916 - DNA, 462 bp, Panicum virgatum
  misc_feature: Ceres CLONE 1954305
  misc_feature: Encodes the peptide sequence at SEQ ID NO. 33917
tctactcatctaccagagcttttctgctgctgaagatgctgttgttggctcgcccaaatctgttcttcattgcttcgagggtcacaatatggagaatgctgctccggtgaatgatggcaagctggctaatcttctctgctgggaggaagaggatgccatggaggagaaggacggagtgcttgtcgagtaagaccgggttctggagtcgatttgctgctgagttattttttttaagtgtttgcgattatcgtttggttattgtgtgaagcagccgagccaggctatctagtatgaaaatgatcgtctgtaagtatgggttctgaacttctgatgttgccgcatgctagtgatgagtctgaataagtatacagctctaggtggtcagctgcgtctaccacaatgagcatatgtagggagaaatgtctgtcaaagcattttatgaacaataattatttgatttat

SEQ ID NO: 33917 - protein, 62 aa, Panicum virgatum
  misc_feature: Ceres CLONE 1954305
  misc_feature: SWISSPROT Homolog: EC 4.1.1.50 Adenosylmethionine decarboxylase
LLIYQSFSAAEDAVVGSPKSVLHCFEGHNMENAAPVNDGKLANLLCWEEEDAMEEKDGVLVE

SEQ ID NO: 33918 - DNA, 865 bp, Panicum virgatum
  misc_feature: Ceres CLONE 1954306
  misc_feature: Encodes the peptide sequence at SEQ ID NO. 33919
acacagacatccccctcgcgaaaaccctagcagcagctccgctctccaacccctcaggtttcccctcgcagtcggccaggtcctcgcagcgcgggagatggcggatcaggagaccccggttgcagttgaggcaccgacccctgttcttggggagccgatggacttgatgactgctctgcagctcgtcatgaagaagtctggtgcccatgatggcctcgtaaagggtcttcgtgaggctgccaaggccattgagaagcatgctgctcagctctgtgtccttgctgatgactgtgaccagcctgattatgtcaagctggtgaaggctctctgtgctgagcacaatgttcacctggttactgtgcctagtgctaaaactcttggcgagtgggcagggctttgcaagattgactctgagggaaaggcaaggaaggttgtgggctgctcatgtgtggttgtcaaggactacggcgaagaatcagagggccttaacattgtgcaggagtacgtcaagtcgcactagatagtgtgtttccgaatctacattttaggcctgagtttgaaattgtccttggtttcccggcttactaggagattagaacaattttcaagtgcaagccaagattgatgtgaacgatctggatatcttaactcttgttttaagcgctgtgttatctgcttttaatacatgtatctccaagagctggtggtattcttgcttgtttcttattttttgtccttcctggttgatttgtgcctatgctcagtggggggcgcttttgatgttagggctttggttttgcttgcatattgttgccgtgtacctggattgctccctaataatatcacatttattactctttttggc

SEQ ID NO: 33919 - protein, 140 aa, Panicum virgatum; identical to SEQ ID NO: 12414
  misc_feature: Ceres CLONE 1954306
  misc_feature (25)..(120): Pfam Name: Ribosomal_L7Ae Pfam Description: Ribosomal protein L7Ae/L30e/S12e/Gadd45 family

SEQ ID NO: 33920 - DNA, 1081 bp, Panicum virgatum
  misc_feature: Ceres CLONE 1954310
  misc_feature: Encodes the peptide sequence at SEQ ID NO. 33921
aggctgagcgccatccatttatcaacaagtttattacgtctgttgatgatgatagaggatttagttacactcatcctcgagatatacctggtgttaggcaggatggacatgcagcatactttttccatagaagatttgagtcatacagcaatgagggtgatgcaaatattagctggaagaaagttggaacctctagatcgatcttcttggatggaacgctgcaaggttgcaaggaggtgtttgtcttatatgcagacacgatgagtgataaaggttctcagcaaacagattggagattacatcaatatcatatcagaaacacagtgaaggatgaggaagagctagtgttgtctaaaatattttttgaatcacgggacaacctgtgtgaattggctgaggaagctcgtgttgaggccaaattggatgtttccacgcctgatgattcaagagagaaatgtactacatgttctaaccccagagtctttactgagactgatgagcttgatcatatatctctgaaagagcgatacaggatccttctagcagacaaaagcacttgccctgctacaatatcatctaggcaatctagtaaaacatcttcgaaaagaaatcaagaggtaacatcatacaaagaagatatatgtaacatgctgcaggaaatttcctccgcacctcctattatagagagtaatcccatggatgattgcaacagcagtaggttgctttgtgaagatgattcaggtttcttgagtatttctggcatatcatctcataccggtccatccgtatgcgaagttggatgctctcatgatccagtggagggaaatcagataggtggcactgcaacttgtgggagtgaaagcagtgaacttattgtaagaaaacaggggggccttcttgctgatgttaaattggagcctgcattagaagggtatgagattgacccttctgaatctcctcaagaaaatcctgctcaagctgaaggctcagtagcatctttattaggagtaaaagatgaactaaatgagtgtgatttacctggcttatgtgagaaaatttcattcagttcccgaaaacgcag

SEQ ID NO: 33921 - protein, 359 aa, Panicum virgatum
  misc_feature: Ceres CLONE 1954310
  misc_feature (1)..(105): Pfam Name: NAM Pfam Description: No apical meristem (NAM) protein
AERHPFINKFITSVDDDRGFSYTHPRDIPGVRQDGHAAYFFHRRFESYSNEGDANISWKKVGTSRSIFLDGTLQGCKEVFVLYADTMSDKGSQQTDWRLHQYHIRNTVKDEEELVLSKIFFESRDNLCELAEEARVEAKLDVSTPDDSREKCTTCSNPRVFTETDELDHISLKERYRILLADKSTCPATISSRQSSKTSSKRNQEVTSYKEDICNMLQEISSAPPIIESNPMDDCNSSRLLCEDDSGFLSISGISSHTGPSVCEVGCSHDPVEGNQIGGTATCGSESSELIVRKQGGLLADVKLEPALEGYEIDPSESPQENPAQAEGSVASLLGVKDELNECDLPGLCEKISFSSRKR

SEQ ID NO: 33922 - DNA, 389 bp, Panicum virgatum
  misc_feature: Ceres CLONE 1954313
  misc_feature: Encodes the peptide sequence at SEQ ID NO. 33923
aaaaccgaggaggattggactcgctccacccccgaagcgtgtgtactgtgtacgcccgcgcacggccatggcagccgtcgcctcctcgtccccgcccctatccacaaaccctaggtagcacgagagcctcccgccgccagatccccgagtcccgcgccgatctgagctccctagctagatttccgcggcgaagagagcgcgttttttttcagcagtctttttttcttcttcttttccttcggtcggttttggcaaggagagggctggagtaatggagcccagggtcgggaacaagttccggctcggccgcaagatcgggagcggctccttcggagagatctacctcggcaccaatatccagacgaacgaggaggtcgcgattaagctgg

SEQ ID NO: 33923 - protein, 39 aa, Panicum virgatum
  misc_feature: Ceres CLONE 1954313
  misc_feature: SWISSPROT Homolog: EC 2.7.11.1 Non-specific serine/threonine protein kinase
  misc_feature: The sequence is a functional homolog of SEQ ID NO 32 in US patent 7179962
MEPRVGNKFRLGRKIGSGSFGEIYLGTNIQTNEEVAIKL

SEQ ID NO: 33924 - DNA, 957 bp, Panicum virgatum
  misc_feature: Ceres CLONE 1954318
  misc_feature: Encodes the peptide sequence at SEQ ID NO. 33925
aaagcaaagcatccaggagcattaattccatccatggcgtcccgctacgaggtggaggtcaccgtgggttctgccaccaacctcaagaacgtcaactggcgcaacggcgacctccatccctacgccgtgctctggatcgacgacggccccaagtgctccacccgcgtcgacctcgacaacggtgaggaccccgtctgggacgacaagctcctcgtccccgtccctccgtccgtgacccgcctcgaggacgccgtcctctgcatcgacgtcgtccacgccgacgccgccgagggcgtcaagcctctcgtcggctccgcgcgcctcccgctccgcgacgtcctcgacgacgccggcatcgggggcaaggtctcgcgcagcctcaggctcaagcgcccctcgggcaggccgcagggccgcctcgaggtccgcgtctccgtccgtgaggccgcgccgccgcgatactacgagccggctcaggcggcctacggcgcgcgcgacccatactacgccgcccctcccggcgaatacggcggccagcagccgtacgctgcgccgccggcgggctacccggcggcctacggcggttacggagcagccgccgccgctgctcctccagttccagcaccaccggtggcctacggggcgggtagcggtgatccttgtgctgcggcggcgtacggttttgctgctcctccaacgaagagcaagatggggatggggacggggcttgcggtgggcgcggcggcggggctgctgggcgggctggcgctggcggaaggggcaagctacctggaggacaagttcgaggaccacgtggcggagaaggtggaggaggacctgtacgccgacgacgacggtggctacgacgacgactactagctaggatcactgtctgtcactggtgaatcatgcatgagagccggtcaggttgaaataacaagtgcccgcacgcaacgc

SEQ ID NO: 33925 - protein, 281 aa, Panicum virgatum
  misc_feature: Ceres CLONE 1954318
  misc_feature (7)..(96): Pfam Name: C2 Pfam Description: C2 domain
MASRYEVEVTVGSATNLKNVNWRNGDLHPYAVLWIDDGPKCSTRVDLDNGEDPVWDDKLLVPVPPSVTRLEDAVLCIDVVHADAAEGVKPLVGSARLPLRDVLDDAGIGGKVSRSLRLKRPSGRPQGRLEVRVSVREAAPPRYYEPAQAAYGARDPYYAAPPGEYGGQQPYAAPPAGYPAAYGGYGAAAAAAPPVPAPPVAYGAGSGDPCAAAAYGFAAPPTKSKMGMGTGLAVGAAAGLLGGLALAEGASYLEDKFEDHVAEKVEEDLYADDDGGYDDDY

SEQ ID NO: 33926 - DNA, 986 bp, Panicum virgatum
  misc_feature: Ceres CLONE 1954322
  misc_feature: Encodes the peptide sequence at SEQ ID NO. 33927
aagcaaaaaaacactccaacacaattcaagcaggaccaaaggcagcaacagcaccccgggctcaagcgagcttgaagtggtcagaacaagatgtgccaaatcaagaaggagatgagcgccgagtcgggctccccgtgcagctcggccacgtcctcgacctcgacctcgtcggagcaccaccagacggtgtggtcgtcgccgccgaagcggcccgcggggcggaccaagttccgggagacgcggcaccccgtgttccgcggcgtgcggcgccggggcaacgccgggcggtgggtgtgcgaggtgcgcgtgccgggccgccgcggctgcaggctctggctcggcaccttcgacaccgccgagggggccgcgcgcgcgcacgacgccgccatgctcgccatcgccggcgcgggcgcctgcctcaacttcgccgactcggcgtggctcctcgcggtccccgcctcctacgccagcctcgccgaggtgcgccacgcggtcgccgaggccgtggaggagttccagcgccgggaggcgctcccggagcaggagggacgcgcgctcggccacgtctctysacgccgtctgtaccctgccagcgaggacggcagcgccaccgacggcgaggggtcctctgactcctccccggccaccggggcctcgccgttcgagctggacgcgttcaacgacatgagctgggacttgtactacgcgagcatggcgcaggcgatgctcatggagccgccgtctgcggtcatggagttcggcgacgccagcatcatcgatgtgccactttggagctactagaagcgatgctgctgagccggagcttagcttttccttttctttcacatggcctcggacgccatttcttttgcctgtatgtaattttacttctttgagaaaacagagcaaaacagagcatgcccatttgactttcttagactcgcaaaaacattcaaatctaacgcttaagttagcggttgaccctg

SEQ ID NO: 33927 - protein, 236 aa, Panicum virgatum
  misc_feature: Ceres CLONE 1954322
  misc_feature (53)..(106): Pfam Name: AP2 Pfam Description: AP2 domain
  misc_feature: The sequence is a functional homolog of SEQ ID NO 2 in US patent 7253000
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 2 in US patent 7138277
  misc_feature: The sequence is a functional homolog of SEQ ID NO 1248 in the 10/374,780 US patent application
  misc_feature: The sequence is a functional homolog of SEQ ID NO 1235 in the 10/374,780 US patent application
  misc_feature: The sequence is a functional homolog of SEQ ID NO 714 in the 11/435,388 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 1227 in the 10/374,780 US patent application
  misc_feature: The sequence is a functional homolog of SEQ ID NO 706 in the 11/435,388 US patent application
  misc_feature: The sequence is a functional homolog of SEQ ID NO 1228 in the 10/374,780 US patent application
  misc_feature: The sequence is a functional homolog of SEQ ID NO 722 in the 11/435,388 US patent application
  misc_feature: The sequence is a functional homolog of SEQ ID NO 1221 in the 10/374,780 US patent application
  misc_feature: The sequence is a functional homolog of SEQ ID NO 1410 in the 10/412,699 US patent application
  misc_feature: The sequence is a functional homolog of SEQ ID NO 720 in the 11/435,388 US patent application
  misc_feature: The sequence is a functional homolog of SEQ ID NO 752 in the 11/435,388 US patent application
  misc_feature: The sequence is a functional homolog of SEQ ID NO 1226 in the 10/374,780 US patent application
  misc_feature: The sequence is a functional homolog of SEQ ID NO 1225 in the 10/374,780 US patent application
  misc_feature: The sequence is a functional homolog of SEQ ID NO 4 in US patent 7317141
  misc_feature: The sequence is a functional homolog of SEQ ID NO 750 in the 11/435,388 US patent application
  misc_feature: The sequence is a functional homolog of SEQ ID NO 1245 in the 10/374,780 US patent application
  misc_feature: The sequence is a functional homolog of SEQ ID NO 1238 in the 10/374,780 US patent application
  misc_feature: The sequence is a functional homolog of SEQ ID NO 770 in the 11/435,388 US patent application
  misc_feature: The sequence is a functional homolog of SEQ ID NO 1243 in the 10/374,780 US patent application
  misc_feature: The sequence is a functional homolog of SEQ ID NO 768 in the 11/435,388 US patent application
  misc_feature: Functional homolog of the protein sequence given in SEQ ID NO 50529
  misc_feature: Useful for making plants with altered terpenoid content
  misc_feature: Useful for making plants with modulated flowering time
  misc_feature: The sequence is a functional homolog of SEQ ID NO 780 in the 11/435,388 US patent application
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 692 in the 11/435,388 US patent application
  misc_feature: The sequence is a functional homolog of SEQ ID NO 1241 in the 10/374,780 US patent application
  misc_feature: The sequence is a functional homolog of SEQ ID NO 762 in the 11/435,388 US patent application
  misc_feature: The sequence is a functional homolog of SEQ ID NO 1236 in the 10/374,780 US patent application
  misc_feature: The sequence is a functional homolog of SEQ ID NO 696 in the 11/435,388 US patent application
  misc_feature: The sequence is a functional homolog of SEQ ID NO 704 in the 11/435,388 US patent application
  misc_feature: Functional homolog of the protein sequence given in SEQ ID NO 51039
  misc_feature: Useful for making plants with modulated biomass
  misc_feature: The sequence is a functional homolog of SEQ ID NO 694 in the 11/435,388 US patent application
  misc_feature: The sequence is a functional homolog of SEQ ID NO 1234 in the 10/374,780 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: Functional homolog of the protein sequence given in SEQ ID NO 50249
  misc_feature: Useful for making plants with altered lignin content
  misc_feature (161)..(161): Xaa is any aa, unknown, or other
MCQIKKEMSAESGSPCSSATSSTSTSSEHHQTVWSSPPKRPAGRTKFRETRHPVFRGVRRRGNAGRWVCEVRVPGRRGCRLWLGTFDTAEGAARAHDAAMLAIAGAGACLNFADSAWLLAVPASYASLAEVRHAVAEAVEEFQRREALPEQEGRALGHVSXRRLYPASEDGSATDGEGSSDSSPATGASPFELDAFNDMSWDLYYASMAQAMLMEPPSAVMEFGDASIIDVPLWSY

SEQ ID NO: 33928 - DNA, 936 bp, Panicum virgatum
  misc_feature: Ceres CLONE 1954355
  misc_feature: Encodes the peptide sequence at SEQ ID NO. 33929
ctcagactggtccgccgccgctcctttcgccgccgtcgcgtctccttctcaggtaggtaggacaagaagagggcgaaatggtgaagcacaacaacattatccccaacgggcacttcaagaagcactggcagaactatgtcaagacatggttcaaccagcccgcccgcaagcagaggcgccgcattgctcgtcaaaagaaggatgcgaagatattcccacgcccaactgctggacctcttcgccccattgtccaatgccagactctcaagtataacatgaagtcaagggctggcagaggctttactcttgaggagctgaatgctgcgggcattccgaagaagcttgctccaaccattggcatttctgtggatcaccgccgcaagaacaaatcacttgagggacttcaggctaatgtccagaggctgaagacatacaaggccaagctggttatcttcccaaggcgtgctcgcaaggtcaaggctggtgactctactcccgaggagcttgccagtgccacccaggtccagggtgactacatgcctattactcgtggtgagaagcgctcggttgaggttgtgaaggtcagcgatgagatgaagtcgttcgcagcctatggcaagatccgccttgagaggatgaacaagaagcaccttggtgcccgccagaagaaggccgctgaggtagagaaggaagagaagaagtaaagcggccagatattggatatagtatcttctagttgatgctacagcgaagggcttgctctaagttctttttgctgctgaaaatagagaccagccgattgttttggtgtccttgtactgtttgatacctggtactcatttgcggttcatcggacacttgccttctcttcatttctgaattgcttaacctgtcatgaagtttgcctgcctgaaatttgtgatggtaattttgggc

SEQ ID NO: 33929 - protein, 208 aa, Panicum virgatum
  misc_feature: Ceres CLONE 1954355
  misc_feature (6)..(185): Pfam Name: Ribosomal_L13e Pfam Description: Ribosomal protein L13e
  misc_feature: Functional homolog of the protein sequence given in SEQ ID NO 50165
  misc_feature: Useful for making plants with modulated nitrogen use efficiency
  misc_feature: Functional homolog of the protein sequence given in SEQ ID NO 50166
  misc_feature: Useful for making plants with modulated phosphate use efficiency
MVKHNNIIPNGHFKKHWQNYVKTWFNQPARKQRRRIARQKKDAKIFPRPTAGPLRPIVQCQTLKYNMKSRAGRGFTLEELNAAGIPKKLAPTIGISVDHRRKNKSLEGLQANVQRLKTYKAKLVIFPRRARKVKAGDSTPEELASATQVQGDYMPITRGEKRSVEVVKVSDEMKSFAAYGKIRLERMNKKHLGARQKKAAEVEKEEKK

SEQ ID NO: 33930 - DNA, 643 bp, Panicum virgatum
  misc_feature: Ceres CLONE 1954357
  misc_feature: Encodes the peptide sequence at SEQ ID NO. 33931
ccaggggaagaagaggttcgacatggatcctccggtcggcccctttggcactaaggaggaaccagctgtgattgaatcctactataacaagagaatagttggctgtcctggtggcgaaggagaggatgaacatgacgttgtctggttttggttagaaaaggataaaccacatgagtgcccagtctgctcgcaatactttgtgctcaaagtcattggtaatggaggtgatccagatgggcacgatgatgatgaagatgagcatcactgaggctgtatgtcagttggcgataataagaacttgtgatacatggtttcggccttatctttgcagcatcagactgctctatagtgttgtagttgatgagtgtttcatttcaaaaaaaaaaagatgatgagtgtgaccatgaagcaggtcaggtggtgttttttgcccatgcattttgttcgagccgcgtagaccttacagatgtttctgtttggtatgtgcattttttttcttgagtgcatcatcaaataaaggatgagtgcatcgatctgtttcaatctagtgaccgtgtttgtattttgttctgagatcatcaggtgtggcgatgctcgtgtttgtattttgttctgagatcaaagaacataaatttcagtattc

SEQ ID NO: 33931 - protein, 88 aa, Panicum virgatum
  misc_feature: Ceres CLONE 1954357
  misc_feature (1)..(74): Pfam Name: COX5B Pfam Description: Cytochrome c oxidase subunit Vb
  misc_feature: SWISSPROT Homolog: EC 1.9.3.1 Cytochrome-c oxidase
QGKKRFDMDPPVGPFGTKEEPAVIESYYNKRIVGCPGGEGEDEHDVVWFWLEKDKPHECPVCSQYFVLKVIGNGGDPDGHDDDEDEHH

SEQ ID NO: 33932 - DNA, 610 bp, Panicum virgatum
  misc_feature: Ceres CLONE 1954364
  misc_feature: Encodes the peptide sequence at SEQ ID NO. 33933
agggttcattcgctgcgccgccacttccttccactctccccaacctctcaaaccctcgtcggcgaggcctccggcggcggcgaagtatggtgaagggacgccaaggccagcgcgtcaggatgtacgtgcggggcacgatcctgggctacaagcggtccaagtcgaaccagtacgagaacacgtcgctgctgcagatcgagggcgtcagcaccaaggaggatgtggcgtggtacggcggcaagcggatcgcctacgtctacaaggctaagaccaagagcgacggcaccagcatccggtgcatctggggcaaggtgacgcgcccgcacggcaactccggcgtcgtgcgcgccaagttccggtccaacctcccgcccagctccatgggtaagaaggtccgcgtcttcatgtaccccagcagtatctaatcaaggttccatattcggtcaagcttcgtacttggaggttctgctggaaagcttctatggtgattttgagtagtttagcttgctcttcttttttttttactgaacaggctgttgtcagtcgcaacctagacaacttatgtcaattgtaactcattggccttgaaatgaaagttttatgccgtgtt

SEQ ID NO: 33933 - protein, 112 aa, Panicum virgatum
  misc_feature: Ceres CLONE 1954364
  misc_feature (12)..(106): Pfam Name: Ribosomal_L35Ae Pfam Description: Ribosomal protein L35Ae
MVKGRQGQRVRMYVRGTILGYKRSKSNQYENTSLLQIEGVSTKEDVAWYGGKRIAYVYKAKTKSDGTSIRCIWGKVTRPHGNSGVVRAKFRSNLPPSSMGKKVRVFMYPSSI

SEQ ID NO: 33934 - DNA, 465 bp, Panicum virgatum
  misc_feature: Ceres CLONE 1954365
  misc_feature: Encodes the peptide sequence at SEQ ID NO. 33935
acggttaatgcacgtgactccggctgaccctccacgctctctcacatataaatcactcgtttgggaggccgctgcatcgaggatgaatgtgatgaagggacgccgacgtgggcatggccagatgcaccggcggggcgggatcctgggctacgggcggcccaactccaaccgctaccagaacacgtcgctgctgcggatcgagggcgtcaacaccagggaggatgtggcgtggtacggcggcaatcggatcgcctacgtctacaatgctaacaccaagagcgacggcaccagcatccggtgcatctggggcaaggtgacgcgcccgcacggcaactccggcgtcgtgcgcgccaagttccggtccgacctcccgcccagctccatgggaaagaatgtccgcggcttcatgtaccccagccgttatcaaatccaggttccatattctgccaagccgcgtacttggag

SEQ ID NO: 33935 - protein, 124 aa, Panicum virgatum
  misc_feature: Ceres CLONE 1954365
  misc_feature (11)..(105): Pfam Name: Ribosomal_L35Ae Pfam Description: Ribosomal protein L35Ae
MKGRRRGHGQMHRRGGILGYGRPNSNRYQNTSLLRIEGVNTREDVAWYGGNRIAYVYNANTKSDGTSIRCIWGKVTRPHGNSGVVRAKFRSDLPPSSMGKNVRGFMYPSRYQIQVPYSAKPRTW

SEQ ID NO: 33936 - DNA, 145 bp, Panicum virgatum
  misc_feature: Ceres CLONE 1954365-R
ctggcgtaaaggtgcgatggtgatattgcagtctgtataggattgtggtttggacagattggtaggttgggtgccccggggggtcttgggatcccccattcgtataatccccagtgaatttatattcacatccttttcaaccttc

SEQ ID NO: 33937 - DNA, 796 bp, Panicum virgatum
  misc_feature: Ceres CLONE 1954366
  misc_feature: Encodes the peptide sequence at SEQ ID NO. 33938
aaaaaaaaaaaaaaatcagctgcccaaatttttagctcacagtctccacctctattttcaaatcaacaatcagttctctcaggaaatcaaaatgcttctgaagcttcagctgatgcagatgcagatgaagatgccgaacctgagaaaccaagcagcccttctgtaaagaaggcagaagagaaaggaatagttgttgttcatgaagccaagtgcaaggtgtatgtgaagcatgatgatgctaccaagggttggaaagacattggtgtcggtcaactctctatcagaagtaaagaaggtgcagagaaagcttctaaagagtctactccgaccattgttattaggaacgatgttggtaaaattctcctaaatgctctgatctacaaagggataaaaatgaatgttcagaagaacacagttgcttcgatttttcatacttcggatgcacagtcagatgaatcaagcagtggtgcagttgtagctcgaacatacttgttcaggttgaaaagtgaggatgaggctacaaagttgtcaacagcaatcaaagagaacgcgcccttggactgattcttgcagcttggattaccatctcacgacgcctaagcatctgggcacgagttgtaatagtagagggtaacaccaccaatggcctctgcagcaggccaaaagatgccttgcagagttcttttttgcctatatagttcttgcctgtaacttgtaacgtgtaagactgactggttggcgatgtattagtaccttttcttttcctcacgttatgtatcgtatattgagcattgac

SEQ ID NO: 33938 - protein, 187 aa, Panicum virgatum
  misc_feature: Ceres CLONE 1954366
  misc_feature (54)..(186): Pfam Name: Ran_BP1 Pfam Description: RanBP1 domain
KKKKKSAAQIFSSQSPPLFSNQQSVLSGNQNASEASADADADEDAEPEKPSSPSVKKAEEKGIVVVHEAKCKVYVKHDDATKGWKDIGVGQLSIRSKEGAEKASKESTPTIVIRNDVGKILLNALIYKGIKMNVQKNTVASIFHTSDAQSDESSSGAVVARTYLFRLKSEDEATKLSTAIKENAPLD

SEQ ID NO: 33939 - DNA, 713 bp, Panicum virgatum
  misc_feature: Ceres CLONE 1954371
  misc_feature: Encodes the peptide sequence at SEQ ID NO. 33940
ggctacgagcgccagtactgcgaggcatccgcctccctcacccgcaaatgcaccgccgccgcggccctccaaggagagaagctgaagcagaaggcggcggagatcaaatccggcgtcgatggagccgaggcactgataagaaagatggatcttgaagcaaggaacctccaaccaagcgttagagctgggctactagcaaagatcagggagtacaagtcagatcttaataacctcaagggagccttgaagaggattaccagtggcaacccacagcaaggggcgagggaggagttgctggagtcaggaatggctgatgcattgggggtttctgctgatcaaagatcaagactgctcagggcaactgaaagacagaaccaaacaactaataggctcagagatagccatagaactatgctggagacggaagatcttggagtctccatcttgcatgatctgagtcaacagcgccactctctcttgcatgctcatcgtggattggatgacgttgatgtcaacgttggcaagagcaggaggatcattggaggcatggtgaggagaatggacagaaacaagtggatcatcggtctcatcatagccgtccttgtcttggtcatcctagtgatcctgtatttcaagttcgtgcactagggtttcttctcttaatataatgatgtgcagttctcctgcgcgtttgagaaaaaagttcgtgcact

SEQ ID NO: 33940 - protein, 215 aa, Panicum virgatum
  misc_feature: Ceres CLONE 1954371
  misc_feature (35)..(190): Pfam Name: V-SNARE Pfam Description: Vesicle transport v-SNARE protein
GYERQYCEASASLTRKCTAAAALQGEKLKQKAAEIKSGVDGAEALIRKMDLEARNLQPSVRAGLLAKIREYKSDLNNLKGALKRITSGNPQQGAREELLESGMADALGVSADQRSRLLRATERQNQTTNRLRDSHRTMLETEDLGVSILHDLSQQRHSLLHAHRGLDDVDVNVGKSRRIIGGMVRRMDRNKWIIGLIIAVLVLVILVILYFKFVH

SEQ ID NO: 33941 - DNA, 808 bp, Panicum virgatum
  misc_feature: Ceres CLONE 1954375
  misc_feature: Encodes the peptide sequence at SEQ ID NO. 33942
atcacaaccgacctccgatccacttctgctcaccagacactgctaagctagctagctgctttacacttcactcactagtcactagcagcttgatcattcgacgatcagtgagtgttatcatatatcagtcgtagctgcaatattatatatagaattttatatatggctcgcctctccgccgttgtcgccgtcgtcctggtggctgcgctggtggcggccgagaccgcttcggctgcggtgagctgcagccaggtgacgtcggccgtggcgccgtgcctggggtacgccatgggcagctcggcgtcgccctcgtcggcgtgctgcaacggggtgaggtcgctcaacagccgggcgtcgtcgacggccgacaggcaggcggcgtgcgcctgcctcaagaacatggcggggaggctgggtggcaacatgggcaacgccgccgccagcatccccagcaagtgcggcgtcaacgtcggcgtgccaatcagcccaaacgtcgactgcgccaagattaactgataagatgctaaggatggatgctcagctctttccttctctttgggtacgatgtcggccaacagagcagagagcagtcgtttaatttactacctcttcggctcttccttttacatttgtacaacaccacgcaccacctgtgtacgtcgtcgtctatgtacaacaataatcctctctctgcttatgggtttgctgggtctctgttttcatgtactactaccatgatgctgctgctactgcttgttataggcaggtcaggcagctctccgctcaatcaataaacttttttttctag

SEQ ID NO: 33942 - protein, 117 aa, Panicum virgatum; identical to SEQ ID NO: 12304
  misc_feature: Ceres CLONE 1954375
  misc_feature (28)..(113): Pfam Name: Tryp_alpha_amyl Pfam Description: Protease inhibitor/seed storage/LTP family

SEQ ID NO: 33943 - DNA, 791 bp, Panicum virgatum
  misc_feature: Ceres CLONE 1954382
  misc_feature: Encodes the peptide sequence at SEQ ID NO. 33944
gcatatatcagccgggggccttgggacctcccgcccccgcatccatccatccgtcccctcgaagcaatcgactggaattggaaagaagcgagggacgagagcagcagcgcccgccgtcggcatgggtctgcaggaggaatttgaggagcacgcggagaaggccaagaccttgcctgactccactacagatgagaacaagctgatcctctacgggctctacaagcaagcaaccgttggtgatgtcaacactgggcgtcctgccttctacgacctgaaaggcaaagctaaatgggatgcttggaaggccgttgaagggaagtccaaggaggaagcgatgactgattacatcaccaaggtgaagcagctgctggaggaggctgctgctgcatccacttcctaggccacgaaaacaccaccatccatagtgctgcgtgcatcaataagtaataaacattgttatctgtcagatggctccaggtttcatctatacatgtaattgttcgtcgtcatggatgttcagtgtcgtttaaggctgcaaaactcatgtgaaaacaaatggatgctgtctcagctcatcaccatatggatcttcaaaatctgttatttctgcacccgcattttcatgcccatgagtacagtacgagtctgcagccatgtttctgcatctgcaggaccgattggtattgctgcaaaagttcaggatatgtctttcatgttgttgggcacgcatctgactgtatcctcaataatattgaattattgatactcctatacgatgcagatctttatct

SEQ ID NO: 33944 - protein, 92 aa, Panicum virgatum; identical to SEQ ID NO: 26083
  misc_feature: Ceres CLONE 1954382
  misc_feature (3)..(87): Pfam Name: ACBP Pfam Description: Acyl CoA binding protein
  misc_feature: SWISSPROT Homolog: EC 5.3.3.8 Dodecenoyl-CoA isomerase

SEQ ID NO: 33945 - DNA, 739 bp, Panicum virgatum
  misc_feature: Ceres CLONE 1954388
  misc_feature: Encodes the peptide sequence at SEQ ID NO. 33946
acgcaacgcaatcttgcaatccagcccccgaaagagacctaaaaaccgccaccaggctttcgatcgcgccgagggaggaggacgagcaatggcggccgaggagggagtcgtgatcgcgtgccacaccaaggaggagttcaagaaccagatgaacaaggccaaggatgccggcaagctggtgatcattgacttcactgcctcctggtgtggtccttgccgcatcatcgccccggtgtttgctgaattagccaagaagttcactgacgctttcttcctgaaggtcgatgttgacgagctgaaggtgaggatggtgcccctatagttcatcaaatcacaaccacttggcttcgggtggtgtgtgcgctaatgctgtttccttgttcaacaggaagtagcctcagagtacgagatccaggcgatgccgaccttcctcttcattaagaacggtgagaagatccacactgttgttggtgccaggaaggaggacctccagaccagcatcgagaagcacgcctccgccactgctgcttccgcctccgcctaaggcaatagcgccaccagttatcaataagggccagcccacggcgtggtagcagtaggcgtcgtaattttcagtttggtttgggtgaattgtgagctatgttcaaatctggagtcctgatatgtttggttcctgtgctggacctgttatcgtcctgaatacctgtgttgatatggatgctttgtgactgaaagtttg

SEQ ID NO: 33946 - protein, 77 aa, Panicum virgatum
  misc_feature: Ceres CLONE 1954388
  misc_feature (8)..(77): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MAAEEGVVIACHTKEEFKNQMNKAKDAGKLVIIDFTASWCGPCRIIAPVFAELAKKFTDAFFLKVDVDELKVRMVPL

SEQ ID NO: 33947 - DNA, 745 bp, Panicum virgatum
  misc_feature: Ceres CLONE 1954389
  misc_feature: Encodes the peptide sequence at SEQ ID NO. 33948
ctccaggggcgtcactcgcacgcgtcgcgaggaaaagctgcgcctccctccgcctccgccggcgccgccgcccctccgcgtccgggcttcgccgcctctctgctcttccattgctctgcctccgccgcccctccgctgctcgtgtccccgtcggctgcaacgccaccaccccctcggagaactcgatctacagcagcgcctccagctcggccagctccacatcatattctcttcggcacatgatggcgaccctgaggaacttgaagatcaagacgtcgacgtgcaagaggatcgtcaaggagctgcgctcgtacgagaaggaggtggagaaggaggcggcaaagactgccgacatgaaggacaagggtgccgatccctacgatctcaagcagcaggagaatgttttagcggagtcaaggatgatggtcccagactgccacaagcgacttgaaactgcactggcagacttgaaagcaacgctggctgaactgaaggagtcaaatgaacaaggtgctgagatcggagaagctgagagtacaatcgcagaggtcgaagctgtggtcaagccaacagaagaatgaattctgaactcccaattgctgaactactagcaagcatccttattgctcttgttgagaccttgtgagctcgttagtaagatgtgtttgatgtaaactcatgtaccagtatcttgacctggaaattctacgactgggcacggaattgtgtttgctgctctgcttat

SEQ ID NO: 33948 - protein, 112 aa, Panicum virgatum
  misc_feature: Ceres CLONE 1954389
  misc_feature (6)..(99): Pfam Name: TBCA Pfam Description: Tubulin binding cofactor A
MATLRNLKIKTSTCKRIVKELRSYEKEVEKEAAKTADMKDKGADPYDLKQQENVLAESRMMVPDCHKRLETALADLKATLAELKESNEQGAEIGEAESTIAEVEAVVKPTEE

SEQ ID NO: 33949 - DNA, 824 bp, Panicum virgatum
  misc_feature: Ceres CLONE 1954390
  misc_feature: Encodes the peptide sequence at SEQ ID NO. 33950
atggtgccgttccagaatatctcccctggtgcaccaaactcgctattacaggttgccgtgaaaaataaccagcagccagtgtggtacttcaatgacaaaattccgctgcatgttttcttcgttgaagatggaaagatggagcgagccagttttctcgaggcctggaaatctttacctgatgaccacgagttcacaaaagaattccctgcctcggtcatcagcagcgtagatgcaactgtcgagcgccttgcagcagcaaatgtgttctttatagccaagcggaaaaatgcaaacatggatgttctgtatctatcagccaagatgccccgtggaatccccttccttatagagattacagcagtggtgggtgttcctggtgtaaagtgtgcagtcaaaacgccaaacaaggagatggtccctctcttctttgaagctatggaggctcttaccaagtgagggcagtgttaattgatcagtgtgtctacaaaaatcttgatcagttaatgagctgctataggccttcggactcgggatttttttttttcacggaagctggtgtgaaatgtatttgttgtttttgtattagattacagtattcaaactgctagtttcctggttccaaagtttttccccaaaaatactgaagatgttcttatctcagcatgatttgtatatttgcccatttgggctcgaacctttttcttcttgttatgcatagcatgtgaaatatgactagttttcaactgatagctgatgtaaattgttttgctttaccctagactacttctactatctcattctcatcttcgatggaatgaccaatt

SEQ ID NO: 33950 - protein, 151 aa, Panicum virgatum
  misc_feature: Ceres CLONE 1954390
  misc_feature (40)..(151): Pfam Name: B2-adapt-app_C Pfam Description: Beta2-adaptin appendage, C-terminal sub-domain
  misc_feature: SWISSPROT Homolog: EC 3.1.1.61 Protein-glutamate methylesterase
MVPFQNISPGAPNSLLQVAVKNNQQPVWYFNDKIPLHVFFVEDGKMERASFLEAWKSLPDDHEFTKEFPASVISSVDATVERLAAANVFFIAKRKNANMDVLYLSAKMPRGIPFLIEITAVVGVPGVKCAVKTPNKEMVPLFFEAMEALTK

SEQ ID NO: 33951 - DNA, 613 bp, Panicum virgatum
  misc_feature: Ceres CLONE 1954397
  misc_feature: Encodes the peptide sequence at SEQ ID NO. 33952
gttcactatggctgcaaaggagggtggaagtggagggacaccaagaagccaaaccctaacatcatagttggagccatggtcgctggccctgatcgccatgatggattcaaagatgcccgcaagaactacaactacactgaagcaacgctggcgggcaatgctggtctagtcgcagcattggtagctttgtcaggtgaaggccatggggtggacaagaacacgatgttctctgcagtgccgcccatgttcccttcacctccaccaccaccggcgccatggaaaccatagtgggtgcgagtatctgattcttttgtagatccccccctcctcatgtcgcaatactgctgtggagttctaacaagtgaagatgtagcatcgcgatttggtctatctttcagtgttgtgtaatcgccgtgctgtgtatggaactaagttgtgtatgaatctctacgttctaatttagtaatagactagaaactgggtcgcaccgttggtgtgccagtctgtgcttatccagtggatgtcgtgtgatagtattagcataagttatattttgcaaatttaaaagactatgtaactattgggaacgatctgatttttaacttttttttgt

SEQ ID NO: 33952 - protein, 95 aa, Panicum virgatum
  misc_feature: Ceres CLONE 1954397
  misc_feature: SWISSPROT Homolog: EC 3.2.1.4 Cellulase
  misc_feature: Functional homolog of the protein sequence given in SEQ ID NO 50500
  misc_feature: Useful for making plants with altered cell wall content and/or composition
  misc_feature: Functional homolog of the protein sequence given in SEQ ID NO 50501
  misc_feature: Useful for making plants with altered carbohydrate content
VHYGCKGGWKWRDTKKPNPNIIVGAMVAGPDRHDGFKDARKNYNYTEATLAGNAGLVAALVALSGEGHGVDKNTMFSAVPPMFPSPPPPPAPWKP

SEQ ID NO: 33953 - DNA, 694 bp, Panicum virgatum
  misc_feature: Ceres CLONE 1954401
  misc_feature: Encodes the peptide sequence at SEQ ID NO. 33954
agccgtgatagcaatagagcccttttcttttctccctccttccatcccaagtctcaacatcttcttcagttcatcaccaaacatcaagggcgcgcgccctcagatcaccttatatatgggtcctcagcaagatcggcgttccatggcggcgaacggcacggcggcgaggaaggagacgaataataaggtggtgcactaccgggagtgccagcgcaaccacgcggcggccatcggcgggtacgccgtggacgggtgccgggagttcatggcgtcgggcgcggagggcacggccgcggcgctcatgtgcgccgcctgcgggtgccaccgcagcttccacaggcgcgaggtggagcccgacttggactgctcctccaccacctccgcctgaattgaatctcgagatcgatcgatcatgggtggcaaaggcattgaaatgattggtagctgcattatattcaaccgtatatggaatggacatatttattttcttcttctttttccccttatggccttggatttgcagtgaaacttatgtatgtgttgatggttcgtgtatggtgcttgtaactgacgttatgtatatagtcaaagtgctttacttgctgtgtgtgtgtgtgtgtgtgtgtatatatatatatatcatgctcatcttcatggacgaaattaaaattgcgagagaaatttatattggtac

SEQ ID NO: 33954 - protein, 90 aa, Panicum virgatum; identical to SEQ ID NO: 18635
  misc_feature: Ceres CLONE 1954401
  misc_feature (23)..(82): Pfam Name: ZF-HD_dimer Pfam Description: ZF-HD protein dimerisation region
  misc_feature: Functional homolog of the protein sequence given in SEQ ID NO 50409
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 50410
  misc_feature: Useful for making plants with modulated low light sensitivity
  misc_feature: The sequence is a functional homolog of SEQ ID NO 112 in the 10/714,887 US patent application
  misc_feature: The sequence is a functional homolog of SEQ ID NO 112 in the 11/435,388 US patent application
  misc_feature: The sequence is a functional homolog of SEQ ID NO 106 in the 10/714,887 US patent application
  misc_feature: The sequence is a functional homolog of SEQ ID NO 106 in the 11/435,388 US patent application
  misc_feature: The sequence is a functional homolog of SEQ ID NO 14 in the 10/714,887 US patent application
  misc_feature: The sequence is a functional homolog of SEQ ID NO 14 in the 11/435,388 US patent application
  misc_feature: The sequence is a functional homolog of SEQ ID NO 626 in the 10/666,642 US patent application
  misc_feature: The sequence is a functional homolog of SEQ ID NO 60 in the 10/714,887 US patent application
  misc_feature: The sequence is a functional homolog of SEQ ID NO 60 in the 11/435,388 US patent application
  misc_feature: The sequence is a functional homolog of SEQ ID NO 64 in the 10/714,887 US patent application
  misc_feature: The sequence is a functional homolog of SEQ ID NO 64 in the 11/435,388 US patent application
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: The sequence is a functional homolog of SEQ ID NO 108 in the 10/714,887 US patent application
  misc_feature: The sequence is a functional homolog of SEQ ID NO 108 in the 11/435,388 US patent application
  misc_feature: The sequence is a functional homolog of SEQ ID NO 104 in the 10/714,887 US patent application
  misc_feature: The sequence is a functional homolog of SEQ ID NO 104 in the 11/435,388 US patent application
  misc_feature: The sequence is a functional homolog of SEQ ID NO 54 in the 10/714,887 US patent application
  misc_feature: The sequence is a functional homolog of SEQ ID NO 54 in the 11/435,388 US patent application
  misc_feature: The sequence is a functional homolog of SEQ ID NO 62 in the 10/714,887 US patent application
  misc_feature: The sequence is a functional homolog of SEQ ID NO 62 in the 11/435,388 US patent application
  misc_feature: The sequence is a functional homolog of SEQ ID NO 624 in the 10/666,642 US patent application
  misc_feature: The sequence is a functional homolog of SEQ ID NO 52 in the 10/714,887 US patent application
  misc_feature: The sequence is a functional homolog of SEQ ID NO 52 in the 11/435,388 US patent application
  misc_feature: The sequence is a functional homolog of SEQ ID NO 620 in the 10/666,642 US patent application
  misc_feature: The sequence is a functional homolog of SEQ ID NO 116 in the 10/714,887 US patent application
  misc_feature: The sequence is a functional homolog of SEQ ID NO 116 in the 11/435,388 US patent application
  misc_feature: The sequence is a functional homolog of SEQ ID NO 1554 in the 10/666,642 US patent application
  misc_feature: The sequence is a functional homolog of SEQ ID NO 44 in the 10/714,887 US patent application
  misc_feature: The sequence is a functional homolog of SEQ ID NO 44 in the 11/435,388 US patent application
  misc_feature: The sequence is a functional homolog of SEQ ID NO 58 in the 10/714,887 US patent application
  misc_feature: The sequence is a functional homolog of SEQ ID NO 58 in the 11/435,388 US patent application
  misc_feature: The sequence is a functional homolog of SEQ ID NO 622 in the 10/666,642 US patent application
  misc_feature: The sequence is a functional homolog of SEQ ID NO 118 in the 10/714,887 US patent application
  misc_feature: The sequence is a functional homolog of SEQ ID NO 118 in the 11/435,388 US patent application
  misc_feature: The sequence is a functional homolog of SEQ ID NO 102 in the 10/714,887 US patent application
  misc_feature: The sequence is a functional homolog of SEQ ID NO 102 in the 11/435,388 US patent application
  misc_feature: The sequence is a functional homolog of SEQ ID NO 48 in the 10/714,887 US patent application
  misc_feature: The sequence is a functional homolog of SEQ ID NO 48 in the 11/435,388 US patent application
  misc_feature: The sequence is a functional homolog of SEQ ID NO 122 in the 10/714,887 US patent application
  misc_feature: The sequence is a functional homolog of SEQ ID NO 122 in the 11/435,388 US patent application
  misc_feature: The sequence is a functional homolog of SEQ ID NO 126 in the 10/714,887 US patent application
  misc_feature: The sequence is a functional homolog of SEQ ID NO 126 in the 11/435,388 US patent application
  misc_feature: The sequence is a functional homolog of SEQ ID NO 120 in the 10/714,887 US patent application
  misc_feature: The sequence is a functional homolog of SEQ ID NO 120 in the 11/435,388 US patent application
  misc_feature: The sequence is a functional homolog of SEQ ID NO 114 in the 10/714,887 US patent application
  misc_feature: The sequence is a functional homolog of SEQ ID NO 114 in the 11/435,388 US patent application
  misc_feature: The sequence is a functional homolog of SEQ ID NO 46 in the 10/714,887 US patent application
  misc_feature: The sequence is a functional homolog of SEQ ID NO 46 in the 11/435,388 US patent application
  misc_feature: The sequence is a functional homolog of SEQ ID NO 616 in the 10/666,642 US patent application
  misc_feature: The sequence is a functional homolog of SEQ ID NO 50 in the 10/714,887 US patent application
  misc_feature: The sequence is a functional homolog of SEQ ID NO 50 in the 11/435,388 US patent application
  misc_feature: The sequence is a functional homolog of SEQ ID NO 618 in the 10/666,642 US patent application
  misc_feature: The sequence is a functional homolog of SEQ ID NO 124 in the 10/714,887 US patent application
  misc_feature: The sequence is a functional homolog of SEQ ID NO 124 in the 11/435,388 US patent application
  misc_feature: The sequence is a functional homolog of SEQ ID NO 66 in the 10/714,887 US patent application
  misc_feature: The sequence is a functional homolog of SEQ ID NO 66 in the 11/435,388 US patent application
  misc_feature: The sequence is a functional homolog of SEQ ID NO 128 in the 10/714,887 US patent application
  misc_feature: The sequence is a functional homolog of SEQ ID NO 128 in the 11/435,388 US patent application
  misc_feature: The sequence is a functional homolog of SEQ ID NO 628 in the 10/666,642 US patent application
  misc_feature: The sequence is a functional homolog of SEQ ID NO 68 in the 10/714,887 US patent application
  misc_feature: The sequence is a functional homolog of SEQ ID NO 68 in the 11/435,388 US patent application
  misc_feature: The sequence is a functional homolog of SEQ ID NO 56 in the 10/714,887 US patent application
  misc_feature: The sequence is a functional homolog of SEQ ID NO 56 in the 11/435,388 US patent application

SEQ ID NO: 33955 - DNA, 617 bp, Panicum virgatum
  misc_feature: Ceres CLONE 1954416
  misc_feature: Encodes the peptide sequence at SEQ ID NO. 33956
aaatcatcatattgctttcactgccgcggctcgtcctcctcctcttgtcctcgccttgccgtcctcaatagtcaattccctcggcctccttccggccttccctgtgctgtgctgtgctgtgcggtgacttgtcctctaccggggggctgccgggctgctgttgactggaggagagatccattcgtccgcacccctcttcttttgccgcatcatgtcagagacgaaggactctaacactgctgctcttgatggaaatcctgaacctatggatcaaagtgaagacaattctatgccatcagctcagcagcaagaagaagcaatcaagaagaagtttggtggactaatgcccaaaaagccaccactcatctcaaaggatcatgagcgggcctactttgattctgctgattgggctctaggaaagcaaggtgttgccaaacccaaaggacccctggaggcacttaggccaaagctgcagccaacacgccaacagcaacaacaacgtgcaaggcgctctatttacacttcgtcagaaaacaaggacagtgatagcgctggtgctgaagatatgaacatcaactgaagtggccctggaatctgcaggacgtgctgcgttgttg

SEQ ID NO: 33956 - protein, 122 aa, Panicum virgatum
  misc_feature: Ceres CLONE 1954416
  misc_feature (38)..(121): Pfam Name: Lg106 Pfam Description: Lg106-like protein
  misc_feature: Functional homolog of the protein sequence given in SEQ ID NO 50181
  misc_feature: Useful for biocontainment applications
MSETKDSNTAALDGNPEPMDQSEDNSMPSAQQQEEAIKKKFGGLMPKKPPLISKDHERAYFDSADWALGKQGVAKPKGPLEALRPKLQPTRQQQQQRARRSIYTSSENKDSDSAGAEDMNIN

SEQ ID NO: 33957 - DNA, 148 bp, Panicum virgatum
  misc_feature: Ceres CLONE 1954416-R
acataggtgacccttgcgttagttgcatgtccgcatgagatgatggagtacaaggttaattagtccagcatttggcatgagatatcctaggaaattattatgttgcatatttatttgtggataaatatatgatgcgtgatatgtgagc

SEQ ID NO: 33958 - DNA, 587 bp, Panicum virgatum
  misc_feature: Ceres CLONE 1954417
  misc_feature: Encodes the peptide sequence at SEQ ID NO. 33959
acacgcgcttcgttcctcctcgtccctcggctcggcctcgcctcctctccgtctccctgcagagagagcgcagcaaggcaagaggggggataggaggaggaagagagcaggagatggcaggctgcgagggagccaagtcaccggcctcccaggaggaagaggcatgtgttgagaagaagtacggaggaattgcgcccaagaagcctttgatatccaaggaccacgagcgcgcgtacttcgattcagcagactgggtgctcggcaagcaagctgcaaatagcagcacaagggctgctgtcgagtctctgaagcccaagctgaagagaacgcctcaccaccagctcccccctcgcaagccgacctgcgcttccagctgagacgcacgctggagggagtgctcggaggcaagaaagggagaatgaatgattgagctcggataaatgcttggcagccgaaatcgtagggatggatcacaagcccgaggtgcaatctggttagtacttgtcaattgcagcctctactatgtctatcatcagaacggattaattatcggcatcatgcttaagttagatggtacttggtggttg

SEQ ID NO: 33959 - protein, 87 aa, Panicum virgatum; identical to SEQ ID NO: 18681
  misc_feature: Ceres CLONE 1954417
  misc_feature (20)..(87): Pfam Name: Lg106 Pfam Description: Lg106-like protein
  misc_feature: Functional homolog of the protein sequence given in SEQ ID NO 50181
  misc_feature: Useful for biocontainment applications

SEQ ID NO: 33960 - DNA, 779 bp, Panicum virgatum
  misc_feature: Ceres CLONE 1954426
  misc_feature: Encodes the peptide sequence at SEQ ID NO. 33961
acaaatcccccgcaacctcccaacgcatcctctcattcaaaccctcgttcctccagcaccaagagaatccgagcggcctcgatggcgcccaaggcggagaagaagccggcggccaagaagcccgcagaggaggagcccgcggagaaggcggctccggcggagaaggcccccgctggcaagaagcccaaggcggagaagcggctcccggcgggcaagtctgccggcaaggagggcggcgacaagaaggggaagaagaaggccaagaagagcgtggagacgtacaagatctacatcttcaaggtcctcaagcaggtgcaccccgacatcggcatctcctccaaggccatgtccatcatgaactccttcatcaacgacatcttcgagaagctcgccgcggaggccgccaagctcgcccgctacaacaagaagcccaccatcacctcccgcgagatccagacctcggtgcgcctcgtcctccccggggagctcgccaagcacgccgtgtcagagggcaccaaggctgtcaccaagttcacctcgtcttaggctatgatgaaaggcttgtttgcgcctgcctgtgatgtgttgcttctgctgttagtagtggtagttcggagtattggctggtgtggtgtagtgaactgttccggtggcttttgtggcttatcgtggtggtaatggaaggctattgttatgtgaaacttgatcagtaatccaatgtttgcatgtcatgttaggctagcagtatgtctcgattgttttgtgattcgtgatgtgct

SEQ ID NO: 33961 - protein, 154 aa, Panicum virgatum; identical to SEQ ID NO: 14859
  misc_feature: Ceres CLONE 1954426
  misc_feature (61)..(131): Pfam Name: Histone Pfam Description: Core histone H2A/H2B/H3/H4
  misc_feature: Functional homolog of the protein sequence given in SEQ ID NO 50160
  misc_feature: Useful for biocontainment applications
  misc_feature: Useful for making plants with modulated flowering time

SEQ ID NO: 33962 - DNA, 541 bp, Panicum virgatum
  misc_feature: Ceres CLONE 1954431
  misc_feature: Encodes the peptide sequence at SEQ ID NO. 33963
atcacaagcgaagagcatcacacaataacttcctctccaccttcttcagcctctctagctggttccttcctcgatcgtgatcaccgaaaggatatgtctagctgcgggggcgactggcggtgcggctccggctgccagtgcggccagggatgcggcggctgcaagaagtcccctgacgtggaggccacctcccccaccaccaccgccaggggcatcgccgccgccagctggacggccagctccggcgggtacgacgcggtcaccgagggcggcggctgctactgcaactgctgcaactgcaccaccaactgcggctgctcctgctgcagctgcgactgacgcggccatggcccgccccgatggagcacgagaaggaatgaaaagccccctgcttagtatatagtaccagaccgtctaaataagatcttgcctgctgcgcgatccttcatctatcgcgtcgcgtcctgaaattcaaggacgcctgccgcgtctcgactagggttgtcaatctgaacgtctctgctgatcgacgacgcatgcc

SEQ ID NO: 33963 - protein, 81 aa, Panicum virgatum
  misc_feature: Ceres CLONE 1954431
  misc_feature (1)..(75): Pfam Name: Metallothio_2 Pfam Description: Metallothionein
MSSCGGDWRCGSGCQCGQGCGGCKKSPDVEATSPTTTARGIAAASWTASSGGYDAVTEGGGCYCNCCNCTTNCGCSCCSCD

SEQ ID NO: 33964 - DNA, 564 bp, Panicum virgatum
  misc_feature: Ceres CLONE 1954431-R
cgctacaggattcgttcatcgctcgggatcccggagagggtatgtgttgaggggagggcatcggcggggaagggtctggctgcaagtgtggcactggaagcggagcaagcaagatgttccgcggcgaggaggcatcatccgccgccgccaccacgaaggtcatcgcggccgctagcagcaaggtgaggtccggcgggttcgaggcggcctccgagggcggggggtgtgactgcaacacgggcaagtgcagcaccagatgagggtgctctggtcgcagctgcaaatgaggtggccatgcgccgccgccatggagcacgaggaggaaggagaagcccccggcgtagtatatagtagcagcgcgtctaaataagagctcgccaaatgggccatccatcatctatcgtgtagggtggcgacattaatggtcgcgatcagagtgtcagatggggtggtcgatccgaacgtctaggcagatagaagccgcaggccggtggtcgatcttagctcgtgtgtctgtcctcctcgggcacgccacctatcctttaatatagggatttcagaacc

SEQ ID NO: 33965 - DNA, 875 bp, Panicum virgatum
  misc_feature: Ceres CLONE 1954462
  misc_feature: Encodes the peptide sequence at SEQ ID NO. 33966
attcgctcccctcctccccactcctcgccgccgcaaatcccacctcgatctgccgccgatcttccccaaaccctcgccgaatcccagatccagcccagccctccagacgctcgcccgccggccgccatggggaaccccgagaagctgatgaaccagatcttcgacctcaagttcacctccaagtcgctgcagcggcaggcgcgcaagtgcgagaaggaggagaaggagcagaagctcaaggtgaagaaggcgatcgagaagggcaacatggacggcgcccgcatctacgccgagaacgccatccgcaagcgcaccgagcacatgaactacctccgcctcgcctcccgcctcgacgccgtcgtggcgcgcctcgacacgcaggccaagatgcaggtcatcggcaagtccatgcagtccatcgtcaagtcgctcgactccgcgctcgccaccgggaacctccagaagatgtccgagaccatggacaacttcgagcgccagttcgtcaacatggaggtccaggccgagttcatggagggcgccatggccggctccacctcgctctccacgcccgagaccgaggtcaacagcctcatgcagcaggtcgccgacgactatggcctcgaggtctccgtcggcctcccgcaggccgcggcgcacgccatccctgctgccaaggataaggagaaggtcgacgaggacgacctctctcgccgccttgctgagctcaaggcccgcggctgagcacctttcaggctttcagctttttcaggtgatgatagattggtcctagccttaatgtatgttttgctgcggcagcctatgggatattgtcgcaaactactatattgattgcgttgctggatagcattgtgccc

SEQ ID NO: 33966 - protein, 204 aa, Panicum virgatum; identical to SEQ ID NO: 18718
  misc_feature: Ceres CLONE 1954462
  misc_feature (9)..(179): Pfam Name: Snf7 Pfam Description: Snf7

SEQ ID NO: 33967 - DNA, 590 bp, Panicum virgatum
  misc_feature: Ceres CLONE 1954471
  misc_feature: Encodes the peptide sequence at SEQ ID NO. 33968
agagaaggaaaggaagcgagcaggaagcagggggctaccgagcggcggcgaggatgaggggcggcggcggcgggatgatggacgacgacgaccgggtgacccacgcgcagatcccgaccagcttcggccccgagctgcgggcctgcctccgatgccgcctcgtcaagacctacgaccagttcaggcagaacggctgcgagaactgcccgttcctggagatggacaaggagcacgacaatgtggtcaactgcactacgccgaacttcactggaataatctctctgatggaccccagtaggagttgggctgctcgttggttgagaattggtaggttcattccagggtgctacacactggcagtctcagaggagcttccggaagagtaccaggggatttgccaggacaacaacgtgcagtacgtgccgcccaagcgtgtctaaggttcagcatgttcacggcatcccaatcctgaagcagtatgataatatatagaatagctggaacggatgtaacgcttgttgtactcaaggagtctattctcttgtcaaatcggcgtgctacgctgagaagttaatagttgattggctgct

SEQ ID NO: 33968 - protein, 128 aa, Panicum virgatum
  misc_feature: Ceres CLONE 1954471
  misc_feature (26)..(128): Pfam Name: Spt4 Pfam Description: Transcription elongation protein Spt4
MRGGGGGMMDDDDRVTHAQIPTSFGPELRACLRCRLVKTYDQFRQNGCENCPFLEMDKEHDNVVNCTTPNFTGIISLMDPSRSWAARWLRIGRFIPGCYTLAVSEELPEEYQGICQDNNVQYVPPKRV

SEQ ID NO: 33969 - DNA, 573 bp, Panicum virgatum
  misc_feature: Ceres CLONE 1954476
  misc_feature: Encodes the peptide sequence at SEQ ID NO. 33970
aagactgcaatggacgcagctgaagctgctctttcagaaaagaagcccttttgtgtcactcatgttgatgtaggccttgataccactgctgtccgggaagcagttatcaaggtcatggcccaaaagggtttgcctgtaatgctattcagcacagatgaatcatcaaacaaagctgttatctatgccggtgtgccgcccaacacgcccagtggcttcaaggtgttggattggctaacaccttcaattgcacccgtcaagggaagaggtggtggtggcaagaacggtgtcgcccagggccagggaaatgatgcttctcaactcaaggaggcaatggagctcgcgaataacattgccgcgatgaagctcagctgatgggtcgaataccttgtgcactccacttttgagcttttgtgtggctgtaggtccagcgctcttcgcttttacattgtctttcacctaacagaaattgtgtaatgtttgctgttccatttacatactataccattcaaaccacatgatgacatacaacctaactgttaagagctggctgaagcagctttcttatttctgttg

SEQ ID NO: 33970 - protein, 123 aa, Panicum virgatum
  misc_feature: Ceres CLONE 1954476
  misc_feature (43)..(116): Pfam Name: DHHA1 Pfam Description: DHHA1 domain
  misc_feature: SWISSPROT Homolog: EC 6.1.1.7 Alanine--tRNA ligase
KTAMDAAEAALSEKKPFCVTHVDVGLDTTAVREAVIKVMAQKGLPVMLFSTDESSNKAVIYAGVPPNTPSGFKVLDWLTPSIAPVKGRGGGGKNGVAQGQGNDASQLKEAMELANNIAAMKLS

SEQ ID NO: 33971 - DNA, 544 bp, Panicum virgatum
  misc_feature: Ceres CLONE 1954487
  misc_feature: Encodes the peptide sequence at SEQ ID NO. 33972
gtattcgggatgtcgcatgggcgccagttttgggcttggccaagtcgaccattgccagcgggtcccaagacgggaaggtcgtcatctggaccaaggggaaagatggagacaagtgggagggaaagctcacgcgggactttgggtctcctgtctggagggtatcttggtccttgactgggaacatactgtccatagctgctggtgaaaacaacattacactctggaaggaagggtcagatggtcactgggaggaggtgatgaaggttgaaccctaggctgtgtgacattttcaagtctcttgcagatccatgtttcgacagagatgagtttgcctttgtgttttactagctcgtcgataaacactatattcacatatttttagtactttgtcatcagcaattatactgttcgatggatggggtgagcattagaatgccactttctgattggtgaacctgcttagttctgtatatcttggttccgtatatcgtcgactttgtttttgctatgggtgaaacatcacagctgctaccagcttgcaagt

SEQ ID NO: 33972 - protein, 90 aa, Panicum virgatum
  misc_feature: Ceres CLONE 1954487
  misc_feature: SWISSPROT Homolog: EC 2.7.7.7 DNA-directed DNA polymerase
IRDVAWAPVLGLAKSTIASGSQDGKVVIWTKGKDGDKWEGKLTRDFGSPVWRVSWSLTGNILSIAAGENNITLWKEGSDGHWEEVMKVEP

SEQ ID NO: 33973 - DNA, 594 bp, Panicum virgatum
  misc_feature: Ceres CLONE 1954516
  misc_feature: Encodes the peptide sequence at SEQ ID NO. 33974
actccatccaattcccaacctcccccaccagaaaacaacaatccccaatttccttcgtgctcgcggcggcggcggcggcggcgatgtcggggcgcggcaagggcggcaaggggctgggcaagggcggcgccaagcgccaccgcaaggtgctccgcgacaacatccaggggatcaccaagccggcgatccggcggctggcccggaggggcggcgtgaagcgcatctcggggctcatctacgaggagacccgcggcgtgctcaagatcttcctcgagaacgtcatccgcgacgccgtcacctacaccgagcacgccaggcgcaagaccgtcaccgccatggacgtcgtctacgcgctcaagcgccagggacgcaccctctacggcttcggcggctaggccctggcgccggtgcgcccccgtctgaggcgcggttcctggattggtgccgtgtgtggttagggatgagggttcgttgtcaagggattggctgtgttggctttctgaatgtagtctgtctttgtgccgtgaagaaatgcgtactgcctatcttgtacgaggattgaacatgcctgcagcaaagaaatggtcgagtttc

SEQ ID NO: 33974 - protein, 103 aa, Panicum virgatum; identical to SEQ ID NO: 12044
  misc_feature: Ceres CLONE 1954516
  misc_feature (25)..(94): Pfam Name: Histone Pfam Description: Core histone H2A/H2B/H3/H4

SEQ ID NO: 33975 - DNA, 1040 bp, Panicum virgatum
  misc_feature: Ceres CLONE 1954546
  misc_feature: Encodes the peptide sequence at SEQ ID NO. 33976
ggaccgcaccgcaggccgcagccagccacaggctcccgtcgcattcgctcgctctctcgcgtcgtcgctcccgaccggtgctcccgcctccgccgatccgcgcacgcagatcgccgaagcccggcggcgcagcggcaaaggggatcgagcgagggagggagggagctcgcgccgatccgcgcacgcagatcgccgatccgcgcacgcagttcgccaccgtctcgaggaagagatggggctctcgttcgggaagctgttcagccgcctcttcgccaagaaggagatgaggatcctcatggtcgggcttgatgccgccggtaagaccaccatcctctacaagctcaagctcggcgagatcgtcactaccatccccaccatcggattcaacgttgaaactgtcgagtacaagaacattagctttactgtttgggatgttggtggccaggacaagatcaggcccctgtggaggcactacttccagaacacgcagggtctcatttttgttgtggacagcaatgacagggagcgtgttgttgaggctagggatgagctccacaggatgctgaatgaggatgagctgcgtgatgctgtgctgcttgtgtttgcaaacaaacaagatcttcctaatgctatgaatgctgctgaaattactgacaagcttggcctgcattccctgcgccagcggcactggtacatccagagcacttgtgctacatctggtgaagggttgtacgaggggcttgattggctttccaacaacatcgccaacaaggcttgaagcttttcggcagggctcccaggaagaggaagatgtctgaacaacttattgctgccttattacatattataattatacaatctacaatagatagtgtgggtgtttgtgaagaaaaagaaactagctctcttttgaggggctagtgccagattcgtatgtttttgtttttggctcggtattatcacctgtccagtttcacagaactgactctgtcaatcatgtgtacttatgttcggagatgtgtggtaaattaaatttacat

SEQ ID NO: 33976 - protein, 181 aa, Panicum virgatum; identical to SEQ ID NO: 10623
  misc_feature: Ceres CLONE 1954546
  misc_feature (1)..(177): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content

SEQ ID NO: 33977 - DNA, 459 bp, Panicum virgatum
  misc_feature: Ceres CLONE 1954581
  misc_feature: Encodes the peptide sequence at SEQ ID NO. 33978
gttattgttgttacgcaactaagcagcgacaccaccctcaacaaaaaaatgtccgaagcaaagaccatcactattgaagaacttgagaagcacaatacccgcaacgactgctggattgttgttgccggtaaagtacttgatgttaccaagttcatcagtgaacatcctggaggtgaagatgttatcatggaacttgcaggtgccgatgctactgagggtttcaacaacgtaggccactctgatgacgcccacaaccttcttaagacatacgagatcggagtttacaagggagagccagctaagcccaaggcccagtctgcacaatcctctgtgaccaagccaccaccaccctccaccatcgacacgattctctcttatgttcctctccttattattgtcatcgccgccattatttactactacacgcggatgtaataaacccacttcagtctcagtctc

SEQ ID NO: 33978 - protein, 128 aa, Panicum virgatum
  misc_feature: Ceres CLONE 1954581
  misc_feature: SWISSPROT Homolog: EC 1.7.1.1 Nitrate reductase (NADH)
MSEAKTITIEELEKHNTRNDCWIVVAGKVLDVTKFISEHPGGEDVIMELAGADATEGFNNVGHSDDAHNLLKTYEIGVYKGEPAKPKAQSAQSSVTKPPPPSTIDTILSYVPLLIIVIAAIIYYYTRM

SEQ ID NO: 33979 - DNA, 585 bp, Panicum virgatum
  misc_feature: Ceres CLONE 1954587
  misc_feature: Encodes the peptide sequence at SEQ ID NO. 33980
catagctaaagcccttcctggcgctcctaatgagattttgcttgttctygatggcaccacaggcttaaacatgttacaacaagcaagggagttcaatgatgttgttggagtcacaggattcatcctgactaagctagatggcacagcgcggggtggctgtgtggttagtgttgtagatgaacttggaatcccagtgaagtttattggggttggtgaagggatggaaratcttcaaccttttgacgctgaggcatttgtggaagccattttcccatgaattcggatttatgctcctactgtaaagttttttttaacgctgtcattacttcagctattcatgtaagagatagttgtcatttgttacgytgaggctgtgaggcgtgactacsaagcagcaaaaagcaaaactaaggaattaaagcacaagacatgagttgaagagctagatgggagagtggtagccgggccggacattgccagtgaaagggtttattagagtctagacctgcaggtcccttgtataagagacttgcgaactgtacctgaagaattcagagaaggaaatggtgaaggatattgattatc

SEQ ID NO: 33980 - protein, 91 aa, Panicum virgatum
  misc_feature: Ceres CLONE 1954587
  misc_feature (1)..(91): Pfam Name: SRP54 Pfam Description: SRP54-type protein, GTPase domain
  misc_feature (76)..(76): Xaa is any aa, unknown, or other
IAKALPGAPNEILLVLDGTTGLNMLQQAREFNDVVGVTGFILTKLDGTARGGCVVSVVDELGIPVKFIGVGEGMEXLQPFDAEAFVEAIFP

SEQ ID NO: 33981 - DNA, 222 bp, Panicum virgatum
  misc_feature: Ceres CLONE 1954598
  misc_feature: Encodes the peptide sequence at SEQ ID NO. 33982
gggggcttggttacaattccgaatacgctattacatgtttgcgctagtttttgttgtttttgatgtggaaacggtctttctctacccttgggcaatgagtttcgacgtattgggtgtatccgtttttatcgaagctttcatttttgtgcttatcctagttgttggtttagtttatgcatggcgaaaaggagccttggaatggtcttaactgaatattcagac

SEQ ID NO: 33982 - protein, 68 aa, Panicum virgatum
  misc_feature: Ceres CLONE 1954598
  misc_feature (1)..(67): Pfam Name: Oxidored_q4 Pfam Description: NADH-ubiquinone/plastoquinone oxidoreductase, chain 3
  misc_feature: SWISSPROT Homolog: EC 1.6.99.5 NADH dehydrogenase (quinone)
GAWLQFRIRYYMFALVFVVFDVETVFLYPWAMSFDVLGVSVFIEAFIFVLILVVGLVYAWRKGALEWS

SEQ ID NO: 33983 - DNA, 312 bp, Panicum virgatum
  misc_feature: Ceres CLONE 1954671
  misc_feature: Encodes the peptide sequence at SEQ ID NO. 33984
gatgtcagccaagttctacgaacgatccatttggacttcgaagggtctcttatggactggtccaaatattggttgagaacaagaaaagctttgacctcagacgggccctcaccttaatggcagaggtgcaacccattaaaatacagagtgatgttatagatgaggcagtacaattcatcacgaggagactggaacagcttctggtggatgagggaattaactgtgagatagtccgctcagtgcttatggagcgtgcaaactgcccttatcttgcagcacaaacagcaacaagatttagatcggttgatgagc

SEQ ID NO: 33984 - protein, 103 aa, Panicum virgatum
  misc_feature: Ceres CLONE 1954671
  misc_feature: SWISSPROT Homolog: EC 6.1.1.14 Glycine--tRNA ligase
CQPSSTNDPFGLRRVSYGLVQILVENKKSFDLRRALTLMAEVQPIKIQSDVIDEAVQFITRRLEQLLVDEGINCEIVRSVLMERANCPYLAAQTATRFRSVDE

SEQ ID NO: 33985 - DNA, 508 bp, Panicum virgatum
  misc_feature: Ceres CLONE 1954713
  misc_feature: Encodes the peptide sequence at SEQ ID NO. 33986
acactctgggaagagcagcacgcagcaaggtcagctagctacaggacgaagctgcagctaccgcggcagatcagatcgatcgagatggcggccgccttctcctccaccgtcggagctccggcctccaccccggccagctccctcgggagcaagctcagcaggaagcaggtgaccgccgccgccgtgaactaccatggcaagagctccggcgccaacaggttcagggtcatggccaaggaggtcgacgagtcaaagcagacggactccgacaggtggaagggcctggcctacgacatctcggacgaccagcaggacatcaccaggggcaagggcctcgtcgactccctcttccaggcgcccacgggagacagacactgctagtagtagtagtaccataatgtgtgcactggaatggaagttaatgggttgtgtgtgaacttattatgtatcggcaatctttaatctgttcaagacttggagttggcaatatatagatgttgctgttatc

SEQ ID NO: 33986 - protein, 98 aa, Panicum virgatum
  misc_feature: Ceres CLONE 1954713
  misc_feature: Functional homolog of the protein sequence given in SEQ ID NO 50305
  misc_feature: Useful for making plants with modulated biomass
MAAAFSSTVGAPASTPASSLGSKLSRKQVTAAAVNYHGKSSGANRFRVMAKEVDESKQTDSDRWKGLAYDISDDQQDITRGKGLVDSLFQAPTGDRHC

SEQ ID NO: 33987 - DNA, 160 bp, Panicum virgatum
  misc_feature: Ceres CLONE 1954739
  misc_feature: Encodes the peptide sequence at SEQ ID NO. 33988
tcggcatcgccaaatgtgttccggctgccaagtcccatgcctccacctacgtgctgggaaccatcggctacattgatccagagtatgcccggacgtcaaggctcaatgagaaatctgatgtctacagctttggcatcgtccttctagagctgctcaccgg

SEQ ID NO: 33988 - protein, 52 aa, Panicum virgatum
  misc_feature: Ceres CLONE 1954739
  misc_feature: SWISSPROT Homolog: EC 2.7.11.1 Non-specific serine/threonine protein kinase
  misc_feature: Functional homolog of the protein sequence given in SEQ ID NO 50265
  misc_feature: Useful for making plants with modulated drought sensitivity
  misc_feature: Functional homolog of the protein sequence given in SEQ ID NO 51141
  misc_feature: Useful for making plants with modulated biotic stress sensitivity
  misc_feature: Functional homolog of the protein sequence given in SEQ ID NO 50301
  misc_feature: Useful for making plants with modulated heat sensitivity
  misc_feature: Functional homolog of the protein sequence given in SEQ ID NO 51140
  misc_feature: Useful for making plants with altered carbohydrate content
  misc_feature: Functional homolog of the protein sequence given in SEQ ID NO 50524
  misc_feature: Useful for making plants with modulated nitrogen use efficiency
GIAKCVPAAKSHASTYVLGTIGYIDPEYARTSRLNEKSDVYSFGIVLLELLT

SEQ ID NO: 33989 - DNA, 590 bp, Panicum virgatum
  misc_feature: Ceres CLONE 1954768
  misc_feature: Encodes the peptide sequence at SEQ ID NO. 33990
aaactgaacgaagaactcttcccttccattgccgtctcgactcgcgacgagcttggcctccaaaccccgtcctgcctgagcctcccctccgctagggttttccccgccatctcgtgtggaccaagtagcgcgcggcgcaaggaggaggagcgcgcccgccatggcgtcgaccaaggtgcagcggattatgacccagcccatcaacctcatcttccgcttcctccagagcaaggcgcgcatccagatctggctcttcgagcagaaggacctgcggattgaaggcaggatcatcggatttgatgaatacatgaatttggtattggatgatgctgaggagatcaacgtcaagaaaagcaccaggaaatctctgggccgcattctcttaaaaggagacaatatcacgctaatgatgaacacggggaagtagcgtcagttcacagcgcatctgattgcaaggaccagtagttatcttggaatgtgaaatttgaggctgtagtggatttatcatccccctttgtgctcatctaaacctgattgcaatatatcttctcagccaggaatgatggattttgagaagtgtagtgttgtcc

SEQ ID NO: 33990 - protein, 88 aa, Panicum virgatum
  misc_feature: Ceres CLONE 1954768
  misc_feature (19)..(85): Pfam Name: LSM Pfam Description: LSM domain
MASTKVQRIMTQPINLIFRFLQSKARIQIWLFEQKDLRIEGRIIGFDEYMNLVLDDAEEINVKKSTRKSLGRILLKGDNITLMMNTGK

SEQ ID NO: 33991 - DNA, 644 bp, Panicum virgatum
  misc_feature: Ceres CLONE 1954786
  misc_feature: Encodes the peptide sequence at SEQ ID NO. 33992
atcttccctgcttccctccatcgccactccaagagctcccaatcgtcacgccatggccagcatggtcaccaccatggctgccatagcagctttctcggccccaagaagcctccagcaggccccggccccgttgcagctccgcccgaacgccgtgtcgttcgtcgcacacccggttcgcgcgcaccgccggctggtggccgtggcggccagctcgccgcccacgccgccggacctcgccaacaaggtgtccgagagcatcaagcaggcgcaggagacgtgcgcggacgacccggtgagcggcgagtgcgtggcggcgtgggacgaggtggaggagctcagcgcggccgccagccacgcgcgggaccggcagaagggcgccgacccgctcgaggagttctgcaaggacaaccccgagaccgacgagtgccgcatgtatgaggactgagccgcgcgaggctgctcgtcgtgccatccgccgtcgccgtcagcctgtcacctgatctagctggcttaactagagtggcatgacggcaacatgcgtcatgcgtgaatgtatgatggacctgctccttcgtctccttgggcgtttgagtttggtttcttagtttcatctggcttggtttgcaataaagcgaggtttgtcc

SEQ ID NO: 33992 - protein, 130 aa, Panicum virgatum
  misc_feature: Ceres CLONE 1954786
  misc_feature (61)..(130): Pfam Name: CP12 Pfam Description: CP12 domain
  misc_feature: SWISSPROT Homolog: EC 1.2.1.13 Glyceraldehyde-3-phosphate dehydrogenase (NADP(+)) (phosphorylating)
MASMVTTMAAIAAFSAPRSLQQAPAPLQLRPNAVSFVAHPVRAHRRLVAVAASSPPTPPDLANKVSESIKQAQETCADDPVSGECVAAWDEVEELSAAASHARDRQKGADPLEEFCKDNPETDECRMYED

SEQ ID NO: 33993 - DNA, 504 bp, Panicum virgatum
  misc_feature: Ceres CLONE 1954791
  misc_feature: Encodes the peptide sequence at SEQ ID NO. 33994
aaaatctctctttccccatctttccccgcaggccccgtgctccttccccagagagagagagagagcgaaaccctagctcgcggctcgccggatggaccctcagcagccggaaccggtcagctacctctgcggagattgtggagccgagaacacgctgaagccgggcgatgtgatccagtgccgcgagtgcggctaccgcatcctctacaagaagcggacccgccgaattgtccaatatgaagcgcgctgaagaaaagggggcaacatcctgtgctgttggcggtgcctcaagcagtgtaacaggccgcctgggagaaggaatgactagtggtgattcgtatggtaagtcgtgtgtactaggttgtaaccgtgcactggactgcacctggaagcgttgaaacactctgaaatatggatggatgtcagacacttcacaagtattgaaatagcttatgatttgctgggaacctaaatacccaataagatggggggtcgtttgcgtct

SEQ ID NO: 33994 - protein, 52 aa, Panicum virgatum; identical to SEQ ID NO: 17825
  misc_feature: Ceres CLONE 1954791
  misc_feature (11)..(42): Pfam Name: DNA_RNApol_7kD Pfam Description: DNA directed RNA polymerase, 7 kDa subunit

SEQ ID NO: 33995 - DNA, 464 bp, Panicum virgatum
  misc_feature: Ceres CLONE 1954795
  misc_feature: Encodes the peptide sequence at SEQ ID NO. 33996
cccgaaaccctaacattcctcacgctgcgccgccgacggtgattaggagcaggagccagaagagggatctgcgatggccaagtcaaagaaccacacggcgcacaaccagtcgtacaaggcgcacaagaacggcatcaagaagcccaagcgccaccgtcagacctccactaacgggatggacccaaagttcctgaggaacctgaggtactcgaggaagaacaacaagaagagtggtgaggctgaggctgagtaaactggtggaatttcagatgatgaattcctgtcttgtatcgctaggatcttgaacttaatgctctgttctgtatgaccaaaggagattcctcagttggtaccatttttttttttgtcttgctgtctggctggatttgaattaaaaccgtcatttgcagccttatgagaattgggaacccgagtatgtcgttctaatttctgtggtatctatc

SEQ ID NO: 33996 - protein, 59 aa, Panicum virgatum
  misc_feature: Ceres CLONE 1954795
  misc_feature (3)..(42): Pfam Name: Ribosomal_L29e Pfam Description: Ribosomal L29e protein family
MAKSKNHTAHNQSYKAHKNGIKKPKRHRQTSTNGMDPKFLRNLRYSRKNNKKSGEAEAE

SEQ ID NO: 33997 - DNA, 687 bp, Panicum virgatum
  misc_feature: Ceres CLONE 1954802
  misc_feature: Encodes the peptide sequence at SEQ ID NO. 33998
actgcaggtcgtagtagaaaccatgccgactctgcattccaagctcatcctgctgcagctgcagctgctgctccacctcaccacattcaggctgctgcccgcgtcttcctcctcgctcatcggcgagtacggtgaccatggagcactgctggcattcaaggcggcgctgtcagacgtctcgggctcgctgagctcatggaacggcagcagctccgacttgtgccgctgggcaggagtgacgtgcagccgccggcatccaggcagggtggtttctctgagaatgcccggcagcaatctggcaggcaccatctcccctgccatcggcaacctcacatttctccggcggctcgatctcttcgacaacatgctctcaggggagataccgcacaccatcagcaggctacaccgtctgcgctctcttcatctgtcgaacaactctctagccggtgagatcccggtaggcctgtccaactgttccaaccttttgcacctgagtgtaccggtcaacaagcttcgtggcagaattcctagtggtctggggtcactgactcagctgcaattcctctttattagtgacaatgatctcctaggtcgtgaaccgccatcactcggtaacctctccgtgcttgaaatactaacactcaataaaacaagcttggatggaaccatcccaaaaacccttttcca

SEQ ID NO: 33998 - protein, 221 aa, Panicum virgatum
  misc_feature: Ceres CLONE 1954802
  misc_feature (35)..(75): Pfam Name: LRRNT_2 Pfam Description: Leucine rich repeat N-terminal domain
  misc_feature: SWISSPROT Homolog: EC 2.7.11.1 Non-specific serine/threonine protein kinase
MPTLHSKLILLQLQLLLHLTTFRLLPASSSSLIGEYGDHGALLAFKAALSDVSGSLSSWNGSSSDLCRWAGVTCSRRHPGRVVSLRMPGSNLAGTISPAIGNLTFLRRLDLFDNMLSGEIPHTISRLHRLRSLHLSNNSLAGEIPVGLSNCSNLLHLSVPVNKLRGRIPSGLGSLTQLQFLFISDNDLLGREPPSLGNLSVLEILTLNKTSLDGTIPKTLF

SEQ ID NO: 33999 - DNA, 621 bp, Panicum virgatum
  misc_feature: Ceres CLONE 1954802-R
  misc_feature: Encodes the peptide sequence at SEQ ID NO. 34000
attacagagggaatgacttccgagctctagtgtttgacttcatgcccaggtacagtttggacaggtggctgcgaccaagaagcgatgagcagatgcataagttaagtcttacccagctgttgaacattgcgattgatgtagcggatgcactagactatcttcacaacagtagttgcccaacagtggtgcattgtgatttgaagcctagcaacatcctccttggtagtgattggactgctcatgttgctgactttgggcttgcaaagctggttggtgaatccattgatcaaagcaactttaatgctgggactgaaagcaccattgggataagaggaaccattggatatgttgctccagaatacggagcaggtggtcaagcatcagttgaaggcgatgcctacagctttggtgttactctgcttgaaatgttcacagggatggcaccgactgatgatatgttcatagaaggcttgaccctgcacttgcttgttgaggcagggttacctgagaagataccagaaatcattgacccagaactattgcataatgaactgtatgacaatgatgtggggatactcaattgctttgcttcagtactaggagttggcatctcatgctcag

SEQ ID NO: 34000 - protein, 206 aa, Panicum virgatum
  misc_feature: Ceres CLONE 1954802-R
  misc_feature (1)..(184): Pfam Name: Pkinase_Tyr Pfam Description: Protein tyrosine kinase
  misc_feature: SWISSPROT Homolog: EC 2.7.11.1 Non-specific serine/threonine protein kinase
YRGNDFRALVFDFMPRYSLDRWLRPRSDEQMHKLSLTQLLNIAIDVADALDYLHNSSCPTVVHCDLKPSNILLGSDWTAHVADFGLAKLVGESIDQSNFNAGTESTIGIRGTIGYVAPEYGAGGQASVEGDAYSFGVTLLEMFTGMAPTDDMFIEGLTLHLLVEAGLPEKIPEIIDPELLHNELYDNDVGILNCFASVLGVGISCS

SEQ ID NO: 34001 - DNA, 414 bp, Panicum virgatum
  misc_feature: Ceres CLONE 1954809
  misc_feature: Encodes the peptide sequence at SEQ ID NO. 34002
gcatcagcctgcccgcagctggcgctgagcaacacgactcgggagcaccagagctagctagcccgccgcgccgcccgaccgggacgatccaggccggcgtcgctgctgtccgagagaccgtcgaggtcgatcgtcggagagggagagcccggctagctatgtcgtcggggatggagacggccggcggcggcttcgaggacgcgtacggcgaggaccgcgccaccgaggagcagctcatcacgccgtgggcattctccgtcgccagcggctacaccctgctgcgcgacccgcggcacaacaagggcttggccttctcggaggcggagcgcgacgcgcactacctgcgcggtctgctccccccggtgctggcgtcgcaggagctccaggaaaaaaaagatgattcactttctgcgc

SEQ ID NO: 34002 - protein, 85 aa, Panicum virgatum
  misc_feature: Ceres CLONE 1954809
  misc_feature: SWISSPROT Homolog: EC 1.1.1.40 Malate dehydrogenase (oxaloacetate-decarboxylating) (NADP(+))
MSSGMETAGGGFEDAYGEDRATEEQLITPWAFSVASGYTLLRDPRHNKGLAFSEAERDAHYLRGLLPPVLASQELQEKKDDSLSA

SEQ ID NO: 34003 - DNA, 625 bp, Panicum virgatum
  misc_feature: Ceres CLONE 1954809-R
  misc_feature: Encodes the peptide sequence at SEQ ID NO. 34004
acttcttcccggggttcggcctcggcgtggtcatctccggcgccatccgcgtccacgacgacatgctgctggccgcgtcggaggcgctggcggagcaggtcaccgacgagcacttcgccaaggggctcatcttcccgcccttcaccaacatccgcaccatctcggctcgcatcgccgccaaggtggccgccaaggcctacgagctcggcctcgccagccgcctgccccgccccgacgacctcgtcaagtacgcccagagctgcatgtacaccccaacctaccgcaactaccggtaagcaccgttgccggcggccgaggagggaagaggggcaccatttttgctgcagggtcgtcgtgagtgagtgaataaatttgttcagctggagcttgctgctgctgctagaggagttttaaactttgttttgtactgtacttctgtgtatcgtatacggcataccacaccattacaggtcgtcagtcatttttttttttcactttgttatatagtggtcaatcacgggtgtgtttttcgttcgttcttctgacaaatttgttgagtctttatactactatatacttaaaaccagtgtaatgctagagagatacatttgatttggttggtgcc

SEQ ID NO: 34004 - protein, 97 aa, Panicum virgatum
  misc_feature: Ceres CLONE 1954809-R
  misc_feature: SWISSPROT Homolog: EC 1.1.1.40 Malate dehydrogenase (oxaloacetate-decarboxylating) (NADP(+))
FFPGFGLGVVISGAIRVHDDMLLAASEALAEQVTDEHFAKGLIFPPFTNIRTISARIAAKVAAKAYELGLASRLPRPDDLVKYAQSCMYTPTYRNYR

SEQ ID NO: 34005 - DNA, 499 bp, Panicum virgatum
  misc_feature: Ceres CLONE 1954816
  misc_feature: Encodes the peptide sequence at SEQ ID NO. 34006
cggtgaatttacgctatggaatggacaatcttttaacttcgaaatgatacttcaggctcatgatcaacccgtgagatcaatggtttggagtaacaatgaaaattggatggttactggtgatgatggtggtgcaattaaatattggcaaagtaacatgaacaatgtcaaagtgaataaaacagcccatagagaatcagttcgtggtttaagcttttcaagaacagacttgaagttctgctcctgctccgatgacagaaccgttaaggtttgggattttgcgagatgccaggaggaaaaatcattaactggccacggttgggatgttaaaagtgtcgattggcatcctacaaagtctttactagtatcaggtggtaaagactatcttgtgaaactttgggatgcaagaagtggtagagagctaaattcattccatggtcacaaaaatattgtacattgtgtaaagtggaatcagaatggaaactgggtactgacggcctca

SEQ ID NO: 34006 - protein, 165 aa, Panicum virgatum
  misc_feature: Ceres CLONE 1954816
  misc_feature (95)..(133): Pfam Name: WD40 Pfam Description: WD domain, G-beta repeat
  misc_feature (53)..(91): Pfam Name: WD40 Pfam Description: WD domain, G-beta repeat
  misc_feature (11)..(49): Pfam Name: WD40 Pfam Description: WD domain, G-beta repeat
  misc_feature: SWISSPROT Homolog: EC 2.3.1.48 Histone acetyltransferase
  misc_feature: Functional homolog of the protein sequence given in SEQ ID NO 51449
  misc_feature: Useful for making plants with modulated flowering time
GEFTLWNGQSFNFEMILQAHDQPVRSMVWSNNENWMVTGDDGGAIKYWQSNMNNVKVNKTAHRESVRGLSFSRTDLKFCSCSDDRTVKVWDFARCQEEKSLTGHGWDVKSVDWHPTKSLLVSGGKDYLVKLWDARSGRELNSFHGHKNIVHCVKWNQNGNWVLTA

SEQ ID NO: 34007 - DNA, 418 bp, Panicum virgatum
  misc_feature: Ceres CLONE 1954816-R
gtttaagctcttaccagggattgctgcagggaatgggcaatgttggccttacaccacccccgccgccaccacagcacccgccgcctcgaggttcaacaccacagtgacctggaacaaagtgatgctgataatgagcctagagttttgtgctgacacctgaatttgtaacatcttgagcaatatctgtatgtctaggccctccttcaaattcaaacgaattttgtctggcagctaggatgtttgctatttgtgctgagatttacagagccttctgctcagttcaagggccgagttgcactggacatgttcgcctaggcgcctaatgacccgtctggtgtcttgtatttatattgtattttgtattgtgttattgcttgacgactgcttaaatgtgaaatgcagttttgaggagacattt

SEQ ID NO: 34008 - DNA, 1228 bp, Panicum virgatum
  misc_feature: Ceres CLONE 1954834
  misc_feature: Encodes the peptide sequence at SEQ ID NO. 34009
gggggctctctatccctcagatggggagcacggcctgctggcctcccactggcctcccttgttctcctctgtcctctcagtctcagatgcggcgagagtgagcgcgagcgcgacagctagttggctatctgagcctcctcgccctcgccggctccccgtggcatcccgtgtcctcagctagctctccgcggggagggaaccgagagcgacggggctcttggattggatcccctcgagacccgggagtcaggacaagcagatagtcgtcgctcggtagatagagcatagccactctcagtctcactcactccccccgcggcggcatggagaaggagaagaggaggagctggttcgagcgcatcaggcggctcttcatctcctcctccgagcccaaggagaaacccaaacctgacaagaaggcgaagagcaagcgctggctgccggggaagctgaggacgcagcagtcgttcgcgctgccggcgccggcgccggaccagcagatcaggcaggcggaggacgagcagagcaagcacgccgtggccgtcgccctcgccaccgcggcggccgccgaggccgcggtcgccgccgcgcacgccgccgccgaggtcgtccgcctcaccggccagcagcccgcgaccccgccgcccgggcaggagccggaggaggaggcggagcatgccgccgtcctgatccaatcggcgtaccgcgggtacctggctcggcgggcgctgcgcgcgctcaagggcctggtgcggctgcaggcgctgatccgggggcaggcggtgcggcgccagacggcggccacgctgcgcggcctcgagtccctgatgaggatccaggcccggcaccgctccagggccggcggccccgaccacccagcggcgctcgacggcaacgacgacgacgacgccttcctgctccgccgcggccgggagctctacgccgccgcggtccacgaacagcagcagcaggcgggcaacaaggggtgggacagcagcatcctctccaaggaggagatgcgcgccgtgacgcggagccgggaggaggccgccctcaagcgcgtgcgcgcgctccagtacgcctccctgcagagcgagcggctgggcgtgcggcggccgccgctgcccagggacgaggaggcggcggacgcgctccaccggcgctggagctggctcgaggagtgggtcggcgcgcagccccccttcgacaaggacgtccccgtggcgca

SEQ ID NO: 34009 - protein, 301 aa, Panicum virgatum
  misc_feature: Ceres CLONE 1954834
  misc_feature (117)..(137): Pfam Name: IQ Pfam Description: IQ calmodulin-binding motif
MEKEKRRSWFERIRRLFISSSEPKEKPKPDKKAKSKRWLPGKLRTQQSFALPAPAPDQQIRQAEDEQSKHAVAVALATAAAAEAAVAAAHAAAEVVRLTGQQPATPPPGQEPEEEAEHAAVLIQSAYRGYLARRALRALKGLVRLQALIRGQAVRRQTAATLRGLESLMRIQARHRSRAGGPDHPAALDGNDDDDAFLLRRGRELYAAAVHEQQQQAGNKGWDSSILSKEEMRAVTRSREEAALKRVRALQYASLQSERLGVRRPPLPRDEEAADALHRRWSWLEEWVGAQPPFDKDVPVA

SEQ ID NO: 34010 - DNA, 388 bp, Panicum virgatum
  misc_feature: Ceres CLONE 1954834-R
  misc_feature (191)..(191): n is a, c, t, g, unknown, or other
cgtgccgtgctcgccggcgccgttcctggggttcggggcgtccgcggcgtccgccggggccctgttccggtccttgtgcccgcccggggggcgctccgccggcgcggtcgccttgtccgggcgctgcttcctgttcgccgcccgcttgctctcgccgttcccgtccttgtcgcccttcccctccttcgccngcgccttgggcttcgccaggtccaccaggccgcccgccgcccagaggtcgccgcgggtggcggccaagggccccaagacgccggcgcggccgcgcccgcggaggccgccgagccaccacagcaccggccccgaggccgcgcggcaccagcggcagagggagcacaacaccccagcccggggagcaggacaacagaaa

SEQ ID NO: 34011 - DNA, 557 bp, Panicum virgatum
  misc_feature: Ceres CLONE 1954873
  misc_feature: Encodes the peptide sequence at SEQ ID NO. 34012
tttccctccacaatcgcgcggtttccccctcccgccgcacaagcgcaacccaccccgcgccatggccgcctcctcttccgcccccgcgcccgcgcccgcccccgccgacacctacgatatcccatgggtggagaagtaccgccctacccgcgtggcggacgttgtcggcaactccgacgccgtcgcccgcctggaggtcatcgcccgcgacggcaacatgcccaacctcatcctctcggggcctccggggactgggaagactacgagcattctggcgctggcccacgagctgctcgggcccagctaccgcgaggccgtgctcgagctcaacgcctcggacgatagggggctggatgtggtgcggaacaagatcaagatggtcgcgcagaagaaggtcactctgcagccagggcggcacaagattgtgatcttggatgaggctgacagcatgacatcaggagcacagcaagctctgcgaagaacaatggagatctattccaacaccactagatttgcacttgcatgcaacacctcatctaagataatcgaacccattc

SEQ ID NO: 34012 - protein, 165 aa, Panicum virgatum
  misc_feature: Ceres CLONE 1954873
  misc_feature: SWISSPROT Homolog: EC 2.7.7.7 DNA-directed DNA polymerase
MAASSSAPAPAPAPADTYDIPWVEKYRPTRVADVVGNSDAVARLEVIARDGNMPNLILSGPPGTGKTTSILALAHELLGPSYREAVLELNASDDRGLDVVRNKIKMVAQKKVTLQPGRHKIVILDEADSMTSGAQQALRRTMEIYSNTTRFALACNTSSKIIEPI

SEQ ID NO: 34013 - DNA, 656 bp, Panicum virgatum
  misc_feature: Ceres CLONE 1954873-R
  misc_feature: Encodes the peptide sequence at SEQ ID NO. 34014
ggcttgaagccatcatatttactgctgatggtgacatgagacaagctttgaacaacctgcaagctacatttagtggtttccgctttgttaatcaagaaaatgtgttcaaggtatgcgatcaaccacatcccttacatgtcaagaacatggtgaaaaatgtgcttgatggaaagtttgacgaggcctgctctgcactgaagcaactttatgatttgggatactcgcctactgacattatcactactctcttccgagttgtcaagaactatgacatggctgaatatctgaagctggaaatgctcaaggaaacaggatttgcacacatgagaatctgcgatggtgttgggtcattccttcagctttctggcctacttgcaaagtttgcgctggtgagagaaactgcaaaggctccctgaacaaatcatgttgccggtggtaatagcatatgtcccctgaacaaatcatgttgccggtggtaatagcatatgtcgagttgtgctgacatggtaatctagttatttctgttaacactactggcgagcatgtcttgtgactacagccgtcgtgtatctcagtctgtaagatagtaccttacgaagtgaacaactaccattctatcatgcctattccagtgtgaaacatttagctgaggctcc

SEQ ID NO: 34014 - protein, 137 aa, Panicum virgatum
  misc_feature: Ceres CLONE 1954873-R
  misc_feature (39)..(127): Pfam Name: Rep_fac_C Pfam Description: Replication factor C
LEAIIFTADGDMRQALNNLQATFSGFRFVNQENVFKVCDQPHPLHVKNMVKNVLDGKFDEACSALKQLYDLGYSPTDIITTLFRVVKNYDMAEYLKLEMLKETGFAHMRICDGVGSFLQLSGLLAKFALVRETAKAP

SEQ ID NO: 34015 - DNA, 630 bp, Panicum virgatum
  misc_feature: Ceres CLONE 1954880-R
  misc_feature: Encodes the peptide sequence at SEQ ID NO. 34016
ttgttttccacagtgtggatcaaattaggcttcaggggctactcttccagatggcagataagctctcagtcctggtggagagcaatgagagggcatacgaggcaagaactggtggtactcttgagggggtaccacccaggcgcaggggcgacggacaggaatctaatatggggaagtggcaggacaactttgtatcctcacaagggaggcagggaggtggcaaccggtctggatatgctggcagaggtggaggtggccatggtggtggataccagagggacaggggaaaccagggttcccgtggggactatagcggcggctcacggtttcaggatggaaggggtcgcaaccagtctggttcctcagggagaggtggtgatggtggtgcacggatggtgagccttaacagggctggtagagtttaggtgcgataaatttgagcctgaaggtcttccatcaaggtctccacttttgaagcgctgctttttccataatttagaaccttgcagttttaaactcgggttatttgctatattttgctgtagccttttgattcaagtccctgtcacaatctaagacttggtactttgatttgtgtcatgagagtgagggctatgtattcgttcccac

SEQ ID NO: 34016 - protein, 140 aa, Panicum virgatum
  misc_feature: Ceres CLONE 1954880-R
  misc_feature (5)..(140): Pfam Name: eIF-3c_C Pfam Description: Eukaryotic translation initiation factor 3 subunit 8 C-terminus (eIF3c_C)
VFHSVDQIRLQGLLFQMADKLSVLVESNERAYEARTGGTLEGVPPRRRGDGQESNMGKWQDNFVSSQGRQGGGNRSGYAGRGGGGHGGGYQRDRGNQGSRGDYSGGSRFQDGRGRNQSGSSGRGGDGGARMVSLNRAGRV

SEQ ID NO: 34017 - DNA, 530 bp, Panicum virgatum
  misc_feature: Ceres CLONE 1954880
gacgccactcgaacccaaccacctagggtttcttccctatcctcagtctcaaccacgcgccgccgccgcctccgacgcacccgaactccagagcttgagccaagtcgaagcaaaagcagcagcagcaaccatgcaggcatcacgtttctggggacagggggacagtgaatctgaggaggaggaggaagaagtcgaatcagaagagggtagtgatagtgaagatgatgtagctccaggtcctggggggcgtggaatccaaaaccgctatttgaagacccaagaagatgatagtgatgagtctgattctggccaccgcgtgattcgctctttgaaggacaagcgcaatgaggagatgagatctattgttgatcagatgcgtaatgctatgaagatcaatgactgggttagcctgcaggagagctttgagaagctcaacaaacatcttgagaaggttgtacgtgtcaatgaatcaactgagattccaaagatgtatatcaaggcacttgtattattggaggacttccttgctg

SEQ ID NO: 34018 - DNA, 663 bp, Panicum virgatum
  misc_feature: Ceres CLONE 1954889-R
  misc_feature: Encodes the peptide sequence at SEQ ID NO. 34019
cctccactgccctttctgcaacacgacaatcagtttctgagccaagttctgaaccttcagagaccactgttgcggcatctccaagagaaagacaaaaggagaaaagccaagatgttactgatggtgaggctgattcttctgaagcaccacccagggatgaagttgtcaagcctatgatcagcattaatcttcagccagagcagtcagttgtccaacaggacatagttgacatgtacatgaagagcatgcaacagttcactgaatccattgcaaaaatgaagcttccgttggatgttgagaatagtagtccctctaatgatgtctctgactccagtacaattgagaagccatccccatccccatcatcatccgtgtcaaagggttctagggtcttttatggaagcagggccttcttttaagtttctggtgcaaagtagcgctagctcatctcctatatatatggttcaggtttgttaggtattggctagcatgtattgacatacttttctgtcgccgcaatatactgctaggactcactcttggtattgttcatagtgttgtgctttgttaaaaaagaacaataatttcagaataatgtcctctcagagttgtagattgatcctatgtactaatatgtgtcgatgaatatagtaatgataatgg

SEQ ID NO: 34019 - protein, 138 aa, Panicum virgatum
  misc_feature: Ceres CLONE 1954889-R
  misc_feature: Functional homolog of the protein sequence given in SEQ ID NO 50930
  misc_feature: Useful for making plants with modulated biomass
STALSATRQSVSEPSSEPSETTVAASPRERQKEKSQDVTDGEADSSEAPPRDEVVKPMISINLQPEQSVVQQDIVDMYMKSMQQFTESIAKMKLPLDVENSSPSNDVSDSSTIEKPSPSPSSSVSKGSRVFYGSRAFF

SEQ ID NO: 34020 - DNA, 647 bp, Panicum virgatum
  misc_feature: Ceres CLONE 1954889
ctcgcgactcgcgcacccaacagcgaacacttccccaccaaatcctgcaacagccggtacctctgttcacccccgtcaatccctcggcgaagaaggtaattaccgccattctcccagttatattttgcactacggagttgctaatcgctcaagtttgacactagtatctgttccgagcccagacgattcctcacgccccgcgttagttaccactgtgtgttctgatttgggggttctggatctcctcctgcctgtttagccaaatccccaaatttctccaacaagttgcgttaggaggattccttccgttacagatagggtttttgataagcgcaggaggtcaagaatctctgttctttgttggctgaatcgagtattaattccaatatatctgcctagctattcgtatcccacgccaatgttgttgctgccatttcgcgttcacgctttgccggcgaattatcaaattatgcctttgattcgagtattggctaggcagttggttcctgatggatataccaattaccaaatgcaatcactttctgtgcttctataaaagtttcaaatcgtccgggctcttgctgttgcgctggatattaattctgtttggtccccagtttgttcctcacatgctcgtactgtttccg

SEQ ID NO: 34021 - DNA, 474 bp, Panicum virgatum
  misc_feature: Ceres CLONE 1954903
  misc_feature: Encodes the peptide sequence at SEQ ID NO. 34022
tttggctcgatagatgcagatcctcctgctgcaatgcgatacacagagtgccgcttggatccactatcagaagccatgttcttgactgatctggagctgaatacagttgatttcgtacccaactttgataactcacagaaggagccatctctgctgccagctcgtgttccatctctattgttgaatggttcttctgggattgcggtcggaatggcaacaaacattcctcctcataatctgggggagcttgttgatgcactttctgttataattcaaaaccctgaatccacactccaagaactactggaatgcatgcctggtcctgacttccctacaggagggataatcctaggaaatcaaggtattttggaatcctataaatctggacgtggcccaattgttgtgagatgaaacactgacatactaacccattgatgaataaagcaataccctcatctttaatccttaatgaaa

SEQ ID NO: 34022 - protein, 136 aa, Panicum virgatum
  misc_feature: Ceres CLONE 1954903
  misc_feature (1)..(136): Pfam Name: DNA_topoisoIV Pfam Description: DNA gyrase/topoisomerase IV, subunit A
  misc_feature: SWISSPROT Homolog: EC 5.99.1.3 DNA topoisomerase (ATP-hydrolyzing)
FGSIDADPPAAMRYTECRLDPLSEAMFLTDLELNTVDFVPNFDNSQKEPSLLPARVPSLLLNGSSGIAVGMATNIPPHNLGELVDALSVIIQNPESTLQELLECMPGPDFPTGGIILGNQGILESYKSGRGPIVVR

SEQ ID NO: 34023 - DNA, 582 bp, Panicum virgatum
  misc_feature: Ceres CLONE 1954903-R
  misc_feature: Encodes the peptide sequence at SEQ ID NO. 34024
ttgggaaacgggtgcccttaaatgcattccggcaatcaagattcaacgttgtaggtttggtaggctacaagcttccagcagattgtcgcttagccgctgtatttgttgctggtctttcactcggtgatgatggtgaaagtgatgagcaggttgttttagttagccagagcggcactgtaaacagaatcaaggttaaagatatatccatccagtctcgttatgcgaggggagtaattctgatgaggctggagcatgctggaaagacacagtcagcttcactgatatctgcagcggcagcagaagtcgctgaagattaatcttgctcccaagaggcaagtagttagtctaaagttaaagccctgggtgtgcaccgcatggcaatacattgagcatgcatttgaggttaatcctgtcaccagtaggattcagtgatttagttcccacgccaaaggctggcgcagttagtagctgatgatttggtggatagatctcctgtggccattaacctgtcaagagatgtaggttttgtcaacacagtattcatgcgatgtgtggtggatgtaaaatggcacgttggcttgc

SEQ ID NO: 34024 - protein, 104 aa, Panicum virgatum
  misc_feature: Ceres CLONE 1954903-R
  misc_feature (47)..(96): Pfam Name: DNA_gyraseA_C Pfam Description: DNA gyrase C-terminal domain, beta-propeller
  misc_feature: SWISSPROT Homolog: EC 5.99.1.3 DNA topoisomerase (ATP-hydrolyzing)
GKRVPLNAFRQSRFNVVGLVGYKLPADCRLAAVFVAGLSLGDDGESDEQVVLVSQSGTVNRIKVKDISIQSRYARGVILMRLEHAGKTQSASLISAAAAEVAED

SEQ ID NO: 34025 - DNA, 635 bp, Panicum virgatum
  misc_feature: Ceres CLONE 1954904-R
  misc_feature: Encodes the peptide sequence at SEQ ID NO. 34026
aaggtgaagcgaataatgggccagccaatgcaaataacagtcaaggagctcctgcttccactggtgatgggcttctagacttcgatatgtacctttctgagatccagagtagccaaccctcaaaatctgaactggaacagtacctggatgaatcactcactccccgaatgcaggagttcgatattctgaactggtggaagcttaacacagtcaagtttccaaccctctctaaaatggcccgtgatatcttggctattccaatgtccatggtaagcagtggcaataccatattcactgctggaacaggaagtcacatgctcgatgactatagaagctctcttcgtcctgagattgtggaggcacttttctgtgcgaaagactggctccagtactcagcagctgccaaggatgcaccaagttctgcacttgtcaaggctgaagggtcggaggttcgatgtggtcacttcttccttgttgaaccatgaatatgtctctatcgtgagtgtagtaattgtaggcgtattgtaggctgagattgtgaactggttattatttagatatttgtcttgtagaggtgtaacttatttgtgtcgaactctgtttaactcgctattgtcatgtaatagcttttgttg

SEQ ID NO: 34026 - protein, 160 aa, Panicum virgatum
  misc_feature: Ceres CLONE 1954904-R
  misc_feature (43)..(128): Pfam Name: hATC Pfam Description: hAT family dimerisation domain
GEANNGPANANNSQGAPASTGDGLLDFDMYLSEIQSSQPSKSELEQYLDESLTPRMQEFDILNWWKLNTVKFPTLSKMARDILAIPMSMVSSGNTIFTAGTGSHMLDDYRSSLRPEIVEALFCAKDWLQYSAAAKDAPSSALVKAEGSEVRCGHFFLVEP

SEQ ID NO: 34027 - DNA, 606 bp, Panicum virgatum
  misc_feature: Ceres CLONE 1954904
acccactctctcgctcgccgtctccccccctcttctcctccccgtctccctcccccaccaaccaaagatctagctagggtttgcgcgctcggccttcgtccttcttgggccgagccttaatcctgctgcaccgcccgccggtccgccaaaagcctccggtctggtggatcgcctcctcgcccgcccctccgctgcgcccgcgcccctccctctctctgctcctccgcgtacgcattcttgggttccatcgacaacaaagaagatctaagacacctgctcgcagctcggcctagctagtccggactccggatctcaaccaccacctaccatatcctattttacgggttcaactgctagcttatcagcatggctgaggaaaccaccaatgacactcaggtggcccaagaaaatgaggttgctcccaatgatgaggcggtccaagcagatgaattggtccaagctgaagatatggctcaagctgatgagttgatacaaggcgaagaaatcaatcaaggtgatgagttgactcatggtgacgatttcatgcaaggaaatgagttggtcgttgctgaggaaacgacccctcggactggaaccagacggagg

SEQ ID NO: 34028 - DNA, 566 bp, Panicum virgatum
  misc_feature: Ceres CLONE 1954923-R
  misc_feature: Encodes the peptide sequence at SEQ ID NO. 34029
cgcaattctgtgacaaaggccagttccatgacattgttatcgagtgcgataccgtcggcctgaaggatccatgtctcgatataagggttgataagaagcccgtgatgcaggtgaagcgcctggcatggaaatttaggggaaatcagacaattctcgttgatggtttgcctgtggaggttttctgggatgtccacagttggctctttggatcgacggcaagcaatgcagtgttcatgtttcagacatgccaggcacctgagaagtcgctgccatggtcatactcgcagatctttagggagtcccagttgcaaggtcttggtttctcgttgatcctgcatgcatggaagcttgaataggtttttgcaggatcacaatttgcttctgcacctgcctccttttctttagtgctaacagaagatgttttgttgaagtgtctgttcatcagaatgctatggaggctctccaatatatgttctttcatttcactttgtttttgttttgccatcttttataaactctttgtttgaatgattggcaagattatgtgatatcccagtgactttggc

SEQ ID NO: 34029 - protein, 117 aa, Panicum virgatum
  misc_feature: Ceres CLONE 1954923-R
  misc_feature: Functional homolog of the protein sequence given in SEQ ID NO 50707
  misc_feature: Useful for making plants with modulated nitrogen use efficiency
QFCDKGQFHDIVIECDTVGLKDPCLDIRVDKKPVMQVKRLAWKFRGNQTILVDGLPVEVFWDVHSWLFGSTASNAVFMFQTCQAPEKSLPWSYSQIFRESQLQGLGFSLILHAWKLE

SEQ ID NO: 34030 - DNA, 369 bp, Panicum virgatum
  misc_feature: Ceres CLONE 1954923
aaccttttgtctccttcctcacgaaccacctccaccccttcccccagctcctcccactacttcttgtgagttccttgccgctgcggccgcttgcttccctcatctctagtctgtacactggttggagtggttgctacttgctagtgttcgagttcgacccacttgctcctctcaatcccctctcccatggatgtgcatacatcctctggtggttgcttgcttcttctggctcgaagttgaaggccttcgcctcgcctgggggaaagcttccgtttcgcgttccgttcctggtgccgctgctgtggcataaaggcggaagcctgagccatcttttgaagaaatcccggcggaagattgctccgtcgctgc

SEQ ID NO: 34031 - DNA, 1740 bp, Panicum virgatum
  misc_feature: Ceres CLONE 1954942
  misc_feature: Encodes the peptide sequence at SEQ ID NO. 34032
aatctccggcccaactagagagggaaaaagagtcgaccacggcggacggcggcgagggtttaacccaggtcgaagccgccgccgccgacgagggcggagacttggaaagcacgcacacccgcggccccagagaagccgcgcgaatctctcccagagaagcggcggcggcggaggagatgcttctcgaggagctgctccgctgccagatccacgagtggtacccggccttccgccgccactccatccccaccgccatcatcccgctccccgccgccttcctccgctacctcgccggccgagcggcctaccccgacccggactccgggtccggcgccgacgaggagccgctcccgttcctcctccccgcggtgacctccggccgccagcccttcgcgcccgcccacgcccaccacccggacccggactccctcctcagctcggacctcttcttcggctccagcgccgaggacgtccacgaccccgacgccgaccacccgcaccgccccgagttcccggagctcaaggcggccgtcgacgccgccatcgcggacctcggcggcgccgcgctccccaagctcaactggagcgcgcccaaggacgccaccttcatgtccgcggacggcacggcccggtgcgcgtgcttcgccgaggtcgccatgctgctccgcgcctccgactgcgtggcccacgacctcgcctccgcgcgccagtcgtgcgaggattttgtgcgtccagagggtgctcgacggaatgcccggaaagttggtgctggtgccgaggaaggtgctgcatcaaatgctgtggattgtgatgcggaagatgcacgggaagaagatagtagtggggatgcttgggtggacgatgggttccaatactatctcgccctccgcaagtggtacccaggcctccgccctgagtcagagttcagatgcttcgtacgggagcggaagcttgttgctgtgtcccagagagatgcatcagcgtactacccatcactgcctggatggagttctgaggtgcaaccgaagattgaggttttctttgaggaagttattgagccacagtttggttcaaataattatacatttgatgtgtatgtgacaactgatgggcgagtcaagctgatagattttaacccatggggtggttatactttgccgctgctgtttacttgggaggagcttgaagcagaaggaagagagcatgagctggaatttagagtggtcatgcagcagggtgccgtgaggccaggattgatgacagcagtgccatatgatatgctggattgggggcaggggagtggctgggatgtttttttgaagaaggctgatgaagagctcaacagacagatgaactcaccagatggtgattcataattgcatttcaggaaaagatgtttggagtatgcagtatgtgcacaacttaaagtgatatctgctgattttcttaccagccacatgctagcagtcacgtgctttcttaagattgatatgcggtctgctctcctgccactatgctgttttttgtttccagttactcttatagcgctaggcagttagtgctgatcacctattatagccacatcgtgtcatgtattggttatcgagttataatctcccaacataactaatatgcagttcagtttagtgaagctgatggttagtacttgaatcttaagaaatgtatttgcagtgaaaatttgttgcctttctgctcagctgcaatgaatattcgtcatcg

SEQ ID NO: 34032 - protein, 399 aa, Panicum virgatum
  misc_feature: Ceres CLONE 1954942
  misc_feature (14)..(374): Pfam Name: D123 Pfam Description: D123
MLLEELLRCQIHEWYPAFRRHSIPTAIIPLPAAFLRYLAGRAAYPDPDSGSGADEEPLPFLLPAVTSGRQPFAPAHAHHPDPDSLLSSDLFFGSSAEDVHDPDADHPHRPEFPELKAAVDAAIADLGGAALPKLNWSAPKDATFMSADGTARCACFAEVAMLLRASDCVAHDLASARQSCEDFVRPEGARRNARKVGAGAEEGAASNAVDCDAEDAREEDSSGDAWVDDGFQYYLALRKWYPGLRPESEFRCFVRERKLVAVSQRDASAYYPSLPGWSSEVQPKIEVFFEEVIEPQFGSNNYTFDVYVTTDGRVKLIDFNPWGGYTLPLLFTWEELEAEGREHELEFRVVMQQGAVRPGLMTAVPYDMLDWGQGSGWDVFLKKADEELNRQMNSPDGDS

SEQ ID NO: 34033 - DNA, 593 bp, Panicum virgatum
  misc_feature: Ceres CLONE 1954944
  misc_feature: Encodes the peptide sequence at SEQ ID NO. 34034
aggacaacatgatggcggcggcgggggagcagaatgaggaggtggacgagctgctggccgcgctcgggtacaaggtgcgctcgtcggacatggcggacgtcgcgcagaagctggagcagctcgagatggccatggggatgggcggcgtgggcggcgccggcgccgccgccgatgacgggttcgtctcgcacctcgccacggacacagtgcactacaacccctccgacctgtcgtcctgggtcgagaacatgctgtccgagctcaacgcgcccccaccgccgctcccgccggctccgcggctcgcgtccacctcgtccaccgtcacgggtggcgccaccgccggtggagggtactttgatctcccgcccgccgtcgactcgtccagcagcacgtacgcgctcaagccgatcccctcgccggtggcggcgtcggcggacccgtcaacggactcgacgcgggagcccaagcggatgcggactggcggccgcaccaggagctccgcggtcgaggcggccccgccggcgacgcaagcgtccgcggcggccaacgcgcccgcggtgccggtggtggtggtggacacgcaggaggccggg

SEQ ID NO: 34034 - protein, 196 aa, Panicum virgatum
  misc_feature: Ceres CLONE 1954944
  misc_feature: The sequence is a functional homolog of SEQ ID NO 1 in US patent 7268272
DNMMAAAGEQNEEVDELLAALGYKVRSSDMADVAQKLEQLEMAMGMGGVGGAGAAADDGFVSHLATDTVHYNPSDLSSWVENMLSELNAPPPPLPPAPRLASTSSTVTGGATAGGGYFDLPPAVDSSSSTYALKPIPSPVAASADPSTDSTREPKRMRTGGRTRSSAVEAAPPATQASAAANAPAVPVVVVDTQEA

SEQ ID NO: 34035 - DNA, 648 bp, Panicum virgatum
  misc_feature: Ceres CLONE 1954944-R
  misc_feature: Encodes the peptide sequence at SEQ ID NO. 34036
ggccgcggccggcggcacggaccaggtcatgtccgaggtgtaccttggccggcagatctgcaacgtcgtggcgtgcgagggcgcggagcgcacggagcgccacgagacgctggggcagtggcgcaaccgcctgggccgcgcagggttcgagcccgtccacctgggctccaatgcctacaagcaggcgagcacgctgctggcgctgttcgccggcggcgacggatacagggtggaggagaaggacgggtgcctgaccctggggtggcacacgcgcccgctcatcgctacctcggcatggcgcctcgccgcgccgtgatcgggcgggtgcggtcttggacgctgatcaggatgcacgtccccgggcatggcgcaccccctccacccagctcgccggcacagctgaagctagacgtcaacgaacgctgaattgcagtgagcgaccgggccacggttcactccggcgtgatgagatggacactttgactccgaccggaccggcctgtgttcgttcttgttcccgatccccccctctcatcacctccctccaatcggtagcctattgttatgtttaaatgtctattattatgtgtaattcctccaatcgctcatatctcaatctcaataaggacgaaccggatttctttagcc

SEQ ID NO: 34036 - protein, 104 aa, Panicum virgatum
  misc_feature: Ceres CLONE 1954944-R
  misc_feature: The sequence is a functional homolog of SEQ ID NO 1 in US patent 7268272
  misc_feature: Functional homolog of the protein sequence given in SEQ ID NO 50894
  misc_feature: Useful for making plants with modulated biomass
  misc_feature: The sequence is a functional homolog of SEQ ID NO 218 in the 10/412,699 US patent application
  misc_feature: The sequence is a functional homolog of SEQ ID NO 2290 in the 10/374,780 US patent application
  misc_feature: The sequence is a functional homolog of SEQ ID NO 439 in the 11/479,226 US patent application
  misc_feature: The sequence is a functional homolog of SEQ ID NO 784 in the 10/225,066 US patent application
  misc_feature: The sequence is a functional homolog of SEQ ID NO 68 in the 10/666,642 US patent application
  misc_feature: The sequence is a functional homolog of SEQ ID NO 216 in the 10/412,699 US patent application
  misc_feature: The sequence is a functional homolog of SEQ ID NO 435 in the 11/479,226 US patent application
AAAGGTDQVMSEVYLGRQICNVVACEGAERTERHETLGQWRNRLGRAGFEPVHLGSNAYKQASTLLALFAGGDGYRVEEKDGCLTLGWHTRPLIATSAWRLAAP

SEQ ID NO: 34037 - DNA, 708 bp, Panicum virgatum
  misc_feature: Ceres CLONE 1954950
  misc_feature: Encodes the peptide sequence at SEQ ID NO. 34038
gagatttttgaaagtttgaaggccaggggaagcgcaaatgaattctcatacgcaatgatggtgtgtttgtacaagaaaattggtcgctacgatgtagctcacaggatttgccaggaaatgcaagctctaggacttctgactcaagcactaagctataattctgctatccaaatgtatgtgtctggtggaagaatggaggatgcttttaaaatatttaagatgatgttgatatcgaacacaccgccaaatgatgcaacattcaaggcactaaatgttattctagtaagaagtggaattacaaggaacgagattaggaagctagaattgctaagaagaaataacactcatgattgcttgcatcaatggtacaaggcactatccctttcccttcagctgtaagatcaagcgtgtgttcttttcaacatagtattatcgatcaatctgctacaagggcacacccttaccctttcgacattgacaattgtaggagtagaaaaaggagtacaagaaagcaagtaacttcataactgatttcaaatggttgaaatgttagatgtagatgcacaattgtgattatctgtctactgaactctatacagagaaggtgcataccatttttgagtaaaaaatgttgatagttgattggctgatgcacagagaattcatggaaatcattttcacatatgtgtggatcctgttagatctctg

SEQ ID NO: 34038 - protein, 132 aa, Panicum virgatum
  misc_feature: Ceres CLONE 1954950
  misc_feature (50)..(84): Pfam Name: PPR Pfam Description: PPR repeat
EIFESLKARGSANEFSYAMMVCLYKKIGRYDVAHRICQEMQALGLLTQALSYNSAIQMYVSGGRMEDAFKIFKMMLISNTPPNDATFKALNVILVRSGITRNEIRKLELLRRNNTHDCLHQWYKALSLSLQL

SEQ ID NO: 34039 - DNA, 649 bp, Panicum virgatum
  misc_feature: Ceres CLONE 1954950-R
tttttttagtttaagtcataagtcccgtcacatcgcatgtttacagaccaaatgaagcgggatggtgataaaaaatagaagctagagaataattacttctgatattccttatttggctgaaaggatatctgcttaccttgctcatgtcgtggtaagtaatattgtcggcattatatacttcgtgaattaccaatgattatttagttatttatgattatgaaatctctactactaattctgtaggtatttcttgccataaacattgaagctacgcacggtgctgttaatgccaaaaaacgtgaggtacaggtgctagagaagaggtacaggtgctagattttctcggtggatttggacgcaaagacctcaaaactgctgtacattttttctaacataagtataagcttctttacagtaattctagcatattaatttttacatcattctgtaaatagttgacaagtttacggagggaaatagaattcgtttgcagcacgaagggctcaaaaaaaaaagaatggccagactataatatcgatgattggccagttaaagagatcatcaaaacagccatccggaaagacgggctatgatgaaattcacgatgaagctcgctggcattttattatcaagtaatcttaacatacgg

SEQ ID NO: 34040 - DNA, 665 bp, Panicum virgatum
  misc_feature: Ceres CLONE 1954960
  misc_feature: Encodes the peptide sequence at SEQ ID NO. 34041
atgagcacagagctgcagatacactgcaagctcagccatgcctcggctattgcttctgctcttgctcttgccattcttcttcgcggtgtcaaccgcgaagccagaaaagatcatctcaaggagccagttccccaatagcttcttcttcggcacagcgtcgtcggcctaccagtatgaaggggctgtaagggagggcggcagagggccaagcatctgggacacctacactcacactaacccaggtcacttgctccattcaaaagctccctgctcatgcgttctgcctgccacttccacttgtctaagtgtcttaacaccttcaagcaaatgcattcgccgatatatcattaggcctatgcatagcatgttgaacagggtctcgctttagggagctaatggtcataccttaccagttgcttggtctgagtctctgagacatgattaagctacatctaaatttaaactgcttccagttcaagtgcaataaaaaagaaatggtatcgaactagaatctgtgcattggaggtagagcatgcaaatgatatgcaaataaagtaacactgtaccaccctccacaaacagtttgctttcctatggcatcttccaagctctcactcacgggcttaaccacgagaccataaaaaactggggctcatcacctaaaa

SEQ ID NO: 34041 - protein, 116 aa, Panicum virgatum
  misc_feature: Ceres CLONE 1954960
  misc_feature: SWISSPROT Homolog: EC 3.2.1.21 Beta-glucosidase
MPRLLLLLLLLPFFFAVSTAKPEKIISRSQFPNSFFFGTASSAYQYEGAVREGGRGPSIWDTYTHTNPGHLLHSKAPCSCVLPATSTCLSVLTPSSKCIRRYIIRPMHSMLNRVSL

SEQ ID NO: 34042 - DNA, 681 bp, Panicum virgatum
  misc_feature: Ceres CLONE 1954960-R
  misc_feature: Encodes the peptide sequence at SEQ ID NO. 34043
tcaagggcaataaatggatcgtttgacttcatcggtctcaactactatacagcaagatacattcagagtaccaactacagtaacagtgtaaacaaaagctatagtactgattcactgaccaatcaaacagttgaaagacatgggacagctattggtccaaaggctggatctccttggctctacatctatccaaaaggtatagaagagctcctgctatacaccaagaagacgtacaacaatcctacaatctacatcacagaaaatggtgttgatgaaattaacaatgaaaacctaccacttcaagaagccctggttgacagtaccagaatagaattctacaggcaacacctattccacattcaaagatccctcaaggaaggagctgatgtacgaggatattttgcatggtcgctgtttgacaatttcgagtggatggatggttatactgtgagatttggtattaattatatcgactacaaggatggtttgaaaagatatccaaagcattccagcaaatggttccaggatttccttcataaataaaattttgtaccgtgcatgtcaaaagtgttttctatggagcaacatcatcagtgtaacatccacattttgtcatctatccagcttccagttgtataagtgattctcaataagtcaagatgagataggtgattggattgc

SEQ ID NO: 34043 - protein, 180 aa, Panicum virgatum
  misc_feature: Ceres CLONE 1954960-R
  misc_feature (1)..(180): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 50615
  misc_feature: Useful for making plants with modulated biomass
  misc_feature: Functional homolog of the protein sequence given in SEQ ID NO 51450
  misc_feature: Useful for making plants with altered cell wall content and/or composition
SRAINGSFDFIGLNYYTARYIQSTNYSNSVNKSYSTDSLTNQTVERHGTAIGPKAGSPWLYIYPKGIEELLLYTKKTYNNPTIYITENGVDEINNENLPLQEALVDSTRIEFYRQHLFHIQRSLKEGADVRGYFAWSLFDNFEWMDGYTVRFGINYIDYKDGLKRYPKHSSKWFQDFLHK

SEQ ID NO: 34044 - DNA, 652 bp, Panicum virgatum
  misc_feature: Ceres CLONE 1954961
  misc_feature: Encodes the peptide sequence at SEQ ID NO. 34045
actcgtcggctccgctccgtctcgctcggacgctcgctgtgtcccccaggccccagactagggaggcagccggcgaacggccgaagcgcgccgccgcggagcaatggatttcaaggggttctgggagtccagattcgggggcaagaaggagcgggagccggagcagaacgggagcgccaacggcgaagccaacgggagcgccccgaagaggaccgccgatctggcggtctacgagcagttcgagcagcaggccaggcagacccaggtccgagccgccgcgatccgcgatggggctgccgatgtgatccagaagccccttcttccaccattcgagtcagctgaaatgcgtaatctcgcggagacattgttgagggatattattcgtgggagtccagatgtgaaatgggagagcatcaaaggattagagaatgcgaaacgccttctaaaagaggcagttgtcatgcccataaagtacccaaaatacttcactggtctcctttctccatggaaaggcatcttactttttgggcccccagggacaggaaagacaatgctggcaaaagcggtcgctactgagtgcaaaaccaccttcttcaacatttcagcatcatcaattgtcagcaaatggcgtggagattcagagaagcttgtc

SEQ ID NO: 34045 - protein, 182 aa, Panicum virgatum
  misc_feature: Ceres CLONE 1954961
  misc_feature: SWISSPROT Homolog: EC 3.6.4.3 Microtubule-severing ATPase
MDFKGFWESRFGGKKEREPEQNGSANGEANGSAPKRTADLAVYEQFEQQARQTQVRAAAIRDGAADVIQKPLLPPFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKL

SEQ ID NO: 34046 - DNA, 654 bp, Panicum virgatum
  misc_feature: Ceres CLONE 1954961-R
ccatgcaaccactgagacgtctcatgtcagttcttgaagccagtgatgagttggtgccggaggaagaactgcctgaggttggtcctctgaaacctgaagatatagaaattgctttaaggaacactagaccatcagcccatctccatgcacatcgctacgaaaagttcaaccaggactatgggagccaggttctatgttcagagcatgcttgattatcaggttgatgttccattcagccatggtagtggaatggacctatgctccccgtgcacatcagttagttcacatgttgacgggggtcacattgtgtcaaaatggttggaccggtaactaggttcctcggtagattgcaatttcaccatcattgattgaagtgttggctgcggtcacatctttttatgcatgtctctttagccaggcttagattttcacgaagcctctgatcttggagcagaacgttgattcgatgtttggttgcgtgtccaaataaatgtttggtaccttcagagatgtaccctggttaatagctatactgaactgaatgcgagcaggtctagattttcttgttcttattattattacgatatccaactcgttaaccaagctttaagatactcatggaaacggtcaggcgcaagatttcacctgacgggt

SEQ ID NO: 34047 - DNA, 689 bp, Panicum virgatum
  misc_feature: Ceres CLONE 1954963
  misc_feature: Encodes the peptide sequence at SEQ ID NO. 34048
aagcatctatcggtcgaccggccagctccactgtttggggaagcagcaggccaggtcgatcagcgatgatggctccaccagctgtctggcttcttcttcctctcggcctcctgtgcctgtgtagctccgccgcctctccctccggcggcgccacggcggaggccgcagccgatgacaacaactttccgccgtcggacgtcaagactggccggtcggagtccgctgccaccattccagcaaactttggcgaagccaagaaccccatgtcagagggctccgaggcggtgaccatcttcgaacctgcggcggctggcggcgccggcgggcagcggctgccgggcgtgaagcagacgatggtgctcgacaccgccagcgacgtggcgtgggtccagtgcgccccctgccccatgccgcagtgccaccctcagacggacaccctctacgacccctcgcagtcgtcgacgtacgcgccgttcgcctgcggctcccccatctgccgtcagctcggcccgtacggcaacggctgcgccgccgggtcccggcagtgccagtaccgcgtccagtaccccgacgggcggtccaccatgggcacctacatctccgacgtgctgcggctgaaccccacgtcggtgatcggcgggttccagttcgggtgcagtcacgccgtgcagggccacttccccaacgac

SEQ ID NO: 34048 - protein, 207 aa, Panicum virgatum
  misc_feature: Ceres CLONE 1954963
  misc_feature: SWISSPROT Homolog: EC 3.4.23.12 Nepenthesin
MMAPPAVWLLLPLGLLCLCSSAASPSGGATAEAAADDNNFPPSDVKTGRSESAATIPANFGEAKNPMSEGSEAVTIFEPAAAGGAGGQRLPGVKQTMVLDTASDVAWVQCAPCPMPQCHPQTDTLYDPSQSSTYAPFACGSPICRQLGPYGNGCAAGSRQCQYRVQYPDGRSTMGTYISDVLRLNPTSVIGGFQFGCSHAVQGHFPN

SEQ ID NO: 34049 - DNA, 623 bp, Panicum virgatum
  misc_feature: Ceres CLONE 1954963-R
  misc_feature: Encodes the peptide sequence at SEQ ID NO. 34050
cccgccgacggcgtacgcggcgctgcgctccgccttccgggccaagatggggatgtaccgcgcggcgccgcccaagaaccagctcgacacctgctacgacttcaggggggtccgccgtgtcacgctgccgaggatcacgctggtgttcgacaacagcgccgccgtggagctcgacccgtcggggatcctcttctccgactgcctcgccttcgcccccggcagcgatgaccgggcgatgggggtcatcggcaacgtccagctgcagacgtacgaggtgctctacaatgtcgccggcgaaaccatgggcttccgccgtgccgcctgctgatgccgatgagtgcacgcgccaattcaccatggatcatgatctgctgccagatacctaccacaagccacacacaacaaacaacctacctacctacctatatatatatatgctcacctaccgtcattttgggccattgtatggtcgcgtttgaataagccgagttaactcgtgcacatgtatttgcgtggtctatattaagcttcttatacgtgcgaaatgaagcttaagaactattttctgggcaaagtcggtccaaaaagatacatatatattttggacaaagtacatttgtctt

SEQ ID NO: 34050 - protein, 108 aa, Panicum virgatum
  misc_feature: Ceres CLONE 1954963-R
  misc_feature: SWISSPROT Homolog: EC 3.4.23.12 Nepenthesin
PPTAYAALRSAFRAKMGMYRAAPPKNQLDTCYDFRGVRRVTLPRITLVFDNSAAVELDPSGILFSDCLAFAPGSDDRAMGVIGNVQLQTYEVLYNVAGETMGFRRAAC

SEQ ID NO: 34051 - DNA, 1156 bp, Panicum virgatum
  misc_feature: Ceres CLONE 1954964
  misc_feature: Encodes the peptide sequence at SEQ ID NO. 34052
ctaagccgagcaccgcagagaaaggcgtcttcgcactcgcctctctccgcgactcaaagcttccccccctcctcccattccccaccgcgccgccgccccacccttccgacgacaccatgagggagtgcatctcgatccacatcggacaggccggtatccaggtcggaaacgcgtgctgggagctctactgcctcgagcatgtcccccgtgctgtgtttgttgaccttgagcccactgtgattgatgaggtgaggactggcacttaccgccagctcttccaccctgagcagctcatcagcggcaaggaggatgctgccaacaactttgcccgtggtcactacaccattggcaaggagattgttgacctgtgccttgaccgcatcaggaagcttgccgacaactgtactggtctccaaggcttccttgtcttcaacgctgttggtggaggaacggggtctggccttggttccctcctccttgagcgcctgtcggttgactatggcaagaagtccaagcttgggttcactgtatacccatctccccaggtctccacctcagtggttgagccatacaacagtgtcctgtccacccactccctccttgagcacactgatgtttctgtcctgctcgacaatgaggccatctatgacatctgccgtcgctccccacctacgtcagggatcatctgtgattattatttcttcaattgctgggtacaatccagaaaaagggttgacaatgtatggtgttacaaagactgctctcttaggtctcacaaaggctcttgctggtgagatgggacccaatactcgtgttaactgtatagcccctggtttcgttcctacacggtttgctagtttcctcacaacaaatgaggccattaggaaagagcttattgacaggtccacgcttaagagattgggttctgtggaagacatggctgcggttgctgcattcctggcttctgacgatgcgtccttcatcacagctgaaaccattgttgttgctggagggacacagtctagattgtaaatctggctaaagtttaattggcatgctcgaataatctgtactagcaccacatatgactataccagtgcatttagagggtgtagcaactatactgtaataattggctgtgaagctccgttgtgct

SEQ ID NO: 34052 - protein, 225 aa, Panicum virgatum
  misc_feature: Ceres CLONE 1954964
  misc_feature (25)..(198): Pfam Name: Tubulin Pfam Description: Tubulin/FtsZ family, GTPase domain
  misc_feature: Functional homolog of the protein sequence given in SEQ ID NO 50141
  misc_feature: Useful for making plants with altered cell wall content and/or composition
MRECISIHIGQAGIQVGNACWELYCLEHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVSVLLDNEAIYDICRRSPPTSGIICDYYFFNCWVQSRKRVDNVWCYKDCSLRSHKGSCW

SEQ ID NO: 34053 - DNA, 1349 bp, Panicum virgatum
  misc_feature: Ceres CLONE 1954970
  misc_feature: Encodes the peptide sequence at SEQ ID NO. 34054
actcttcaaaggctcaaagctcagagagagagagagagagagagatccactgcctcaggcattctttgtcacaggggtcgaggggagagagacagagggctgaggatcacatggtgctccttttttttgggtatgtgacagcttctgcttttagtcttttagtgcttcccttttatctcctcttcatgaaacccctttcaaaacctcaaatcaccacctcatcggctgatcagtgattgccttccttctcttgctcctttaagaaccctcttccctgccctcatttttcttcatccctcaccttttcccaaaaggcaagaacaaagcaatatgatgctctgatcgcttcgccatcgtaatcctacacattctggtgacgcaccaagataatacacaacccctctgcttttactaccctccatattacaagaggcagctccaggaatttctcacgccatggaggtttccatgctctgcacaagagttagcctgctcatcctcatcctctccctctgctctccatacaaggtcatacagagtcccatggacttcggccccttgaacctgctccccaccaccactactgcgtccagcgattttggtaggatacttttccacgctccagccgcagtgctgaagccccagtcctcaagtgacatctccctgcttctcagcttcctatctggctcgtctctgagcaaggtcacggtggcggccaggggagcaggtcactccattcatggccaggcccaggctctagatggcattgtggtggagatgtgctctttgcctgccgagatagaattctacaaaggaggagaaatatcgtatgctgatgtgagtggtggggttatgtggatagacctcctggagcagagcttgaagcttgggctagctccaaggtcatggactgactacctctatctcaccgttggcggaacgctgtccaatgctggcatcagtgggcagacatttaagcacgggcctcagattagtaatgttctacagctggaggtagtcacaggacgaggggagattgtgacatgctcacccagcaaggatgcggatttgttcaatgcggttctgggaggtcttggccagtttggcatcataactagggccaggatcctgctgcaggaagctccacagaaagtgaagtgggtgagagccttttatgatgatttcagcaccttcaccaaggaccaggagttgctggtatccatgccggatttggtggactatgtggaaggtttcatagtcttgaatgaacaatcccttcacagctcctccatcgccttccctgcaaatgtggacttcaacccagattttgggaccaagaacagccctaa

SEQ ID NO: 34054 - protein, 297 aa, Panicum virgatum
  misc_feature: Ceres CLONE 1954970
  misc_feature (56)..(198): Pfam Name: FAD_binding_4 Pfam Description: FAD binding domain
  misc_feature: SWISSPROT Homolog: EC 1.5.99.12 Cytokinin dehydrogenase
  misc_feature: The sequence is a functional homolog of SEQ ID NO 4 in US patent 7259296
MEVSMLCTRVSLLILILSLCSPYKVIQSPMDFGPLNLLPTTTTASSDFGRILFHAPAAVLKPQSSSDISLLLSFLSGSSLSKVTVAARGAGHSIHGQAQALDGIVVEMCSLPAEIEFYKGGEISYADVSGGVMWIDLLEQSLKLGLAPRSWTDYLYLTVGGTLSNAGISGQTFKHGPQISNVLQLEVVTGRGEIVTCSPSKDADLFNAVLGGLGQFGIITRARILLQEAPQKVKWVRAFYDDFSTFTKDQELLVSMPDLVDYVEGFIVLNEQSLHSSSIAFPANVDFNPDFGTKNSP

SEQ ID NO: 34055 - DNA, 569 bp, Panicum virgatum
  misc_feature: Ceres CLONE 1954970-R
  misc_feature: Encodes the peptide sequence at SEQ ID NO. 34056
tcaggtccgcaaaccctgaaggtggctgctcccaccactgcctccaagagctcctccgccgccacagccgcatcgccgacacggccggagtgcacctcggtgccaaacagtacttggctcaccacccgactccgtcaggctggcaccagcactttggctggcggtgggagcggttcgcggagcgcaagacctggttcgacccgctacgcatcctggggccgggccaaggcatatttcccaggagaggcgacaatgctgcgtatgggcgctaagtttagccggcagaaagtgaataaggggataggcagctgactaggatgcgatcttgttctttctttttctggatcttctcttgagtttcctcggcaattttgaggcaccgattgggttattccgtgggagtgggggcactttgagtttgagaggacccggtggtgaatgtcacaactcacggggaattttggaactttgtacaggctgaggaagcacaagctctagggatagagatagcgattctattcgatctgtattccttgttcgatgtggccattagtagggttactgttgtt

SEQ ID NO: 34056 - protein, 89 aa, Panicum virgatum
  misc_feature: Ceres CLONE 1954970-R
  misc_feature: SWISSPROT Homolog: EC 1.5.99.12 Cytokinin dehydrogenase
RSANPEGGCSHHCLQELLRRHSRIADTAGVHLGAKQYLAHHPTPSGWHQHFGWRWERFAERKTWFDPLRILGPGQGIFPRRGDNAAYGR

SEQ ID NO: 34057 - DNA, 1618 bp, Panicum virgatum
  misc_feature: Ceres CLONE 1954977
  misc_feature: Encodes the peptide sequence at SEQ ID NO. 34058
aaaccaactcaccggcgggcggcggcgccgcgctcgtggcgatcccccggcagtctccggcggcacgtggcagttcagcggcatggacacggaggacgacggcctcgacgccgaggccgagcggggtgccgctgcaacggcggcggacggcctccccgacgacgccgtcgtggagatcctctcccgcgtccccgcgaggtccatccaccggttcaagtgcgtctcaaagccctggcgcgacctcatcgccaacctgctccaccggaagcggctcccccagaccctcgaggacttcgtctgctgcgccggcgcgggcgccagcttccacgggcgcttcatcagcctgcctgggagtggaagatccgctcctcccgtcgacccttccttctccttcctctcgaagctgtccgggatcgagagcatcgagctcgtgggttcctgcaattggctcctcctcttcaagcgcggaaggaatcgcggcgtcggcagaccggactacgccgtgtgcaaccccgccactgagcagttggtggccgtgcccggccctggccgtccctctcctggtccggtatcagaagtgcgcacctatttgatcttcgatccagccgtatcgccacacttccacttggtccatatctggcaggaagatttcctgggtgtgattgaggtgcgtgcctactcgtctgagaccagggcgtggagtgattgggcaagccaaccgaggcgatcgcaagatggtggtggatggaaacgatgggttaatggcggagccatactgacatcaactggtgcctgtgttaacggcatggtgtatttaatcatctccaacatcatgcaggggaagtatttgataactatgttggatagggaagggaagatgtgtgggatcattcgctggccagacaatcgtgattttcctcgttttgtcggccaatcccaagggctcctgcattgtgtgggtttacttttggaacgggaagaaaattgtttaaagtgggctggactgtccatttgggttcttaaggactatgatacagaagaatgggtcctcaagcacagggtgagcttcttggagctgtttggacaaatgagttgcctggatggttataatagcaatgtgcttgccattcatacggattgcaatttgattttcattcttcagcatagtagccaggaactgatatcatatgacatggacagtaaggaattgcatgctttccacactcttggacacaactatgggtctcctactccatatgttcccagtttcctgaagttggtgcttgcaaatgagcattgaaatgttgcttttgaggtactcatggggatattcttcagtaaattgatccccatgtatggagaagttagcaacctgggtgaatgaaatctgtgagaactgagcaaatacattgctggtgacttggacagattcgctctcagttgagagacatctgtgtaaggcagttttacatatgctagttaccttattaaatgaagttgccctgcttgtgatgatttaactttaagagctccatttaccaactttaaactgctatcttttgtgatgtcagaattctgatcttcttgtatacttatatatatatatttggttggcctt

SEQ ID NO: 34058 - protein, 405 aa, Panicum virgatum
  misc_feature: Ceres CLONE 1954977
  misc_feature (19)..(66): Pfam Name: F-box Pfam Description: F-box domain
MDTEDDGLDAEAERGAAATAADGLPDDAVVEILSRVPARSIHRFKCVSKPWRDLIANLLHRKRLPQTLEDFVCCAGAGASFHGRFISLPGSGRSAPPVDPSFSFLSKLSGIESIELVGSCNWLLLFKRGRNRGVGRPDYAVCNPATEQLVAVPGPGRPSPGPVSEVRTYLIFDPAVSPHFHLVHIWQEDFLGVIEVRAYSSETRAWSDWASQPRRSQDGGGWKRWVNGGAILTSTGACVNGMVYLIISNIMQGKYLITMLDREGKMCGIIRWPDNRDFPRFVGQSQGLLHCVGLLLEREENCLKWAGLSIWVLKDYDTEEWVLKHRVSFLELFGQMSCLDGYNSNVLAIHTDCNLIFILQHSSQELISYDMDSKELHAFHTLGHNYGSPTPYVPSFLKLVLANEH

SEQ ID NO: 34059 - DNA, 718 bp, Panicum virgatum
  misc_feature: Ceres CLONE 1954979
  misc_feature: Encodes the peptide sequence at SEQ ID NO. 34060
gccatcgactccaagtacggcgacgcgctcggggtcgcgctccagttcttccaggtccagaagtcggggaagctggagaacaaccagatcccgtggcggggggactcggcacttactgatgggaaggaagcggggctggatctttccaagggaatgtatgatgctggggatcatataaagttcaccttcccaatggcattcactgcgactgtgcttgcctggtcggttctggagtatggggatcagatgagcgcggcgaagcaactggacccagcactcgatgcactcaagtggattacagatttccttatcgctgcacatccgtctgacaatgtgttatatattcaggttggtgatcctgatctggaccacaattgctgggaaaggccggaaacaatgactgagaaaagaccactcacacagattaacaagaagtctcctggatcagatgttgctgctgaggcagcagctgctatggcagcagcttcaatggtcttcaaatccagtgatactacgtattctgatgtgcttcttcaacatgcccagaagctatttacttttgctgatacttatagaggcctctcaagtgaaacctatccaaagctccaagacttctataattccactggttatgttgatgaacttctatgggcagcaagttggctctatcatgccacaggagaccagacatatctcagttatgtaactgtgcagaatg

SEQ ID NO: 34060 - protein, 239 aa, Panicum virgatum
  misc_feature: Ceres CLONE 1954979
  misc_feature (5)..(239): Pfam Name: Glyco_hydro_9 Pfam Description: Glycosyl hydrolase family 9
  misc_feature: SWISSPROT Homolog: EC 3.2.1.4 Cellulase
  misc_feature: Functional homolog of the protein sequence given in SEQ ID NO 50939
  misc_feature: Useful for making plants with altered cell wall content and/or composition
  misc_feature: Functional homolog of the protein sequence given in SEQ ID NO 51345
  misc_feature: Useful for making plants with altered lignin content
  misc_feature: Functional homolog of the protein sequence given in SEQ ID NO 51344
  misc_feature: Useful for making plants with altered carbohydrate content
  misc_feature: Functional homolog of the protein sequence given in SEQ ID NO 51323
  misc_feature: Useful for biocontainment applications
  misc_feature: Useful for making plants with modulated nitrogen use efficiency
AIDSKYGDALGVALQFFQVQKSGKLENNQIPWRGDSALTDGKEAGLDLSKGMYDAGDHIKFTFPMAFTATVLAWSVLEYGDQMSAAKQLDPALDALKWITDFLIAAHPSDNVLYIQVGDPDLDHNCWERPETMTEKRPLTQINKKSPGSDVAAEAAAAMAAASMVFKSSDTTYSDVLLQHAQKLFTFADTYRGLSSETYPKLQDFYNSTGYVDELLWAASWLYHATGDQTYLSYVTVQN

SEQ ID NO: 34061 - DNA, 618 bp, Panicum virgatum
  misc_feature: Ceres CLONE 1954979-R
  misc_feature: Encodes the peptide sequence at SEQ ID NO. 34062
aaccctataaagcttagctaccttgtttggatatgggagcaactatccacggcaagttcaccacagaggagcgtcaatccccgcagatgcaaaaacaggcttcaaaggatttcagtacctccattcacccaatccaaacccaaatgttgcaatgggcgccctggtaggtggtccattccagaatgacactttcgtcgactctcgggataatgctgtacagacagagtccagcacttacaacagtggcactcttgtcggtctgctttccggtctggtcaccacttcctctgtggcacagtcattcacctagactcttagaggcctctcaaatatatgttttggcaatggctttgatcgacatggaggtatgcatgtaaaattgcagttttttggcgaggccgatggtaattcacgattagtgacagaagcttggtctgccgttgtttagatggatggttagcacttagcagtagtagttagtgccacatttcttctgtttgtataattgatggtactgctcctgcagtttttttgctgtgtgctcctatctggtttgctggtgtacctctaaggctgttactacaagtaatgtatttctaggacagatttcatttgttc

SEQ ID NO: 34062 - protein, 52 aa, Panicum virgatum
  misc_feature: Ceres CLONE 1954979-R
  misc_feature: SWISSPROT Homolog: EC 3.2.1.4 Cellulase
  misc_feature: Functional homolog of the protein sequence given in SEQ ID NO 51451
  misc_feature: Useful for making plants with altered cell wall content and/or composition
  misc_feature: Functional homolog of the protein sequence given in SEQ ID NO 51345
  misc_feature: Useful for making plants with altered lignin content
MGALVGGPFQNDTFVDSRDNAVQTESSTYNSGTLVGLLSGLVTTSSVAQSFT

SEQ ID NO: 34063 - DNA, 545 bp, Panicum virgatum
  misc_feature: Ceres CLONE 1955001
  misc_feature: Encodes the peptide sequence at SEQ ID NO. 34064
cgtcctcccacccgaaggccccaaccgcgccgcgccaaggcggcgcctgcggcctcctcctccgctgacatcgaggacctggctccggcagtgcccggggccgcggcggtggcgctgcgggcgcagctgcttcggtggtacgacgcgcaccggcgcgaccttccatggcgacgcgccagcggcggcaaagaggagagggcgtacgctgtgtgggtgtcggaggtgatgctgcagcagacgcgggtgcccgtcgtcgtcagctactacgagcggtggatggcgcggtggcccaccgtgcggagcctcgccgccgccacgcaggaggaggtgaacgagatgtgggcggggctcggctactaccggagggctcgatttctgctggagggagcaaaacagattgtcgaaaagggggagtttcctcgcacggcgtcagcccttcgtgaggttcgtggaatcggggattacacggcaggagccatcgcttccatagccttcaatgaggttgtccctgttgtggatggaaatgtggtacgagtgatcagcag

SEQ ID NO: 34064 - protein, 181 aa, Panicum virgatum
  misc_feature: Ceres CLONE 1955001
  misc_feature (72)..(181): Pfam Name: HhH-GPD Pfam Description: HhH-GPD superfamily base excision DNA repair protein
  misc_feature: SWISSPROT Homolog: EC 4.2.99.18 DNA-(apurinic or apyrimidinic site) lyase
RPPTRRPQPRRAKAAPAASSSADIEDLAPAVPGAAAVALRAQLLRWYDAHRRDLPWRRASGGKEERAYAVWVSEVMLQQTRVPVVVSYYERWMARWPTVRSLAAATQEEVNEMWAGLGYYRRARFLLEGAKQIVEKGEFPRTASALREVRGIGDYTAGAIASIAFNEVVPVVDGNVVRVIS

SEQ ID NO: 34065 - DNA, 354 bp, Panicum virgatum
  misc_feature: Ceres CLONE 1955001-R
gtggatcgacaatgccaaaaggaagatgatagcacaaagttaaaatttgtcaatgagtcctcagtggagtccatgggattaacgtctggtattcgcaaggtgtacaacatggtcaaggctttcaaggagaaaaggctctccatatctcagaaaggtcaagtacccacgaggaaaaggagtagacggttaaagcagtaacctaggtgattatggagtagagatggctagatggctagtgcattagaaaatgtaattttaatgcctactttggtacatgcatctgaagtgctgaactccaaaactgctcatcagtgtaagcttgctgggaaaaggaaagctggtagatcgttgtgc

SEQ ID NO: 34066 - DNA, 535 bp, Panicum virgatum
  misc_feature: Ceres CLONE 1955002
  misc_feature: Encodes the peptide sequence at SEQ ID NO. 34067
tgatatgcctcctgcaatgaaagaacaaggtttcaccgaaagccgccttcaattgctatctgatattagtggcgcattcagaccaggtgttctgactgcactagttggtgtcagtggagctggaaagaccactctaatggatgtattggctggaagaaagacaggtgggactattgagggagatataaggctttctggttaccctaagaaacaggaaacttttgctcgcatcagtggctattgtgaacaaactgatatccattcaccaaatgttactgtgtacgaatcactcatttattctgcttggttgcgcctttcttcggaagttgatgagaatactagaaagatgtttgtggaggaagtgatgtcactagttgagcttggtgtattgcgagatgctatggttggtctccctggtgttagtgggttatcaattgaacaaaggaagagactgacgattgctgtggaactagtagcaaacccttcgattatattcatggatgagccaacttctggccttgatgctagagctgca

SEQ ID NO: 34067 - protein, 177 aa, Panicum virgatum
  misc_feature: Ceres CLONE 1955002
  misc_feature (29)..(177): Pfam Name: ABC_tran Pfam Description: ABC transporter
  misc_feature: SWISSPROT Homolog: EC 3.6.3.17 Monosaccharide-transporting ATPase
DMPPAMKEQGFTESRLQLLSDISGAFRPGVLTALVGVSGAGKTTLMDVLAGRKTGGTIEGDIRLSGYPKKQETFARISGYCEQTDIHSPNVTVYESLIYSAWLRLSSEVDENTRKMFVEEVMSLVELGVLRDAMVGLPGVSGLSIEQRKRLTIAVELVANPSIIFMDEPTSGLDARA

SEQ ID NO: 34068 - DNA, 398 bp, Panicum virgatum
  misc_feature: Ceres CLONE 1955002-R
gaaagaaacttatggcatgaagcatgacttcctcggctacatcgtgctggcgcactttggctacatcctcattttcctcttcctcttcgcgtacggcaccaagaccttgaacttccagaaacggtagatggttgtcagcaggggatatttacctgattaacctcccatgtttggtgtgtaaagcttgtactacgtattggatgtaacatgtaattactcagggtactcaaatcacagtgtattttcgccctttttgaatgtagacctactttacggatcacagtttccggaaatcttgaaatttttttcttccggtgttgttcttttcctctatttcgaagaccacatgttcttttaagactactggaggaagtacaaattcggtttgtttcaactgg

SEQ ID NO: 34069 - DNA, 672 bp, Panicum virgatum
  misc_feature: Ceres CLONE 1955007
  misc_feature: Encodes the peptide sequence at SEQ ID NO. 34070
aaaggaacagggagcttccaagggaggcatcaggcaggttgtctccctccttcccacctgcaccaccctaccccagtcctatctcacctatcgatgggaaggtctccttgctgtgatgagaatggcctcaagaagggcccatggacccctgaagaagaccagaagctcatggagtacatccagaagcatggccatgggagctggagagcactgccgaagcttgcagggctcaacaggtgtggcaagagctgcaggctgagatggaccaactacctgaggccagacatcaagagagggaagttcaccgaagaggaagaacaaaccatcctccggttccactccgtccttggcaacaagtggtcagccatcgcgaagcacctcccggggcggaccgacaacgagatcaagaatttctggaacactcacctgaagaagaagctgatccagatgggcttcgacccgatgacgcacaggccaagaacagacttctttgctgcgctacctcaactcattgcgctggccaacctccgccagctcgtggagcagcggccatgggacgaccacgccgccaggctgcaggttgaggcggtccaggctgcaaagctccagtgcctccagaacctgatccagtctgcagcatctattgcaactagtcccagttccagcagcatc

SEQ ID NO: 34070 - protein, 192 aa, Panicum virgatum
  misc_feature: Ceres CLONE 1955007
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 296 in the 11/479,226 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 824 in the 10/412,699 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 58 in the 10/666,642 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1073 in the 10/374,780 US patent application
  misc_feature: The sequence is a functional homolog of SEQ ID NO 788 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 126 in the 10/412,699 US patent application
  misc_feature: Functional homolog of the protein sequence given in SEQ ID NO 50831
  misc_feature: Useful for making plants with modulated nitrogen use efficiency
  misc_feature: Functional homolog of the protein sequence given in SEQ ID NO 50733
  misc_feature: Useful for making plants with altered cell wall content and/or composition
MGRSPCCDENGLKKGPWTPEEDQKLMEYIQKHGHGSWRALPKLAGLNRCGKSCRLRWTNYLRPDIKRGKFTEEEEQTILRFHSVLGNKWSAIAKHLPGRTDNEIKNFWNTHLKKKLIQMGFDPMTHRPRTDFFAALPQLIALANLRQLVEQRPWDDHAARLQVEAVQAAKLQCLQNLIQSAASIATSPSSSS

SEQ ID NO: 34071 - DNA, 616 bp, Panicum virgatum
  misc_feature: Ceres CLONE 1955007-R
gacctggagcaaattggcctcctgagtcctccgcagatgtcttccctgtcttcgttgccttctccaagtttcctcgagagtatcagtggccaggacatcgtagctggacaactgcctgacatccaaattcctagctctttctttgagcagcccaccagcaacgatgcaaaccagaactcggacttcactccaaagagtagtgttgagggagaaaatggaacccctaaaacgctgctactgtcagaaaactcccttccaccactcaccgacatccccatttccaacctcggcgatgcttgcagcgcctcaagctgtgatggtagcagcattcaattcccaagttggcctgagttgtttgatgaacagttcttgagcgagtttgtatgaatcctggtctggtgtgtgtgtgtgcgcgcgcgcgcgcgttactttacggtttgcttttttcagttttagttttgtttcttacctctgtttttcgtgccatattctggtgtgattatcagttcagaggtgtagtttccgcgtgctgttttttttttgtcgttttgagtgcaaatgcatgctcctatgcataacactacaccaaacacttgtaaatatacagcttctatac

SEQ ID NO: 34072 - DNA, 1290 bp, Panicum virgatum
  misc_feature: Ceres CLONE 1955022
  misc_feature: Encodes the peptide sequence at SEQ ID NO. 34073
agccaaccaacccgccccgagcagcaaagcacaggcgcacgagctcccacagctccacgcctcctccctcccgctcccgccatcctctcctccgccgcgcgccttcccgcccgccgagcctttggggtggttccggagtcgcggccgtgcgcgcgagagcgagaccctcccctgctgccgagcgtaaatctgccgagctcggcatggggtgaccagatcggggcgcggctcggtgctctacggctgaattccgctcgaggaggggggtttgccttgcctagaagaggccgcggggatggcgaacgccggcgtggccgtcggctcagggggtattagccatgctttgttcagggaactctggcatgcttgtgctgggccgttggtcacggtgcctcgccaaggcgagctggtttactacttcccgcaaggtcatctggaacagcttgaagcatctacagatcagcaacttgaccagcacttacctttgtttaatctaccatccaagatcctgtgcaaggtggtaaatgtagaactcagagctgaaactgattccgatgaagtttatgctcaaattatgctgcaaccagaagcagatcaaagtgagcccaccagcccagctcctgagctaccagagccagaaaggtgcaatgtccattccttctgcaagactttgactgcttcagacacgagcacccatggtggtttctctgtcctcaggagacatgctgaagaatgtttgccccaattggatatgactcagaacccaccgtggcaagaactggtggctaaagatctccatggaaatgaatggcatttccgtcacatctttcgaggtcaaccaaggaggcatctacttacaacaggttggagtgtttttgttagctcaaaaagattggttgccggtgatgcatttatctttttgagaggtgagaatggagagctacgagtcggggtaagaaggctcatgaggcaactaaataacatgccatcatcagttatctcaagccacagcatgcatcttggagtcctcgcaactgcatctcatgccatctccactggaactctcttttctgttttctacaaacccagaacaagtcgatcggagtttgttgtgagcgtaaacaagtaccttgaagctaagaatcacaagatgtctgtcggtatgaggtttaaaatgagatttgagggtgatgaatctcctgaaagaagatttagtggaacaattattggtctgggaagcatgccagctaactcaacatctccgtgggctgactctgattggagatcttt

SEQ ID NO: 34073 - protein, 331 aa, Panicum virgatum
  misc_feature: Ceres CLONE 1955022
  misc_feature (248)..(331): Pfam Name: Auxin_resp Pfam Description: Auxin response factor
  misc_feature (121)..(226): Pfam Name: B3 Pfam Description: B3 DNA binding domain
  misc_feature: The sequence is a functional homolog of SEQ ID NO 298 in the 10/412,699 US patent application
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Functional homolog of the protein sequence given in SEQ ID NO 50313
  misc_feature: Useful for making plants with modulated seed size
  misc_feature: Functional homolog of the protein sequence given in SEQ ID NO 50311
  misc_feature: Useful for making plants with modulated biomass
  misc_feature: Functional homolog of the protein sequence given in SEQ ID NO 50312
  misc_feature: Useful for biocontainment applications
  misc_feature: Useful for making plants with modulated flowering time
  misc_feature: The sequence is a functional homolog of SEQ ID NO 300 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 100 in the 10/666,642 US patent application
  misc_feature: Functional homolog of the protein sequence given in SEQ ID NO 50498
  misc_feature: Useful for making plants with modulated light quality sensitivity
  misc_feature: The sequence is a functional homolog of SEQ ID NO 576 in the 10/666,642 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 2380 in the 10/374,780 US patent application
  misc_feature: The sequence is a functional homolog of SEQ ID NO 962 in the 10/225,066 US patent application
MANAGVAVGSGGISHALFRELWHACAGPLVTVPRQGELVYYFPQGHLEQLEASTDQQLDQHLPLFNLPSKILCKVVNVELRAETDSDEVYAQIMLQPEADQSEPTSPAPELPEPERCNVHSFCKTLTASDTSTHGGFSVLRRHAEECLPQLDMTQNPPWQELVAKDLHGNEWHFRHIFRGQPRRHLLTTGWSVFVSSKRLVAGDAFIFLRGENGELRVGVRRLMRQLNNMPSSVISSHSMHLGVLATASHAISTGTLFSVFYKPRTSRSEFVVSVNKYLEAKNHKMSVGMRFKMRFEGDESPERRFSGTIIGLGSMPANSTSPWADSDWRS

SEQ ID NO: 34074 - DNA, 663 bp, Panicum virgatum
  misc_feature: Ceres CLONE 1955022-R
accactaaaccgaacctagacaaattgtcaccagaatctgacatgccgcagagtgactcaaacaacagcgctctggttgccgccgataaggactgatggatgctaacttggcgctttaccttttcttccctttttggatgtttgggaggcaatgcccatgctccttgagactgctaagagttatctgtttgttgcgctgtgggcctgaaggacgttgccccacaatctgccgactgccttggtttggaatggctgatgtaggaccagtggtggtcctctgccagcaaggacgactggaacgtaagggcaagcaggctgcgtgcgcgccgttccctgtggcaccaacctgtgttttgtttgccgtgtttggtaggaggcatggcgaattgccggctgcttggttttggagactgccactgactgctgccgtctcgttggtcgacgtcggccggcgggctgcgcccctcacctccagtaaataggactttatgtacaactattttggtagtagcagtagtggtttatgtatatcagcgtcatgttccttgctacctatataagcatcatcatctgtagctgctgttcccaccttgcattgtattctacccccggcttggtacggaatgatctggtgcaaaaaagtctgcttgctgttccagcggc

SEQ ID NO: 34075 - DNA, 1434 bp, Panicum virgatum
  misc_feature: Ceres CLONE 1955038
  misc_feature: Encodes the peptide sequence at SEQ ID NO. 34076
aagaaagaatgaacctgaagtgaaataagaaacatcttcctccctacgtctctttgcctgtgtccttgagtccatttttgctctcgtgtgtgtgtgctatctagagctgatttctaacatatagttctctaaaagcatcttttctgcaagtctccaacccactattcatgtgttccaaggaagaataaccttttccaataaagtgctctccagtttccatttactactctgctgttggcatcctttcgccctgctcaaaagaagtgtgcccatttctggtggaccgtttattcaagagatcctattgggaaaaaatagcatgtatgcaccactctagtcagtgccttacaagttgacccttattcagttttcaggacgactatctgcaatggacgggcgtcttcaggaagcagcggcaactggtgactcgcgggacctggctacttatgacccagacatgttgctcggcacaactccgctgggaaacacctgcctccacatcgcctccgtacatggccacgagggcttctgcgaggccgccctggctctgaagccctcactcctcgctgccgtcaactcggacggcgagacggcactgctcaccgccgtgacaagcggccgtgtttctttggcttgtgttttgctcaggtactgccgcgatcagcggctgagtgagaccatcttgaagcaagacaaacatggatgcaacgcactgcatcatgccgtacgtggcggacacaggaagcttgcgctcgatctgatagaagcagagcctgccttgtgcaaagctgtcaaccagtacgctgagtcacccatgttcatcgcggtgttgagaaatgatgcggaggtcttcgagaaactgctggggattccggattctgctcatggcggagcccatggctggaacgctctgcacgctgccgtcaaaaacggtaattcagacatcgctaaaatgattatggagacacgtcctaggctggctagagaagagggcaaggacacggctactccaatgcatttggcggtactatggggccagactggcatgctaacaattcttttggaacatgatcgatctttggggtatgtctcaaataaagctggcaaccctctcctttgtgctgctgcatcccgaggccatgttggtgttgctcgagagcttcttaaacattgtccagatgccccctactgcaaaacaaatggctggacgtgcttgcactctgctgtatcgagcgaacagacgaaattcgtagaatttgtccttggttcgccacaacttggtaaactcgttaacatgcgagttaagaatgatggaagaaccgctctgcatctcgctgtcaagaagtgcaatccgaagatggtcgccgcattactgcgtcacccagacatagacaccacagttatggacaacgacggtagccgagcttcctggct

SEQ ID NO: 34076 - protein, 348 aa, Panicum virgatum
  misc_feature: Ceres CLONE 1955038
  misc_feature (308)..(341): Pfam Name: Ank Pfam Description: Ankyrin repeat
  misc_feature: SWISSPROT Homolog: EC 2.7.11.1 Non-specific serine/threonine protein kinase
MDGRLQEAAATGDSRDLATYDPDMLLGTTPLGNTCLHIASVHGHEGFCEAALALKPSLLAAVNSDGETALLTAVTSGRVSLACVLLRYCRDQRLSETILKQDKHGCNALHHAVRGGHRKLALDLIEAEPALCKAVNQYAESPMFIAVLRNDAEVFEKLLGIPDSAHGGAHGWNALHAAVKNGNSDIAKMIMETRPRLAREEGKDTATPMHLAVLWGQTGMLTILLEHDRSLGYVSNKAGNPLLCAAASRGHVGVARELLKHCPDAPYCKTNGWTCLHSAVSSEQTKFVEFVLGSPQLGKLVNMRVKNDGRTALHLAVKKCNPKMVAALLRHPDIDTTVMDNDGSRASW

SEQ ID NO: 34077 - DNA, 657 bp, Panicum virgatum
  misc_feature: Ceres CLONE 1955038-R
gacgggttcattgcctatttttactaagctgctaggagaatggcccatctggaagctgaggtttcggctgggtcggaaattcgagtctggcctccttgatatggtctaatctctttgaggcgtcgtcttggaagctctgcttgttgctgacgaaattgttgccgttctcctggtggtggtcgtcggctctcctcggggagtccatgtttctgtgcctgcccgcgcctcatttcgtccacctcgttcgagttgcctatgtcgtctggcggatgctttgccgccccctttgctagcggatgctttgccgcccctctctgctggcgaatgctttgccgccgttgttgttgctcgctttgtgtggatactttgccgccttggtttgctggtcaggtggatgctttgccacctccgagtttggtgacctttgcactcttgacggtggtgcatcttttagcaggttcagttgcttggcgtgtctaggtttgcaggcttgtatgttccttcccctgttgttcttgttgtttttcttgttgtgttgggtcgtttgccacttgcttagtggtgctttgtaatcaccttaatagcctctgcctattaaggtttgtaccggtcatattgctttcctcttaatgaaacacgtgctcaggcacgttcgcg

SEQ ID NO: 34078 - DNA, 1112 bp, Panicum virgatum
  misc_feature: Ceres CLONE 1955043
  misc_feature: Encodes the peptide sequence at SEQ ID NO. 34079
gaatcgagcgagccagcacactgtcggatccgtgccgtgctcccccgccgccgccgccgccgcttcctcctcctcaccgcttcgtccgcttcgtcgattcggttcgctgcttcccgcctcaaatcaccgcctcgcggatggcctccagcgccccggcgccccagccccagcccctgccaaagcccaccagggtctcgctgtcctacgaggagatctccaagctcttctcgctccccatcgccgaggcagcctccatcctcggagtctgcaccagtgtcttgaagaggatttgccgcagctacgggattgttaggtggccgtatcgaaagcttgtttctgggaaagctggtgacgacacaaaaggtcctgaaagagagaaagccaaggagcttctggagttgtcaaaaattgcaaaacaaaaggctttcagcccatctggttcaccagtagtgtcaacgagcacttcccaaggagcggcaaaatctcaacagggcagttctaaggcaggccaactctcggtttcacccccagcagttaaacagaatgcgtcagctagcttggcgcatggtagccaagccaaagccattcctagctacatggatggtttcaagtacggattcccatcatctggcttgtcctgtgaaactatgaaatggtggggcgggagcagtgactcagactgtgcccccaccaaagatggaagctgtgaagcccatggcgaggcatcaaagggcatgactgatgatgatgagttggactggggagcagatgaggcggaggctgaggctgatggtgctgttacagcagaagcgtcggcacagctgtgctcgctgagaaggaaagcagtagacgacgggcgcaagctattgaatggagacaccagcaggggacaagacttttctagactgaacaagaggcagaagctggcgctagcccaggtatttggggcttcactgccggatgttgtacttgtgtttagtgagtgagcaactgataaatgtggttgccctccctcttcagatcctcatgtaacatgacccattataagcgagaagtgtgaaatcctctcactgaattgaagaagaacagtaggagcttattttgcctgcctt

SEQ ID NO: 34079 - protein, 282 aa, Panicum virgatum
  misc_feature: Ceres CLONE 1955043
  misc_feature (17)..(68): Pfam Name: RWP-RK Pfam Description: RWP-RK domain
MASSAPAPQPQPLPKPTRVSLSYEEISKLFSLPIAEAASILGVCTSVLKRICRSYGIVRWPYRKLVSGKAGDDTKGPEREKAKELLELSKIAKQKAFSPSGSPVVSTSTSQGAAKSQQGSSKAGQLSVSPPAVKQNASASLAHGSQAKAIPSYMDGFKYGFPSSGLSCETMKWWGGSSDSDCAPTKDGSCEAHGEASKGMTDDDELDWGADEAEAEADGAVTAEASAQLCSLRRKAVDDGRKLLNGDTSRGQDFSRLNKRQKLALAQVFGASLPDVVLVFSE

SEQ ID NO: 34080 - DNA, 653 bp, Panicum virgatum
  misc_feature: Ceres CLONE 1955049
  misc_feature: Encodes the peptide sequence at SEQ ID NO. 34081
aaaaatttgcttcccatctccgctcagatctgaccccgcacccaacccgaggccaaacccccccttccctccctcccaaatggcgcactccaacggcgacgccgccggcggcgacggcgaggccgccgccccggtgccgcgccccctcgcgccggcgcggaaggtggcgctgatcacgggcatcacggggcaggacgggagctacctgacggagctgctcctctccaaggggtacgaggtgcacggcctcatccgccgctcctccaacttcaacacgcagcggctggaccacatctaccacgacccgcacgccgtgccctcgtccccgcgcccgccgatgcgcctccactacgccgacctctccgactcctcctcgctccgccgcgcgctcgacgccatcgcccccgacgaggtctacaacctcgccgcgcagtcgcacgtcgccgtctccttcgagatcccggactacaccgccgacgtcaccgccacgggcgcgctccgcctcctcgaggccgtccgcctcgcgcgcaagcccatgcgctactaccaggccggctcctcggagatgttcggctccacgccgccgccgcagagcgaggacacgccgttccacccgcgctcgccctaccccgtcgccaaggtcgccgcgcact

SEQ ID NO: 34081 - protein, 191 aa, Panicum virgatum
  misc_feature: Ceres CLONE 1955049
  misc_feature (30)..(191): Pfam Name: Epimerase Pfam Description: NAD dependent epimerase/dehydratase family
  misc_feature: SWISSPROT Homolog: EC 4.2.1.47 GDP-mannose 4,6-dehydratase
  misc_feature: Functional homolog of the protein sequence given in SEQ ID NO 51452
  misc_feature: Useful for making plants with altered carbohydrate content
  misc_feature: Functional homolog of the protein sequence given in SEQ ID NO 51453
  misc_feature: Useful for making plants with altered cell wall content and/or composition
MAHSNGDAAGGDGEAAAPVPRPLAPARKVALITGITGQDGSYLTELLLSKGYEVHGLIRRSSNFNTQRLDHIYHDPHAVPSSPRPPMRLHYADLSDSSSLRRALDAIAPDEVYNLAAQSHVAVSFEIPDYTADVTATGALRLLEAVRLARKPMRYYQAGSSEMFGSTPPPQSEDTPFHPRSPYPVAKVAAH

SEQ ID NO: 34082 - DNA, 673 bp, Panicum virgatum
  misc_feature: Ceres CLONE 1955049-R
  misc_feature: Encodes the peptide sequence at SEQ ID NO. 34083
gatcacgcgcgccgtcggccgcatcaaggtcggcctgcagaccaaggtcttcctcggaaacctctccgcggccagggactggggattcgccggggactacgtcgaggcaatgtggctaatgctgcagcaggatcagccaggtgactacgtcgtcgccactgaggagtcccacaccgtagaggagttcctgcaggctgccttcgggtatgccgggctcaactggaaggaccatgtggtcattgacaagaagtacttccggccggcggaagtcgacagccttaaaggggactcgaccaaggcgaggagggtgctcaaatggaagcccaaggttggattccagcagctcgttgagatgatggttgatcacgacattgagctcgccaagaaggagaaggtgcttgtggatgctggttaccgtgatcccaagcagcagccttagaaacagcacaaatgccctcttgctctgttggagcttgaatttggggattgttgccttgtagctcatacattgtggttctcaaagtagaggttgactgaggttactattgttattcttcttgggtcagaaataaggatgcttgcagtttgatctcacagtatcttcatttgcattttcctctatgttatgcgctttaaccaaatgaatgaatgatctgtgcaattttcggagagc

SEQ ID NO: 34083 - protein, 145 aa, Panicum virgatum
  misc_feature: Ceres CLONE 1955049-R
  misc_feature: SWISSPROT Homolog: EC 4.2.1.47 GDP-mannose 4,6-dehydratase
  misc_feature: Functional homolog of the protein sequence given in SEQ ID NO 51452
  misc_feature: Useful for making plants with altered carbohydrate content
  misc_feature: Functional homolog of the protein sequence given in SEQ ID NO 51453
  misc_feature: Useful for making plants with altered cell wall content and/or composition
ITRAVGRIKVGLQTKVFLGNLSAARDWGFAGDYVEAMWLMLQQDQPGDYVVATEESHTVEEFLQAAFGYAGLNWKDHVVIDKKYFRPAEVDSLKGDSTKARRVLKWKPKVGFQQLVEMMVDHDIELAKKEKVLVDAGYRDPKQQP

SEQ ID NO: 34084 - DNA, 1169 bp, Panicum virgatum
  misc_feature: Ceres CLONE 1955055
  misc_feature: Encodes the peptide sequence at SEQ ID NO. 34085
ggttaccttcctcctccaccgcatcgacgccagttagccgaggacgcaaccgcctgcgcccggaccccaaccagctagagggaagcgggagaaggatggaccggtaccagagggtggagaagccgagggaggaggcgcccatcaaggagaatgagatccgcatcaccacgcaggggaggatgcgcaactacatcacctacgccaccgccttgctccaggacaagggttctgatgaggttgtattcaaggccatgggaagggctatcaacaaaactgtcatgatcgcggaattgatcaagaggaggattgttggcgtccatcagaatacgaccactggatctactgatattactgatatgtgggagccgttggaggaaggcctacttccgcttgagacaacaaggcatgtctctatgatcactataactctttcaaagaaggagctggacacatcctctgtcggatatcaatctcctttgcctgctgatcaggtgaagcctttggttgactacgataacgatgaagatgcacactcacctggtggccgagggaggggccgtggtggtcgaggccgtgggcgaggcaggggaagaggtggacgtggaaatggatacaatgactatgctgatggtggttggggagaggaggatcatgcccctgagtacatgggcaacggatatccccgtggaagagggagaggtttcagaggccgcggcaggagaggtggctacggtggccagcctgattaccaacaggatggaggctattatgatgaggcacctgttcctgctccggcccgaggtcgtggtcgaggtcgtggccgtgggagaggcccgtctagaggcagaggacgtggtggcaacatgaatggtgtggtgcatgctgcagcatccggtgcgtaagctgtctgggacaggttgtttgttggatgcccgctccaaatatgaagatgtatcatgtgttgttgtcagttaacattatacttggtataagcttgacattcactgtcggaatgcagccaggttttgatatttgactaggcttgtagggtagcgtctttacagtgcttcctccttccagtagatgtcgtaaactaattgtagtttcgtaaaggtttagagcagggcattctttctatttttttaatataaaatgaagtcttgttccct

SEQ ID NO: 34085 - protein, 268 aa, Panicum virgatum
  misc_feature: Ceres CLONE 1955055
  misc_feature (17)..(87): Pfam Name: Alba Pfam Description: Alba
  misc_feature: SWISSPROT Homolog: EC 3.1.26.5 Ribonuclease P
MDRYQRVEKPREEAPIKENEIRITTQGRMRNYITYATALLQDKGSDEVVFKAMGRAINKTVMIAELIKRRIVGVHQNTTTGSTDITDMWEPLEEGLLPLETTRHVSMITITLSKKELDTSSVGYQSPLPADQVKPLVDYDNDEDAHSPGGRGRGRGGRGRGRGRGRGGRGNGYNDYADGGWGEEDHAPEYMGNGYPRGRGRGFRGRGRRGGYGGQPDYQQDGGYYDEAPVPAPARGRGRGRGRGRGPSRGRGRGGNMNGVVHAAASGA

SEQ ID NO: 34086 - DNA, 516 bp, Panicum virgatum
  misc_feature: Ceres CLONE 1955056
  misc_feature: Encodes the peptide sequence at SEQ ID NO. 34087
ctccgcaaaattccccatcgccgtcgtctgcctccgcaagcgcctcggaaccctagcccaccggcgacccctccggatccgacgcgcacatccggcggaatcggccgctgctaccccgtcgtcgcgctccggcacctccgctccccggcgttctccgcctgacttctccgcgtgcgatctccccccggctgagtccagaggaatcgcttggtggaggcttcgtctacgcccgcccggcgtcgaatcgaagggatccgcgagcctgccgtcgtctgagacgctgatcgccgatcacctccccgtagatcgaatttgatctgtacctcttcgattttgtgtatttcatttgagaaaaaatattcaggtcatcccgtcataattgtgaggaaggccttttgcgaggaaacagactcgccatccatcatgggtgttgtgtactaccaatataagagtgaaaaggagatctgttccatgcctgtgccctatgcttttatatctgtctctgaactcaagcag

SEQ ID NO: 34087 - protein, 30 aa, Panicum virgatum
  misc_feature: Ceres CLONE 1955056
  misc_feature: The sequence is a functional homolog of SEQ ID NO 1252 in the 10/666,642 US patent application
  misc_feature: The sequence is a functional homolog of SEQ ID NO 1253 in the 10/666,642 US patent application
MGVVYYQYKSEKEICSMPVPYAFISVSELK

SEQ ID NO: 34088 - DNA, 500 bp, Panicum virgatum
  misc_feature: Ceres CLONE 1955056-R
agagaagggaccatgggcgtcctaacaggtcctcagatgactaccacgaggatcagtcaagtaggaagagaatgcgtgattcttctccaatgtatggcgacaaacacagcggccggaggtcgagacacagttccaggagtatgactcgtgaggaggatgcaagcgatgatgagtgcaacttcaagaggaggtgggggtgcagatcagttggagtggatacaaggcactgaatgaagatgtcaacttaggggaggaccaagtggaggattgctgatcggcgatgctctctatagattttttattacttgtaattgtatgtatgcatctggaagccatgggagcttctgaaaaaacagggaagaacttgcaggttttccccaacagaaatgtaatcagctattcatgtactaccaataatctgtacttgcgagcattgccagctctcacctctgtaatgcaatgtcttcaaagatgaatggaatttctctgatttctgagtt

SEQ ID NO: 34089 - DNA, 1604 bp, Panicum virgatum
  misc_feature: Ceres CLONE 1955067
  misc_feature: Encodes the peptide sequence at SEQ ID NO. 34090
aactgaatccgcaagccgaaccctcacgcctccttccatcgaaccggagcccgccgccggccgccgccccgctccgacgaagaagagaaggtcgccgtctcctcctcctccctccgtcggcaagggagtggtgatgtctacttcggtgcaatcgtcgtaccttcctgctaccactgagtcgatatcaaaggctcaggaggctaaggatgcttctgagtccatctcaatcctctaccgagtgctcgaagacccatcttcttcagcggatgcactgagagtaaaagagcttgccattacaaatctgacaaactacctcacgaaagaaaacagagctgaggatctcaggaatcttttgacccagctcaggcccttctttgcactgatccccaaggcaaagactgcgaagattgtgcgtggcatcattgatgctgttgccaagatacctggaacatctgagcttcagatctcactctgcaaggagatggtagaatggacacgtgcagagaagcgtaccttcctcaggcagcgtgtggaagcaaggctggcagcccttctgttagagaatcaggagtatactgaggcccttgcgctcctttctggtctcatcaaggaagtcaggagactggacgacaagttgcttcttgtggacattgaccttctggagagcaaactccatttctctctgagaaacctgccaaaggccaaagcttctctgactgctgcaagaactgcagccaatgccatttatgtgccaccatctcagcagggcaccattgatctgcagagtggaatcctccatgccgaagaaaaggactacaagactgcttacagctacttctttgaagcatttgaagctttcagttctctggaggaccctaaggccatcttcagcttgaagtacatgcttctgtgcaagataatggtcaatcaagctgatgacgttgcaggaatcatctcatcaaaggctggtctgaagtatctgggtcctgatgttgatgccatgaaagctgtggccgatgcctactccaaaaggtctctgaagtactttgaaactgccctccgagactacaaagcccagctggaagaagatcctatcgtccacaggcacctctcgtctctgtatgataccctactggagcagaacctctgcaggttgattgagccctactcgagggtggagattgcacacatagccgagatgattgagctgccattcagccatgttgagaagaagctgtcccagatgatcctcgacaagaaattcgcggggactctggatcagggtgctggctgcctcatcatattcgaggataccaagaccgaggagatcttccccgccacgctcgagacaatcacgaatgtcgggaaggtcgtggacagcctttacatgagatcggccaagatcatggcttaaaatatgtgggtctactgtcagtttagctggccttacttagctctgcaagtgacaatgaattctgaatttgttctttttctttattcctttggggctgtggaatgtttgagctacaattatgccatgttgctcatggacgagactgttgtttctgagtgatggaagagtatgttaacgctttgatgttttc

SEQ ID NO: 34090 - protein, 426 aa, Panicum virgatum
  misc_feature: Ceres CLONE 1955067
  misc_feature (288)..(392): Pfam Name: PCI Pfam Description: PCI domain
MSTSVQSSYLPATTESISKAQEAKDASESISILYRVLEDPSSSADALRVKELAITNLTNYLTKENRAEDLRNLLTQLRPFFALIPKAKTAKIVRGIIDAVAKIPGTSELQISLCKEMVEWTRAEKRTFLRQRVEARLAALLLENQEYTEALALLSGLIKEVRRLDDKLLLVDIDLLESKLHFSLRNLPKAKASLTAARTAANAIYVPPSQQGTIDLQSGILHAEEKDYKTAYSYFFEAFEAFSSLEDPKAIFSLKYMLLCKIMVNQADDVAGIISSKAGLKYLGPDVDAMKAVADAYSKRSLKYFETALRDYKAQLEEDPIVHRHLSSLYDTLLEQNLCRLIEPYSRVEIAHIAEMIELPFSHVEKKLSQMILDKKFAGTLDQGAGCLIIFEDTKTEEIFPATLETITNVGKVVDSLYMRSAKIMA

SEQ ID NO: 34091 - DNA, 687 bp, Panicum virgatum
  misc_feature: Ceres CLONE 1955073
  misc_feature: Encodes the peptide sequence at SEQ ID NO. 34092
tatattgagaaaatattgtgaagctttttcttccatggtggagggaaaaaacaggatttcaacagataaactttctggtggagcaaggattcattatatttttcagtcaatatttgtcaagagtctggaggaagttgatccttgcaagagtattactgatgaagatatccgcacaaccatccagaattctggtggcccaaaaggtgctatgtttctgcccgaggtgccatttgagattcttgtgcgaaagcagataggtcgtctactcgacccaagtcttcagtgtgcccaatttatctatgatgagttaatcaaaattagccatggttgcttaaccagtgagcttcagaaatttccaattcttaaaaagcggatgagtgaagttgttagcagtttcttgagagatggtcttcgaccggcagaaacaatgataacccatatcattgaaatggagatggattatataaatacttcgcatccaagctttgttgggggcaccaaggttgttgagcttgctaagcatgaagttctacctcccaaaacatcagcttcactctcagttcataaggatggtactattgttggctctgagatacaattaacaggtgaaagaggccaaaagtcacgtgctgttttcgcaatagatgctaacagaagagctacatctgatcagggtgatatggatgc

SEQ ID NO: 34092 - protein, 228 aa, Panicum virgatum
  misc_feature: Ceres CLONE 1955073
  misc_feature (1)..(178): Pfam Name: Dynamin_M Pfam Description: Dynamin central region
  misc_feature: SWISSPROT Homolog: EC 3.6.5.5 Dynamin GTPase
ILRKYCEAFSSMVEGKNRISTDKLSGGARIHYIFQSIFVKSLEEVDPCKSITDEDIRTTIQNSGGPKGAMFLPEVPFEILVRKQIGRLLDPSLQCAQFIYDELIKISHGCLTSELQKFPILKKRMSEVVSSFLRDGLRPAETMITHIIEMEMDYINTSHPSFVGGTKVVELAKHEVLPPKTSASLSVHKDGTIVGSEIQLTGERGQKSRAVFAIDANRRATSDQGDMD

SEQ ID NO: 34093 - DNA, 533 bp, Panicum virgatum
  misc_feature: Ceres CLONE 1955073-R
catatacacatcatcccctaatcgctacggtgtacacaaaacatctcatctagtcatataaaccagcatgtgtcagtggcattatatttgtacgtggatgccaaaggagcatggcttcccgcatggtcatgatcctgccaaggaatttgtgggcgataagcttgagttttgacctgtaaattccatttatttgctagcaagctgtttgctttctagtcggaagctattgctggtggagaaccctcattacgtattgctgaagttgtcaggacaaggcagatatatgcaagtgaataggggccacagggtagttgtatagaccagtgttcaactagcccaggtatcagttttgtgttgcctaggagaatgaggacagctgtgggaacgatgagagattgagacgtatgacttgcaattgcgaagttgcagaagtgtatctatacaaacttgtaaacaggaccatgcatcatgtaagtgggattactgtacgaattcatgtgaccatggttgttcaccagttcctaattggccat

SEQ ID NO: 34094 - DNA, 1229 bp, Panicum virgatum
  misc_feature: Ceres CLONE 1955083
  misc_feature: Encodes the peptide sequence at SEQ ID NO. 34095
aatccgtagtggagcaacttccttcgcagcaggatcgagcgggaggcggggcagccaggcggcaggcgcacacgcgaaggcggtgagggcgcgggcggcggcgcctgacgaggagaagaaaccctaactcttgggtcgcggctgagccactcccaactccaaagattcgcctccatgccttccaatcctcctccgccgccgcctcccgggtcgtcgtcttcggctccggcgggggccagctacttcccgctccctttccatctgcagcagcaccagccgcagccgcagatgccgccgccgatggcgccgaacagctaccagcagtaccagcagcagctgcaccaggcgcaccagctcttccagcgggacgcgcagaccatcacccccgaggcgctgcagagcgtcaaggctgccctcgccaccagcgacgtcctcgaccccgccaccagcgccggcgccaggccctccgacccctccagcagcaagaagcccatcccccgccgcgccgccggacagtcctgggaggacccgacccttaccgactggcccgaaaatgattataggctgttctgtggagatctaggcaacgaagttaatgatgatgtcctctccaaagcgttctcacggtttccctccttcaacatggcaagggttgttagagataagaggactggcaaaactaaaggttatggatttgtgagcttttcaaaccctactgatctggctgcagcaataaaagaaatgaatggaaagtatgtaggtaaccgcccaattaaattgcgcaagagtaactggaaggagaggacagatgttgaggctctggaaaggcaaaagaatcatgtccagaggaagcctaaaatgcccaagaagagtattctgcacaagtaaagctatataggtcattctgataatgatccctgcagatgtgctgctcccttgggatacttcaggaagttcttctctttctgcactactagtcgagacgaaaggctgcctgatgttacttttaggctgtgcgaatacttgtgaccataaaacggagcatcaatagccacttgatacaagctgtgctccatctttctgtttccctttctcaacagttgtacttgcacgttgatgcgttctggaacagtattatgacgaatgactaatgagggcgttttggtgtagccaaatgaaccttttgctttgggtttcagccaagccaactattgatttgtattcttgtt

SEQ ID NO: 34095 - protein, 195 aa, Panicum virgatum
  misc_feature: Ceres CLONE 1955083
  misc_feature (89)..(160): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAPNSYQQYQQQLHQAHQLFQRDAQTITPEALQSVKAALATSDVLDPATSAGARPSDPSSSKKPIPRRAAGQSWEDPTLTDWPENDYRLFCGDLGNEVNDDVLSKAFSRFPSFNMARVVRDKRTGKTKGYGFVSFSNPTDLAAAIKEMNGKYVGNRPIKLRKSNWKERTDVEALERQKNHVQRKPKMPKKSILHK

SEQ ID NO: 34096 - DNA, 632 bp, Panicum virgatum
  misc_feature: Ceres CLONE 1955131-R
  misc_feature: Encodes the peptide sequence at SEQ ID NO. 34097
cctgatcgccgtaaagaattttttgagtgcttagatctggaagacttagaccgactgctaggaggaagcaacgacacaataaatctgcaagattggaaatcacatactcaatataatggctacaaagaaaaggatcgcctgattacttggttctggaaggcagtcgagcgcatgtcaatggagcaacagaggcagctcctcttcttctggacttcagtgaagtacttaccatcagatggctttggtgggctgagctccaaactgtacatatacaagacatccgattcacctgaccgtctcccatcgtctcagacctgcttctaccgcctctgcctccctccttatacatccttgaaaatgatggaaaaccagctgcagaagatcacacaagagcatgtgagctgcagcttcggtacatggtagttgctgccattctggagccggaaccggcatattctgtacatattaggttagttccatcctgttatctcattgcatcttatcatagaagcttcaaggtaataggctgtctcttttttttctctcttttttgtatgtaccgtgagttagtgttctgagacactaaacctaatgtagatggaattggtagaaagcagattccttttatttcc

SEQ ID NO: 34097 - protein, 140 aa, Panicum virgatum
  misc_feature: Ceres CLONE 1955131-R
  misc_feature (1)..(140): Pfam Name: HECT Pfam Description: HECT-domain (ubiquitin-transferase)
PDRRKEFFECLDLEDLDRLLGGSNDTINLQDWKSHTQYNGYKEKDRLITWFWKAVERMSMEQQRQLLFFWTSVKYLPSDGFGGLSSKLYIYKTSDSPDRLPSSQTCFYRLCLPPYTSLKMMENQLQKITQEHVSCSFGTW

SEQ ID NO: 34098 - DNA, 1229 bp, Panicum virgatum
  misc_feature: Ceres CLONE 1955131
atcctcacactccccccaacccatcctgctgcctgcttcctcccccaaattcggctcctcctaaacccccctcccccacctcctcctctccgccgcggccccaattccgacctccccgaccccgatgaatccgatctaagcatgtccgccgctttagcctgccaccgccgcaaccccaagcgccgccgcgacgcgcccgatcatgcgctccccccctcatccaagcagccgctgatggcccacgccggcgccggcgccgccgagccgtcctcgtcggcctccgcctccgcttcgggggccgattgtgcctccgcggcggcggcgcccccaccgtcgccgcgggaggcgcactttttcgtgcgcgccaccgactccaagaccatcgcgatgcacgcggggtgggacgacaccatcggcgccgtgctcgaccacctcggcgcctgcgggtacggccgcgatttgcggctcctctacgcggggcggcagctcgccccggaggccaccctcgccgagctccgcctcccgcaggactccacgctgcacctcgccgcccgactccgatccacccagcacccgcacgcgtggcagctcgcggcgcacatcgccgccaccgccgccggcgccgagtccggggccgccagcgtccccgccgccgctttctccctcgacgagctcgtcaaggacttcatcctccgcgcccaccgtgccaacctcggccttttccgccaagatcgcggtgctgcaggcgaagaccgggccacgggggaccacgcggcggagtacctcgacatcttcctgcaggcgggcgccgccttagcgttggttcgcctctacctctcaaagtccgcctttcgctcatacgccgagagtgctatcaaatgctttatcgccacggacccttcgtccttaccgatggatgtgcttgtcttgacggcgccagttctacttgaattctgccgcttgctttccatggctgcgggcaagaaggaattactctatagatcatgccggcgttcacttgcatcagtgttatccactgggcccaggctgcccccaaccatgaactcgccaaccaggttgatcgagcaaatcctgccatttgcctgtgaaacagtggatgtggtccttgaaggactcgcatccatgtccatgatggtctcacctattgatcttgatgagttctcaaatttctttaaagtgatgtgccagcaggcacgccattggatatc

SEQ ID NO: 34099 - DNA, 987 bp, Panicum virgatum
  misc_feature: Ceres CLONE 1955182
  misc_feature: Encodes the peptide sequence at SEQ ID NO. 34100
tccattccgagctctcgctttgaaaccgaaccagctcacaccacccagctgccgtttctagagaatcccctgcgtttcgagatcccggtcgccacgatgcctgccctcgccaagctcgcctcgcgccccgccaagaccgccgcggcgccgaagccgaagcccgccgccgccaagcccaaggtcgcggccggcgccggcgcctcccacccgccctacttcgaggtgagccttgcccgaactccgtctggtttcgtcctcggttgggattgggtgctgatcgggattgggttttgttccgtgcagatgatcaaggaggcgatctcggcgctccaggagaggaccggctcgagctcgcacgccatcgccaagtacatggaggacaagcacggcccgtcgctgccggccaactacaagaagatgctctccatccagctccgcgggttcgccgccaagggcaagctcgtcaaggtcaaggcctcctacaagctctccgacgccgccaagaaggaggcccccaaggccaagcccgcagccgccaagaccgtcgcggccaagccggccaaggccgccgcgaagccgaagaagagcgccgccgccgcgaagccgaagaagaccgcggccgccgccgccgggaccaagcgcaaggcgccggagaagaaggtcgtggcgaagccgaagaagtcccccgcggcgaaggccaaggccaagcccaagactgtcaagtcccccgcctccaagaaggcccggaaggtcgccgcatgagatggttccataggtcggagctctgattgtggtgtggttgtccctagggaggtgtacaaatgaagtgcgttccccaagcgtctctgatccggtgttgtgttaggtcagttccatgtatccaggtcggtgttagtgtaactgatggttaggtttcttgtgagggagatgtatctcgctctcttatatgatatgaacctgcagtttgccagaactttcttgtgacgg

SEQ ID NO: 34100 - protein, 221 aa, Panicum virgatum
  misc_feature: Ceres CLONE 1955182
  misc_feature (67)..(133): Pfam Name: Linker_histone Pfam Description: linker histone H1 and H5 family
MPALAKLASRPAKTAAAPKPKPAAAKPKVAAGAGASHPPYFEVSLARTPSGFVLGWDWVLIGIGFCSVQMIKEAISALQERTGSSSHAIAKYMEDKHGPSLPANYKKMLSIQLRGFAAKGKLVKVKASYKLSDAAKKEAPKAKPAAAKTVAAKPAKAAAKPKKSAAAAKPKKTAAAAAGTKRKAPEKKVVAKPKKSPAAKAKAKPKTVKSPASKKARKVAA

SEQ ID NO: 34101 - DNA, 700 bp, Panicum virgatum
  misc_feature: Ceres CLONE 1955204
  misc_feature: Encodes the peptide sequence at SEQ ID NO. 34102
attccaggcctccccccatcaccggccgccgcccgccgcgcggcgcctccgcactcccttcaccggccgtcgccgccccgcccttcatggccgggcagtccgacccgcacctctccatcttctcgccctccgaggtggagttcgtggcggaggatgagatcgtcgacatcgtccccaacatccgcatggacgccctcaacatgatctgcggggacttcgggcccttctacccgcaagtcccgaccaaggtgccgctctggctcgctgtcgcgctcaagaagcgtggcaagtgcaccatccgcaccccggactggatgactgttgaccgtttgacacaggtactggaagcagaaagagagtcctctcgagaattccagccattaccattccactacattgagatttctaagctgctgtttgatcatgcacgtgatgacatctcagatgcatacttggtgagatctttgattgaggacatcagagatgtcagattccacaaggttgagactggattagagacaatatctggacgcactcatgctgtaaagctcaaaaatctgtctgcaatggaagtgaacattgtccgtcctttcatggtgagaactttgcaggcattctataagcatgatagtccacagatgattcagcaagcagatactacagggagcaggccaacaccagttacagaccgtggtccaag

SEQ ID NO: 34102 - protein, 204 aa, Panicum virgatum
  misc_feature: Ceres CLONE 1955204
  misc_feature (20)..(167): Pfam Name: Psf2 Pfam Description: Partner of SLD five, PSF2
MAGQSDPHLSIFSPSEVEFVAEDEIVDIVPNIRMDALNMICGDFGPFYPQVPTKVPLWLAVALKKRGKCTIRTPDWMTVDRLTQVLEAERESSREFQPLPFHYIEISKLLFDHARDDISDAYLVRSLIEDIRDVRFHKVETGLETISGRTHAVKLKNLSAMEVNIVRPFMVRTLQAFYKHDSPQMIQQADTTGSRPTPVTDRGP

SEQ ID NO: 34103 - DNA, 655 bp, Panicum virgatum
  misc_feature: Ceres CLONE 1955204-R
aagaatgtgttcctgaccccctgagatctatcaaatagtaaaggcaatggtgcatcgtccattaattagaagtttttctaaactgttatattcgatctggttggattcggggaaaggtaaagatagtaagcgacggcaataatctctctcaaaaagaagatattttccccgaatgattgaacaagtgcatgttaccgtttggtagtcatctccagcagtttggcaaatcgagttgccatctttgatttttggcaaaaacgttaaaaatactcctccaacagtttggcaaaagacttggcaatttttggcaacttgggaaaaaccagcctccagcgcggcgcggcgcgcggttggcatcgtggtttctagttaggtgggagggtgaaaaaagaaataaataacagagaagggtttttgatttaagttttcaagaggtggaagggcataaatataattttgtttctctctcagggttcctgatgtaagttagatctggatttggcaagtgaattatgccaaactgttggatataagctctttttttacttggtatatctttctagaagttggcaaaacacaagatatgccaagtaaaatatggcaaactcttggagatgctcgtatgcttaaaagtttgataagtcgtcattatatc

SEQ ID NO: 34104 - DNA, 582 bp, Panicum virgatum
  misc_feature: Ceres CLONE 1955207
  misc_feature: Encodes the peptide sequence at SEQ ID NO. 34105
agctttcgagtcatttccttacatttcctacctttggccttaggttattagactcgaagatcatgttctctgacttggtgcctctcggttttaaggtcgcagcttgtcctacctggtgtagcttagcaacctgttcagcaaaatgaggccttcagatgacagggcgcagctctcaggctttgaacaatcagaagaatcaacacttgatgtggaggggcattgctaccaccaacagtcattcccttgttctccatcaatgcaaccaattgcttctgggtgcacacacacagagaatagtgcggcatacttcttatggccgacatcaaacctacagcattgtgcggctgaggggcgcgcaaactactttggcaacctttcaaaaggactccttcccaagtctggcaagttgccaaagggccagcaagcaaatagcttgcttgacttgatgactataagagctttccatagcaagatattacgctgttttagccttgggacggcagtgtgatttcgcatcaggaaaggggttctgacagatatccctgctattcttgtctttgttgctcgcaaggttcacaagaa

SEQ ID NO: 34105 - protein, 121 aa, Panicum virgatum
  misc_feature: Ceres CLONE 1955207
  misc_feature: Functional homolog of the protein sequence given in SEQ ID NO 51147
  misc_feature: Useful for making plants with altered protein content
MRPSDDRAQLSGFEQSEESTLDVEGHCYHQQSFPCSPSMQPIASGCTHTENSAAYFLWPTSNLQHCAAEGRANYFGNLSKGLLPKSGKLPKGQQANSLLDLMTIRAFHSKILRCFSLGTAV

SEQ ID NO: 34106 - DNA, 488 bp, Panicum virgatum
  misc_feature: Ceres CLONE 1955207-R
agttcatctcaaacttcgtcggtatgtcccctgtgcgccaagaccaggacgctccgaggcaaatcgccaacctgaacaacccatcagaggaagaactggccatgtcgctgcacctaggtgaccgggagcccaagcggctgcgcaccgacacagaagccgaccttgacctggagaagtgaggtgctcagttcagcgtccctacattcagaaatcagatctagtccgaagatctcctgcggttcagcaaattgaacctgcagcgttagcttaaaccagcatgctcatggcaaatgcattaaggtgtaccatggtgaaacttgattcagcacttgtagggttttaggtggtatctctgcagttttgctgtgctcatgagacttgatttacacaaatgctgaatcccctatcatgttaaaacaatgtagggagcgatgaagtggtatcttcagcactgttttcctatcattattgatgagttttgtctctgg

SEQ ID NO: 34107 - DNA, 654 bp, Panicum virgatum
  misc_feature: Ceres CLONE 1955229-R
  misc_feature: Encodes the peptide sequence at SEQ ID NO. 34108
aactacacgggtgatgggaacctttgggtacctggctccagagtatgcgtcaagtggcaagttgaccgaaagatcagatgtattctctttcggtgtgtttctcttggagcttattactggtcgaaagcctgttgatgcatcaaagccattgggtgatgagagccttgttgagtgggctaggccattgctgacacaagcacttgagagtggcgatgtaggggagctggtggacaccagactcaataagaactacaatgaagttgagatgttccgtatgattgaggctgctgctgcttgcattcggcattcagcatccaggagacccaagatgagtcaggtggtgcgggttcttgatagcctaagtgacgtcgatctaagcaacggtgtccagccaggcaagagcgagatgttcaacatcgcgaacacggcggagatcaggctgttccaacggatggcgtttggcagccaagatttcacgaccgatttcagccagtctagctgggacagccagagtagaggtcttgacgcttctggttcgaggccattttaatcctcgtcgccgtcaattcgtaaatctaactagctagggcatttcatatggactcttttacccaagtgtgattcttcgagtggatcatgattattcttttgcct

SEQ ID NO: 34108 - protein, 182 aa, Panicum virgatum
  misc_feature: Ceres CLONE 1955229-R
  misc_feature: SWISSPROT Homolog: EC 2.7.11.1 Non-specific serine/threonine protein kinase
  misc_feature: Functional homolog of the protein sequence given in SEQ ID NO 50776
  misc_feature: Useful for making plants with altered carbohydrate content
TTRVMGTFGYLAPEYASSGKLTERSDVFSFGVFLLELITGRKPVDASKPLGDESLVEWARPLLTQALESGDVGELVDTRLNKNYNEVEMFRMIEAAAACIRHSASRRPKMSQVVRVLDSLSDVDLSNGVQPGKSEMFNIANTAEIRLFQRMAFGSQDFTTDFSQSSWDSQSRGLDASGSRPF

SEQ ID NO: 34109 - DNA, 1272 bp, Panicum virgatum
  misc_feature: Ceres CLONE 1955229
ggaattcattcgcatcaggcagggtggtgagtggcagcaaggagagatttctgcaaaggtacagagtcacatgcgttggatttcggggggtcgagagagagagagagagagaggaaaaaggagaaagaagcgaagggagagaggtccttctcgtcttgttcgcttgctcgcctcactgttcttgcggttacctccgcctcgccttcaatgctaccgcgtcactgctggatctgacagaaccaccgcgtccgcctccgcctagaagcctaatttttggtccctgcttcttcaagattctgttttctctctcgaaattccagtcttgattcgctacgttctcttcgccgcatccgtgagaaaggtgggatcttggctcagtttctggaggatttgaattctttttgtgcgtctgcttttggtgctgaagagaggctgcctctgtttgttatgcagtgctgcgcgcgtgctgatttgagcgagaagcttttcttctagtggtggaggtgagatttcacctcctccgcgttcttgcagcggcaggagagagaagcggaatttcgcttggttcctgcgcgaatccgcgagattttctcgcgggggaagctcgatcccccttgaattgcgtcgtgtgccatgattctcgcttccatttccactaagaagtaagaaggcagcatctcagcagcgacggcactgtagtgctccagcctgctgggctccaatggcgtcctcgccgtcgccctccccgggcaccatcagggccaccttgccgccgtccacagcaaccccatcgccggcaaccaccacacccacgccggcctctccggctccggtgacacagcccaatgctaccccggccgatcctccctcctcgccggctgcgccgcctccccttccccccgcatccacgccacccccgcagctcactccaccgccctccttgccaccgccgcctcctgccgctgtgccgccaccgccggtagttgttgcctctccgccaccagccccagcagccgtagtgccgccaccctcaccgcccgttgcagtgcccccaccacctacacctgctgccccgccaaaggcatcgcctatactcccccctgcggctgcatcaccaccaccatcaaatttgccagcgcccaacccaccggctgacccaactccgccgacagtagtgcagccgcctccaccaaagaatcgtcagccaccaagaaaacctggaacacagccggatcctccaccgctggctccaccaccttctggaattcctgt

SEQ ID NO: 34110 - DNA, 618 bp, Panicum virgatum
  misc_feature: Ceres CLONE 1955242
  misc_feature: Encodes the peptide sequence at SEQ ID NO. 34111
cacacaaactcccgtctcctttcctcccctctccgtctcgacgcgtcggtggtggtgtgggtgcccgatcgagatcttccccggacttcgtgagatctggttacagatctacctgacaagatggtgaagatctgctgcatcggtgctggctatgtcggtggcccgacaatggcagtcattgccctcaagtgccccgatattgaggtcgttgttgtcgacatctccaagccccgcattgaggcctggaacagcgacacactcccgatctacgaacccggtctcgatgatgttgtgaagcagtgcaggggcaagaacctcttcttcagcaccgatgttgagaagcacgtcgctgaggctgacatcatcttcgtctccgtgaacacccccaccaagacccgtggtctcggtgcaggaaaggctgctgacctcacctactgggagagtgctgctcgcatgatcgctgatgtctccaagtctgacaagattgttgttgagaaatccactgtccctgtcaagaccgctgaggccattgagaagatcctgacccacaacagtaagggtatcaactaccagatcctctccaatccggagttccttgctgagggaacagccattgaa

SEQ ID NO: 34111 - protein, 165 aa, Panicum virgatum
  misc_feature: Ceres CLONE 1955242
  misc_feature (2)..(165): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature: Functional homolog of the protein sequence given in SEQ ID NO 50760
  misc_feature: Useful for making plants with altered carbohydrate content
  misc_feature: Functional homolog of the protein sequence given in SEQ ID NO 50761
  misc_feature: Useful for making plants with altered cell wall content and/or composition
MVKICCIGAGYVGGPTMAVIALKCPDIEVVVVDISKPRIEAWNSDTLPIYEPGLDDVVKQCRGKNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAI

SEQ ID NO: 34112 - DNA, 338 bp, Panicum virgatum
  misc_feature: Ceres CLONE 1955242-R
ctcaaggacatgcccgcggtcgcttaaatcttccccacagacatcggcaagctgcaggggatgcggcaaagaagaagaggaactagttgaccattctttattatagtttgtttttgcaggagacgctacgattttctcttctgtcatcaggcataaaagttggacggtgctgctagtattctgtttcagtgttgtcatgttcggtgtaaacccctcgagacggccttgcgctctgcttgtgggggatttccttgtacgcgtatagacctgctatagccggttgattcttcaaattgtattcctacaaagttactacagaatcgatgtgtttttttgcc

SEQ ID NO: 34113 - DNA, 677 bp, Panicum virgatum
  misc_feature: Ceres CLONE 1955249
  misc_feature: Encodes the peptide sequence at SEQ ID NO. 34114
aaggaccgccacagcaaggttgacggccggggccgccgcatccgcatgcccatcatctgcgccgcccgcgtcttccagctcacccgcgagctcggccacaagtccgacggccagaccatcgagtggttgctccgccaggccgagccctccatcatcgccgccaccggcaccggcaccaccccggcctccttctccacctcctcgccatcctccctccgctccacctcctcgcagaccacgcccttcgtcctcggcaagcgcgtccgcaacgacgccgacgccgagcccacagtcgccgcccccgcccctggattctgggcgctgccggcgcgggcagacttcggccagctctggagcttcgcggcagcgccggagatgatggtggccgccgccgccgccgcggcgcccgccatggcaggggaggcgtccgcagcccgggtcggaaactacctgcccatggcgcagggcaacctcaacctgctcgcctccttctccggcgggccagctccaacggccacagccggacgggccgaggaggagagcgcacgctgaacattcatacccccatcggctttttatgcatctccacatctagggttttatttatttattactctaggttttcttccttgaatccttagcttgagacttgttgctcggtttgctttccttgctgc

SEQ ID NO: 34114 - protein, 183 aa, Panicum virgatum
  misc_feature: Ceres CLONE 1955249
  misc_feature (1)..(167): Pfam Name: TCP Pfam Description: TCP family transcription factor
  misc_feature: The sequence is a functional homolog of SEQ ID NO 1222 in the 11/479,226 US patent application
  misc_feature: The sequence is a functional homolog of SEQ ID NO 136 in the 10/225,068 US patent application
  misc_feature: The sequence is a functional homolog of SEQ ID NO 162 in the 10/374,780 US patent application
  misc_feature: The sequence is a functional homolog of SEQ ID NO 550 in the 10/412,699 US patent application
  misc_feature: The sequence is a functional homolog of SEQ ID NO 970 in the 10/225,066 US patent application
  misc_feature: The sequence is a functional homolog of SEQ ID NO 2782 in the 10/374,780 US patent application
  misc_feature: The sequence is a functional homolog of SEQ ID NO 680 in the 10/225,066 US patent application
KDRHSKVDGRGRRIRMPIICAARVFQLTRELGHKSDGQTIEWLLRQAEPSIIAATGTGTTPASFSTSSPSSLRSTSSQTTPFVLGKRVRNDADAEPTVAAPAPGFWALPARADFGQLWSFAAAPEMMVAAAAAAAPAMAGEASAARVGNYLPMAQGNLNLLASFSGGPAPTATAGRAEEESAR

SEQ ID NO: 34115 - DNA, 538 bp, Panicum virgatum
  misc_feature: Ceres CLONE 1955249-R
tgtgcgcgtgtgtgctgttgctgtcaaaactcaaatgtactactaatctcctcctctccggggtgggctgttccaagaagaagagaagaaaacttcctctttgttggacaagcaagggaaatggcgtcaaattgtcgtccatctctgcagcaggcagctggtgcatcagttcagctcagctccctccctcccaagcagagagggggaagaagaggaaggaaggaaaaagaccttttcttaccacaaacaaacaaacaaacaaaggatgctgggcctggctgtaagttgtccacttggtctgctcatctgctctgtctgcttgctgtcattttgattgttgccttttgtgctctcatcttgattccattagtcatactgcttctgcacctgaatgttgagggagattgagagcaataactagtgtgttagtcctcaattgttggtagctcagttcagctcttatgtatgtatctgtatctatatatgtacggattgcttgttgatcaggtcaagaattaatggatgaaaataaggacgg

SEQ ID NO: 34116 - DNA, 1213 bp, Panicum virgatum
  misc_feature: Ceres CLONE 1955250
  misc_feature: Encodes the peptide sequence at SEQ ID NO. 34117
atccgttccccaaccccccatcgcgccgccgccggaggcgcctcgatccagattcagtagacatgcctcgctatgatgatcgttatgggaacacacgcttgtatgttggcagactgtcctcccgcactcgttcccgtgacctggaatatcttttcagcaaacatggaagaatacgagaagtggagttgaagcgcgactatgcatttattgaattcagcaatcctcgtgatgctgatgatgcacaatacaacctagatggcagggaagttgatgggagccgcatcattgttgagtttgctaaaggggttcctcgtggttctggtggctcacgtgagtacatgggaagagggcctccgcccgggacaggtcgttgttttaactgtggaattgatggtcactgggcaagggactgcaaggctggtgactggaagaacaaatgctaccgttgtggagaaaggggccacatagaaagaaattgccagaacagtccccagaatctcaggcgtgagagaagttattcacggtcaccatctccacaccgtggacgggggcgcagccggagctacagcagaagccgtagctatagccgttctagatccccatctggatctcccaggggtggacgccgagaccgtgatgagaggagatcaaggagtcttagctacagcaggagccccaggcgttctgcttcaccaagtgctaaggaaaaggagcgcagccccgcacccaacggcagtaggagcccaaggagtcccagcccaagggatcaggtgagcccgccaccaaaggacaatggtgaacgcaatggctcagaccgtggtgacagccctgcgaagagggagaacagcaggagcaggagcaggagccgtagcccatctgatggctaccgtagccctgcagccaatgggcgcagcccgagccctagagatgaccggagccctagtcccaaaggcaatgctggtgatgatgatgaccgtggttcaccaagaggaagccagtccccctgaaaagttacattttcagctttaagacagaaagaactgtatttgccacccattttctcgacgacttatggttttgtgagctagaatcttatgcaaggatctgttgccctcgggctatctccggtttgtaacgttgatatttgaacttcttagactggttaatttggatattcgtcagataatttgccctcgtggcagccttatattgc

SEQ ID NO: 34117 - protein, 314 aa, Panicum virgatum
  misc_feature: Ceres CLONE 1955250
  misc_feature (13)..(76): Pfam Name: RRM_1 Pfam Description: RNA recognition motif. (a.k.a. RRM, RBD, or RNP domain)
  misc_feature (102)..(119): Pfam Name: zf-CCHC Pfam Description: Zinc knuckle
  misc_feature (124)..(141): Pfam Name: zf-CCHC Pfam Description: Zinc knuckle
  misc_feature: SWISSPROT Homolog: EC 5.2.1.8 Peptidylprolyl isomerase
MPRYDDRYGNTRLYVGRLSSRTRSRDLEYLFSKHGRIREVELKRDYAFIEFSNPRDADDAQYNLDGREVDGSRIIVEFAKGVPRGSGGSREYMGRGPPPGTGRCFNCGIDGHWARDCKAGDWKNKCYRCGERGHIERNCQNSPQNLRRERSYSRSPSPHRGRGRSRSYSRSRSYSRSRSPSGSPRGGRRDRDERRSRSLSYSRSPRRSASPSAKEKERSPAPNGSRSPRSPSPRDQVSPPPKDNGERNGSDRGDSPAKRENSRSRSRSRSPSDGYRSPAANGRSPSPRDDRSPSPKGNAGDDDDRGSPRGSQSP

SEQ ID NO: 34118 - DNA, 626 bp, Panicum virgatum
  misc_feature: Ceres CLONE 1955255
  misc_feature: Encodes the peptide sequence at SEQ ID NO. 34119
agttgttagttcccgaccggcacttgatgggggatgtgctgcaccctcaccctcaggccggcgccggcgacgtgcaggccctctggccgggcgacctcgacgagcagctcataaccgagctcctcagcgacgacagcctcctcctcggcgccctgcagcagcccccggccggcggcggcgactcggagcacggctcggcagacacgggggcctcgccagcggctgctcccgcggcgtgcgacagcagcgcgggcgagcaggagctgctgccgcagctggaggaggtgagcagggccctgtgctcggtgtacaccggcccgacgatccgggacatcgagatggcgctgtggacgtcgcggccctcctacccctggagcagccgccgctacagcccgatgcatctgtttggggcggcgagccgggcgccggtgagcaagtacacgaccaaggtgaggagctgcggcggcaagacgccgagcgacggctacaagtggcggaagtacgggcagaagtccatcaagaacaacccccatcccaggtgcagtacgatccacacgcgtctggctctacttctacaactaggcctgtctacaacgttaaattaattttgggcgttactccttttc

SEQ ID NO: 34119 - protein, 200 aa, Panicum virgatum
  misc_feature: Ceres CLONE 1955255
  misc_feature (158)..(200): Pfam Name: WRKY Pfam Description: WRKY DNA -binding domain
LLVPDRHLMGDVLHPHPQAGAGDVQALWPGDLDEQLITELLSDDSLLLGALQQPPAGGGDSEHGSADTGASPAAAPAACDSSAGEQELLPQLEEVSRALCSVYTGPTIRDIEMALWTSRPSYPWSSRRYSPMHLFGAASRAPVSKYTTKVRSCGGKTPSDGYKWRKYGQKSIKNNPHPRCSTIHTRLALLLQLGLSTTLN

SEQ ID NO: 34120 - DNA, 545 bp, Panicum virgatum
  misc_feature: Ceres CLONE 1955255-R
aaaaattggtttcagacaggcattcctttcaggtccagcgacacctctagctgctgtacctagctgatctctaactctctaatcctggaccaagctcagccaccgcatcgcgccacgtcgcccgcaattcccggccgtcggatcggccgggcggacggcctcgatcttgcgtttcccagtcattttgcaaaaaagtcctcgaacttaggtcgttttgcaaaaaaaccctcgacattttgcaaaaaaagtccttgaacttaggccattttgcaaaaaaacctcgacattttgcaaaaaagtcctcgaacttaggccactttgcaaaaaagcccccggtcattttgcaaaaaagtcctcgaacttaggccattttgcaaaaaagccctcgaacttaggccattttgcaaaaaagtccccggacatttcgcaaaaaaatcctcgaacttaggccattttgcaaaaaagtcctcgaacttccttgcaataccagatcttgcgtttcccagtcatttcgaaaaaaagtcctcgaacttaggacattttgc

SEQ ID NO: 34121 - DNA, 594 bp, Panicum virgatum
  misc_feature: Ceres CLONE 1955256
  misc_feature: Encodes the peptide sequence at SEQ ID NO. 34122
gcaatcacaaggtcgctctagctctgacctcagagagagagagagagagagagagagatgctgaagcaggcggaggtggtggtggtggtggacacggcgctggtgccgccaagcaaggagacgccggggcagccgctgtggctgtccaacctcgatctggccgtgccgaggacgcacacgccgctcgtctactactacccggcgcccgcgcagggcgccgccgcggcgggcacgggctccttcgcgccggaccggctcaaggccgcgctggccggggctctggtgccgttctacccgctcgccgggcggctcggtcccggcccggacgggcggccgcagattaactgcaccggtgagggcgcgctcttcgtcgtcgccagggcggacctcaccggcgacgacatctttgaggacttcgagccgtcgccagagatccggagagcttttgtgccgtcaccgcggcctggcgacgcgtcctgccccttggccgtgttccagttgactttcctcaagtgtggcggcgtggtgctgggcaccggcatccaccacgcggtgctggacggcgtgggcgcgttccagttcatccagacgtgg

SEQ ID NO: 34122 - protein, 178 aa, Panicum virgatum
  misc_feature: Ceres CLONE 1955256
  misc_feature: SWISSPROT Homolog: EC 2.3.1.144 Anthranilate N-benzoyltransferase
  misc_feature: Functional homolog of the protein sequence given in SEQ ID NO 50924
  misc_feature: Useful for making plants with altered carbohydrate content
MLKQAEVVVVVDTALVPPSKETPGQPLWLSNLDLAVPRTHTPLVYYYPAPAQGAAAAGTGSFAPDRLKAALAGALVPFYPLAGRLGPGPDGRPQINCTGEGALFVVARADLTGDDIFEDFEPSPEIRRAFVPSPRPGDASCPLAVFQLTFLKCGGVVLGTGIHHAVLDGVGAFQFIQT

SEQ ID NO: 34123 - DNA, 647 bp, Panicum virgatum
  misc_feature: Ceres CLONE 1955256-R
  misc_feature: Encodes the peptide sequence at SEQ ID NO. 34124
ccaacgtcgcccaccgcctgagcccgccgctcccacgcagcttcttcggcaacgccgtcgtgcgcgacctcgtcacggcgcgggtcggcgacctgctgggcagcccgctcgggtccgtggcggagacgatcaagaaggcggtggacggcgtgggcgacgcgttcgtgcggtccgtgctcgactacctggagctggagcaggcgaagaagcgaggcggcgacgacgacagcgcccagggcgagcagatggtgccggcgaccgacctgtgggcggtgagctggctggggatgcccatgtacagcgccgactttggctcgggcgcgccgcggttcgtcgcgccggcgcagatgttcggcgtcggcacggcgtacatgaccccctgcgccaacaaggacgacggcatcaccgtcatcttctcgatggaggccgagcacattgagtgcttcgagaaggtcttctacggggaatgaattgaaacagctcgagatacacgtgctacgttttgtgcttttaatttaatttaatttatccatgtaaaagaagcattttatcagggtaaatccgcataaatcgccctaaggcttgcatacgatctcttgcttccggggaaatgcttatgtatcaggttgggtttgatttcaggcgac

SEQ ID NO: 34124 - protein, 155 aa, Panicum virgatum
  misc_feature: Ceres CLONE 1955256-R
  misc_feature: SWISSPROT Homolog: EC 2.3.1.144 Anthranilate N-benzoyltransferase
  misc_feature: Functional homolog of the protein sequence given in SEQ ID NO 50924
  misc_feature: Useful for making plants with altered carbohydrate content
NVAHRLSPPLPRSFFGNAVVRDLVTARVGDLLGSPLGSVAETIKKAVDGVGDAFVRSVLDYLELEQAKKRGGDDDSAQGEQMVPATDLWAVSWLGMPMYSADFGSGAPRFVAPAQMFGVGTAYMTPCANKDDGITVIFSMEAEHIECFEKVFYGE

SEQ ID NO: 34125 - DNA, 672 bp, Panicum virgatum
  misc_feature: Ceres CLONE 1955258
  misc_feature: Encodes the peptide sequence at SEQ ID NO. 34126
acatgccgcggccgcctccctcagatcctccgtcctcgctcggtcaagtgccgccgctacccccctccgtcactcttctcccgtggccaccacccaccccatccgccgctccccgcccctctccaccggccggtttggtttgtctctgaaaggcggcggcggcggcggcggagatgtcggaaaagaagcgcggcggcggcggcacccgcaaggacgaggtggtgacccgcgagtacaccattaacctccacaagcgcctccacggatgcaccttcaagaagaaagcaccaaatgccatcaaagagatcaggaagttcgctcaaaaggccatgggcacaacagatgtccggattgatgtaaagctcaacaagcacatctggagcagtggcatcaggagtgtgccaaggcgagtccgtgtcagaattgcccgcaagaggaacgatgaggaagatgcaaaggaagaactctactctctggtcacagttgctgaggtccccccggaaggtcttaaaggtttgggaaccaaggttgttgaggatgaggactaagctatctagtgtttctaagcagaatttgggtcttgcttaattgttatctgctgttgatgacttatgtaatagaagatttgaggccctgcttgtttctttgaagcgcttgaattttgactttttc

SEQ ID NO: 34126 - protein, 124 aa, Panicum virgatum
  misc_feature: Ceres CLONE 1955258
  misc_feature (12)..(106): Pfam Name: Ribosomal_L31e Pfam Description: Ribosomal protein L31e
MSEKKRGGGGTRKDEVVTREYTINLHKRLHGCTFKKKAPNAIKEIRKFAQKAMGTTDVRIDVKLNKHIWSSGIRSVPRRVRVRIARKRNDEEDAKEELYSLVTVAEVPPEGLKGLGTKVVEDED

SEQ ID NO: 34127 - DNA, 600 bp, Panicum virgatum
  misc_feature: Ceres CLONE 1955258-R
  misc_feature: Encodes the peptide sequence at SEQ ID NO. 34128
caaaccacccccagctcgcgaccatggctgctgtgccagtcaaccctaaacctttcttgaacaacctaacagggaagcctgtaattgtcaaacttaagtggggtatggagtacaaaggttatcttgtttctgtggactcctacataaatcttcagcttgctaacacagaggagtacattgatgggcaattctctgggaacctgggagagattttgatcaggtgcaacaatgttctgtacgtccgaggtgttccagaggatgctcagatagatgatgcggactgagaagacttgaacggtgcttagatggattgatcattgatgtaattttattctgacgtgtgtttgggtgtgccggggacaacctattctgccggggacccacgaccgtctttgtgtcgcttgctaccatgtacttacaaatgcaaatgcagacatcttgtcaccccgagggccaaggcggcgatactactccaccagctccactgccggaaatcgagtgtttgctgattgctgagtgtatttttgtttgactgagtgttttatctcgggcactcggtaaagagattatttgcggagtgttctatttttgcactgtact

SEQ ID NO: 34128 - protein, 86 aa, Panicum virgatum
  misc_feature: Ceres CLONE 1955258-R
  misc_feature (10)..(75): Pfam Name: LSM Pfam Description: LSM domain
MAAVPVNPKPFLNNLTGKPVIVKLKWGMEYKGYLVSVDSYINLQLANTEEYIDGQFSGNLGEILIRCNNVLYVRGVPEDAQIDDAD

SEQ ID NO: 34129 - DNA, 1534 bp, Panicum virgatum
  misc_feature: Ceres CLONE 1955266
  misc_feature: Encodes the peptide sequence at SEQ ID NO. 34130
ggtctcggactctcggctacgcagaaaccctcgccgactcgccgtcgactcctctaaacccttcggctttccccatggcggccacggctaccgcgggggccgccgccgcaccgccgccgcggcagtgcaagctggacccgaggagcgagctgcgcgtggaggtgccccccgacgcgcccctccgcgtgcgcctcgtcgccggcacggcggagatcttcggcaccgagctgccccccgagggctggatccctattcctccccgctccaagatcgccattttcacttggcacggcgcgacgctggagcttgacggggtcaccgagagcgagtatccttccgaggagacgccaatggtggtttacgtcaacacacacgctattcttgacgcgcggagggcgagggcaagggctgctgcagcgcaggggggtgatttggaggcctcgcagggacctagagtgattgttgtgggaccgacagattcaggaaaaagtaccctctgcaaaatgctccttagctgggctgccaaactgggctggaagcctacgtatgtggatttagatatcggccaggggtctataacgatccctggatgtatttctgctaccccaattgagaaacctatcgatatagttgatgggattcccttggagatgccactggtttacttctatggccacccaactccaagtatcaatccggatgtttacaaagttcttatgaaggagctagctaaaactttggagaggcagttctctggcaatgctgaatctagggcagcaggaatggttataaataccatggggtgggttgaaggccttgggtatgagttacttctaaatgcaattgaaacttacaaggccaatgttgtgctggtactgggacaggagaaactctggaagatgttaaaggatgcagttcaaagcaagcccaacattgatgttgtaaaacttcagaaatcagagggtgttgtcctcagaaattcaaaatatcgccaaaagactagaagcttccgaatcaaggaatacttttatgggattgcaaatgatctggcgccacattcaaacattgtcaatttcagtgatgtctcggtgtacagaattggtggtggccatcaagctcctcgctcagcattgcctatcggtgcagagcctgtggcagatcctactcggcttgttgctgtcaacatcagcacggatatgatccatacagtgcttgctatttcttatgctaaggaacccgatgaaataatttctagcaatgttgccgggttcattcatgtcacggatgtggacatccaaaggaagaaactgacgtacattgcaccttgcccgggggacttgccgagtaggctgttgattgcgagctcgcttacatggtatgaagcctgatcagttcatgactgaagattgtagcatagatggcagtttgcccaggtagcggcatgttgtaaagccaggacatgtaacgctggaactgactgtactgtgttgcactgctaaccaacagaaacaacgagggcattttggttcaggcc

SEQ ID NO: 34130 - protein, 437 aa, Panicum virgatum
  misc_feature: Ceres CLONE 1955266
  misc_feature (163)..(436): Pfam Name: Clp1 Pfam Description: Pre-mRNA cleavage complex II protein Clp1
MAATATAGAAAAPPPRQCKLDPRSELRVEVPPDAPLRVRLVAGTAEIFGTELPPEGWIPIPPRSKIAIFTWHGATLELDGVTESEYPSEETPMVVYVNTHAILDARRARARAAAAQGGDLEASQGPRVIVVGPTDSGKSTLCKMLLSWAAKLGWKPTYVDLDIGQGSITIPGCISATPIEKPIDIVDGIPLEMPLVYFYGHPTPSINPDVYKVLMKELAKTLERQFSGNAESRAAGMVINTMGWVEGLGYELLLNAIETYKANVVLVLGQEKLWKMLKDAVQSKPNIDVVKLQKSEGVVLRNSKYRQKTRSFRIKEYFYGIANDLAPHSNIVNFSDVSVYRIGGGHQAPRSALPIGAEPVADPTRLVAVNISTDMIHTVLAISYAKEPDEIISSNVAGFIHVTDVDIQRKKLTYIAPCPGDLPSRLLIASSLTWYEA

SEQ ID NO: 34131 - DNA, 589 bp, Panicum virgatum
  misc_feature: Ceres CLONE 1955275-R
  misc_feature: Encodes the peptide sequence at SEQ ID NO. 34132
accaggggaacgccaccagcgtcgacccgctgctggacgccgcctacgcccgcacgctcaggtcgtcgtgcccctccgcggcggcgcccggcaccgtgaacctcgacggcggcacggcgctcaagttcgacagcagctacttcaccaacgtgctcaacaagcaggggacgctcgcctccgacgccgcgctcacgcagaacgccgccgcggcgcagatggtgcaggacctcaccaaccccatcaagttctacgccgccttctccatgtccatgaagaagatgggccgcgtcgaggtgctcaccggaaccagcggccagatcaggaagcagtgccgccaggtcaacagctcctgatcggccggccggccggccgccgccggcgagctcctccttccgtccctccctccctctccgcgattccttttggtttctcctgcctgccttcctcctctctcgttacaacgaccggccggcgcggatcaatatattccgttccgcgccggcgattgatcagctcgatcctcccaagatccattggtttgtcatgtgctcggttgtcttgcaaaatgtaaggaaaaaaaattaagatc

SEQ ID NO: 34132 - protein, 116 aa, Panicum virgatum
  misc_feature: Ceres CLONE 1955275-R
  misc_feature: SWISSPROT Homolog: EC 1.11.1.7 Peroxidase
QGNATSVDPLLDAAYARTLRSSCPSAAAPGTVNLDGGTALKFDSSYFTNVLNKQGTLASDAALTQNAAAAQMVQDLTNPIKFYAAFSMSMKKMGRVEVLTGTSGQIRKQCRQVNSS

SEQ ID NO: 34133 - DNA, 536 bp, Panicum virgatum
  misc_feature: Ceres CLONE 1955275
gacactgtcatctccaaacactcgcgagccagttcccggttcctccacttccacgactgcttcgtcaaggtccgtgccgcccctccctcctcctccctcaatcgttcgtccatccattattcttctgccccctcgcctccccaatcatgcccgtcagccagccgtcggtgcggtaggagaatcgtttctagttggttcgcctgtgcatttactcttgtcggcacggcatggcatggcgcggcgttcttgttccagaaacgcctgcttgcctgcccgcccgctcggcttcttcctcctcctccaggctccaggaattccgcatctccaaccgcattgatccgcaagagtctcccgctctctggcctggtcaggagccacccatgcagattcaggtcaggcgccggctggccacccaaatacagcagcagtacagcttcgcatacatgcccccatacacagattttttttttttgtttgaataatgcccccatacacagatacagtgtactcctgccggcagatttttaccatgggag

SEQ ID NO: 34134 - DNA, 565 bp, Panicum virgatum
  misc_feature: Ceres CLONE 1955277
  misc_feature: Encodes the peptide sequence at SEQ ID NO. 34135
tccgcatctcgcaccctcgccgctgctgctgcaattaacgccaccgccggccaacaacccgaaacctacctccgccgtggtcgccgcaaccgccgccaacatggcgagccaaggggagccgtcggcctccgcttcggatccgaaggggaagaaagactactctacggcgattcttgagagaaagaagtcgccgaaccgcctggtcgttgatgaggccaccaacgacgacaactccgtcgtcgctctccacccggataccatggagaggctgcagctcttccgcggtgataccgtgctccttaagggtaagaagaggaaagacactatatgcattgtccttgcggatgaaacctgtgaggaaccaaaggttcggatgaacaaggttgtccgccagaacctgagggtgaggcttggtgatgtggtttccgtccatcagtgccaggatgtgaaatatgggaagcgtgtacacattcttccaattgatgatacagttgaaggcattacagggaacctgtttgatgtcttcttgaaaccatacttcctagaagcgtaccgtcctgtgaag

SEQ ID NO: 34135 - protein, 154 aa, Panicum virgatum
  misc_feature: Ceres CLONE 1955277
  misc_feature (30)..(116): Pfam Name: CDC48_N Pfam Description: Cell division protein 48 (CDC48), N-terminal domain
MASQGEPSASASDPKGKKDYSTAILERKKSPNRLVVDEATNDDNSVVALHPDTMERLQLFRGDTVLLKGKKRKDTICIVLADETCEEPKVRMNKVVRQNLRVRLGDVVSVHQCQDVKYGKRVHILPIDDTVEGITGNLFDVFLKPYFLEAYRPV

SEQ ID NO: 34136 - DNA, 579 bp, Panicum virgatum
  misc_feature: Ceres CLONE 1955277-R
  misc_feature: Encodes the peptide sequence at SEQ ID NO. 34137
aggctacagatcttcagggcctgtctaaggaagtcccctgtggcgaaggaagtggacttgaatgctcttgctaagtacacccaagggttcagtggtgcagacatcactgaaatttgccagcgtgcagtcaaatatgccatcagagagaacattgagaaggacattgagagggaaaggcggagaaaggacaaccccgaggcaatggaggaggatgaagtggatgacattgctgaaatcaaggcagctcactttgaggagtccatgaagtatgcgcgccgcagtgtcagcgacgcagatatccgcaagtaccaggcgtttgcccagacgttgcagcagtcccgtggattcggcagtgagttccgcttctcggagcagtcaacgacagcagccaccacagctgcagctgatccttttgcatccactggtgcagccgatgatgacgatctatacagctaggtttcttgttgggttgttgctggttggttctggattgtgttcaatatcagtcgcttcagtcatctgtttaaaactaatcatacattagacacgagatgccctgcaatgatatttatgttccgc

SEQ ID NO: 34137 - protein, 151 aa, Panicum virgatum
  misc_feature: Ceres CLONE 1955277-R
  misc_feature: SWISSPROT Homolog: EC 3.6.4.3 Microtubule-severing ATPase
RLQIFRACLRKSPVAKEVDLNALAKYTQGFSGADITEICQRAVKYAIRENIEKDIERERRRKDNPEAMEEDEVDDIAEIKAAHFEESMKYARRSVSDADIRKYQAFAQTLQQSRGFGSEFRFSEQSTTAATTAAADPFASTGAADDDDLYS

SEQ ID NO: 34138 - DNA, 601 bp, Panicum virgatum
  misc_feature: Ceres CLONE 1955285
  misc_feature: Encodes the peptide sequence at SEQ ID NO. 34139
cttcgaattctcctccccttctcctccgcagcgccgaacccagccacacgccagcgcgagctaagccaaggcgaacccaagccaagcggagcggagcaagggtttgtttgctcgcccccatccgaccgcagagacacccccccagaggttctgctcctgagcgcaggaagcctggcgacctgccatggacctggtgggaccgttgctggtggccatggccggcttgcttgacgcccccggcctcccgttcttcggctggctcatcaccgcgggctccttcggcctcgccgcgctcatctactcgctcctccgcctgcagcgcgaggcctcgctctactggaccaaggcggccgccagggagaagcgcgccgcctggaagaccctgcggtgcccgagctccagccacacctggaccgaggactacttccgcggcggccagccgtcgacgtgctgcgcgtgcctgtcgtccctcggctccgcgcagggcgtggtgggctccagggccgccgaggccgacgtggtccaccgctgctctgtttgcggggtggccgcgcactcctactgctccaggggcgccgacaaggactgcaagtgcgtcgcg

SEQ ID NO: 34139 - protein, 138 aa, Panicum virgatum
  misc_feature: Ceres CLONE 1955285
  misc_feature: SWISSPROT Homolog: EC 2.7.1.107 Diacylglycerol kinase
MDLVGPLLVAMAGLLDAPGLPFFGWLITAGSFGLAALIYSLLRLQREASLYWTKAAAREKRAAWKTLRCPSSSHTWTEDYFRGGQPSTCCACLSSLGSAQGVVGSRAAEADVVHRCSVCGVAAHSYCSRGADKDCKCV

SEQ ID NO: 34140 - DNA, 582 bp, Panicum virgatum
  misc_feature: Ceres CLONE 1955285-R
  misc_feature: Encodes the peptide sequence at SEQ ID NO. 34141
tgggcatgccgcagcaatcatgagtgaggtcctcgtcaatgctgagtgcaatggtgtgatcgacgcagctcagaagagattgctcctccatgagatagcactccgcttatcctcctgacacactgtccgctcctcttgtctgacaaaagctaacgccatgttatattgactgataccaagcatgatgaatcgcttccgttgcacagacacagagcacatatggccgagttgatgtatacaatacaaagaggaaatagaagatttcccacgttctcatttgactgtacctaaaagatagttctgcttctttgtggcttggctcatctgagcagcagttgaaagtggctgtcaagttgagagagtgccagtccacacaaagagttttgtagtgcatagaacactttgtaactacaaatagggctcaatgagcagtgtatctagagtgtgtgtcagtgtttttttgctccgaagatatggatacaaagtgtaaccagacttctccgagaagatctgtaatttagctatctttgataggtgatattttgttgtgctgtcgtggagaaattcgtagttacataatct

SEQ ID NO: 34141 - protein, 38 aa, Panicum virgatum
  misc_feature: Ceres CLONE 1955285-R
  misc_feature: SWISSPROT Homolog: EC 2.7.1.107 Diacylglycerol kinase
GHAAAIMSEVLVNAECNGVIDAAQKRLLLHEIALRLSS

SEQ ID NO: 34142 - DNA, 635 bp, Panicum virgatum
  misc_feature: Ceres CLONE 1955298
  misc_feature: Encodes the peptide sequence at SEQ ID NO. 34143
gccatcgacccccccaactcgccatccctcctcccccactccggcggggacctacacccatctcgctcgtacgtcttcctcgtatcagaggatgatgatgccccagagcggcggcagcctcgatctcgggctcagcctcgggctcacctcccagggcagcctctcctcctccaccacctccggcgcgctctccccctgggccgccgccctcagctccgtcgatggggacgcgatgacgaggagggacgcgcacgcgcagcagcacggcgccgccgcggcggcgatggatcccgaccgcgcggcgatgcgcgcgtccacgtcgcccgacagcgccgccgcgctctccagcggcgccagcggggacaacaacaagcgggagcgcggcgagctcgagcgcaccggctccggcggcgtgcgcagcgacgaggaggacggcgccggcggccgcaagaagctgcgcctctccaaggaccaggccgccgtgctcgaggactgcttcaagacgcacagcacgctcaatcccaagcagaaggtcgccctggccaaccgcctgggcctgcggccgcggcaggtggaggtgtggttccagaaccgccgcgcccgcaccaagctcaagcagacggaggtcgactgca

SEQ ID NO: 34143 - protein, 180 aa, Panicum virgatum
  misc_feature: Ceres CLONE 1955298
  misc_feature (119)..(173): Pfam Name: Homeobox Pfam Description: Homeobox domain
MMPQSGGSLDLGLSLGLTSQGSLSSSTTSGALSPWAAALSSVDGDAMTRRDAHAQQHGAAAAAMDPDRAAMRASTSPDSAAALSSGASGDNNKRERGELERTGSGGVRSDEEDGAGGRKKLRLSKDQAAVLEDCFKTHSTLNPKQKVALANRLGLRPRQVEVWFQNRRARTKLKQTEVDC

SEQ ID NO: 34144 - DNA, 595 bp, Panicum virgatum
  misc_feature: Ceres CLONE 1955298-R
ccttcccaatttgcccctcctgccgccgcgtcgccgccgccagcgcccctgccgctaatcaccaccagcaatgccaccccaaatttaacgctgccgctgccggcaacgtcgtgcccagccactgccagttcttcccggccgccgtcgaccggacagggcagagcacgtggaacgccgccgccgcgccgctcgtcaccagggagctgttctaaggtcgatcggatggatcgatctcgccatggtgacgtcaaccaagtgcggaaggcgatggatcgaccgattcgacggttgattagaaggacaaactctgattagtatcttggcggtcgcagtaattaattacgattaatcaggagagcagattttcttttggtttcctttttttccttttcttttcgattaattaattcatcagttgggtttctgaaaacgacgacgacgacgaagaaggatgaacaacaaacaaagatggctgtctgctttttcctggacggcgtgtaaaccagttcacctaatctgctggttggtgaaataacagcgtgattgattgtactaattgattggtgaagaaagttaatggaaatcaaatctttac

SEQ ID NO: 34145 - DNA, 1255 bp, Panicum virgatum
  misc_feature: Ceres CLONE 1955316
  misc_feature: Encodes the peptide sequence at SEQ ID NO. 34146
ctccctctctcctccccgccgccccgccgcctctccccgcccgccgccgcgatggaggttctccacgaggagatgcccttcgacctcgacttccacccgtccgcccccctcgtcgtcacgtccctcatcaccggcgagctctgcctgtttcgctacggcccggagtcggagcctgagaggttgttttcggtgaaagctcacaaggagtcatgcagagctgttcgctttgtggactcaggaaaagtgatcttgtcggggtctgctgattgctcagttcttgcttcggatgtagaaacaggcaaggccattgcccgcttggaggatgctcacgaggatggcataaaccgccttatctgtcttactgaaacaacaattgctacaggtgacgatgaaggctgcattaaggtgtgggatacacgggaacgttcttgctgcaacacttttcatgtccatgaagattacatttcagatatgacctatgtggccgactcaaatcaaatactggcaacaagtggggatggaactttgtcagtgaacaacctgcgtaggaataaagtaaaatcacaatctgaattttcagaagatgagttgctttccttggtggtaatgaagaacggtaaaaaggttgtttgtggaactccaagtggagcactgttattatattcmtggggatactttaatgattgcagtgaccgctttctgggacacacacagtctgtggatacaatgctgaagctggatgaagaaactctgatatctggtgcatcagatggtgtgatcagattagtgggcatcttacctaataggataatacagccacttgctgaacattcagaatatcccattgaggcccttgctttctcaaacgataagaaatatctaggaagcctttcacatgataaaatgcttaagctatgggacctgcaagagctcttgaatggctcacaggtagttaatggtggtgaacctgttgagtctgctagcgatggtagtgatgacgacgacaatgatgacggcatggatgtagacatggcacctccctcttcaaaaggatcaaggagtaagaaggcaggcaaaggtcagagttcaagtagaccggcatcagatttctttgcagatttataagcgccatgctcccaaagcagaagctgtgagttgtattatttttgaggcttttacttgtgtgccattataaattgttgaaatgacctacatgccattcaaattttaaaaagttcctctatatcctacatcg

SEQ ID NO: 34146 - protein, 357 aa, Panicum virgatum
  misc_feature: Ceres CLONE 1955316
  misc_feature: SWISSPROT Homolog: EC 2.7.11.7 [Myosin heavy-chain] kinase
MEVLHEEMPFDLDFHPSAPLVVTSLITGELCLFRYGPESEPERLFSVKAHKESCRAVRFVDSGKVILSGSADCSVLASDVETGKAIARLEDAHEDGINRLICLTETTIATGDDEGCIKVWDTRERSCCNTFHVHEDYISDMTYVADSNQILATSGDGTLSVNNLRRNKVKSQSEFSEDELLSLVVMKNGKKVVCGTPSGALLLYSWGYFNDCSDRFLGHTQSVDTMLKLDEETLISGASDGVIRLVGILPNRIIQPLAEHSEYPIEALAFSNDKKYLGSLSHDKMLKLWDLQELLNGSQVVNGGEPVESASDGSDDDDNDDGMDVDMAPPSSKGSRSKKAGKGQSSSRPASDFFADL

SEQ ID NO: 34147 - DNA, 512 bp, Panicum virgatum
  misc_feature: Ceres CLONE 1955326-R
  misc_feature: Encodes the peptide sequence at SEQ ID NO. 34148
ggctaacttcatggataataagcttgtcaagccgttatggctggcacactggactgagggcgaggtgcagaagggatttgcgaaagaggccaaggagatcctggcgcttctagaggtgcaggtcagggggaagaggttctttgggggtgacaccgttggctacatcgacatagtctttttttggttagctccttggctgagtgtggttgaggaggtgactggaatgactgtggtagaggaaagcgagtaccctgctttacggcagtgggtaaaggagtacaattcctgtgaagctttgaagccgtgcttgccagacagagaccaactcgtcgcgttcttcattgaaaacaaggagaggtacaaaatgtacgccaatgcatgggcgcagcagtaatatgttgtgtgcaagaatacgagtcaacgtgtggacggaataatgtacgagaatcacatatttcctttgcgggaataacattggcgtgcctaaataaacatgaccatgtctcaggcgg

SEQ ID NO: 34148 - protein, 130 aa, Panicum virgatum
  misc_feature: Ceres CLONE 1955326-R
  misc_feature: SWISSPROT Homolog: EC 2.5.1.18 Glutathione transferase
ANFMDNKLVKPLWLAHWTEGEVQKGFAKEAKEILALLEVQVRGKRFFGGDTVGYIDIVFFWLAPWLSVVEEVTGMTVVEESEYPALRQWVKEYNSCEALKPCLPDRDQLVAFFIENKERYKMYANAWAQQ

SEQ ID NO: 34149 - DNA, 535 bp, Panicum virgatum
  misc_feature: Ceres CLONE 1955326
acctctacggagatgaaatttggacggtcagttcttcccccccgccgtcgtctcgcctcatgccggcatgccctaacctcgtcgatacaaatcggatctcgccgctgaccatatggatcatagtctcgcattcttccttgtccgcatcgccttttcccttccaccttgctggtgccggcgccggatcacacccgcaatagccctgaccaccgattgaaaccctagccgcgccgccgcccgccgtcggggcgctcatcgactgtccacacgtcacttctacccgggctttttgaggtgtttgcattccaccatgtttgtcgggccaagggaccgatgatattttttttattgttgttttgtggactgaagcaaccaatcaagcttcttcctggtcagatgatcgtctaaagaaaagtaaatgaaagaaacaagaagagcttgctcttcatggagaagaactaagccttcttgattaccgctcttataaataacgggaatggtttagtaagatagccgcgagttggaaagatagcag

SEQ ID NO: 34150 - DNA, 523 bp, Panicum virgatum
  misc_feature: Ceres CLONE 1955332
  misc_feature: Encodes the peptide sequence at SEQ ID NO. 34151
gaatctcgcttctcacacccctttcccactccccgtcgcgatcggtcgccagcaactgctgggcttcgcttcaggagtctcttccggacgcggcaacatgggtggagaaaggggaggagggatggaggtggacctgtcgcaaggggccgtggcggcgatgtcgcgccaccaggaggaggggctgcgcccggtgctgcaggtggcggacgagccgcggctcgtcggctcctccgcggtggcggccaagtaccgcctcgtgctctccgacggcgcgcacctgctgcagggcgtgctcgccacctccctcaaccacctcgtcgccgacggcgcactccgccgcggtagcgtcgtacgcgtcgtcgactacgtctgcagatgcatccggaaccagagggccattgttgtgatccaacttgaggtactgcaagctgagtgtgcactgatcggcagtccgacaactcaacttaatgctatgtcctgttctagtagcctgggcaacgaaccttgcttcattcaaggggct

SEQ ID NO: 34151 - protein, 141 aa, Panicum virgatum
  misc_feature: Ceres CLONE 1955332
  misc_feature (12)..(111): Pfam Name: Rep-A_N Pfam Description: Replication factor-A protein 1, N-terminal domain
MGGERGGGMEVDLSQGAVAAMSRHQEEGLRPVLQVADEPRLVGSSAVAAKYRLVLSDGAHLLQGVLATSLNHLVADGALRRGSVVRVVDYVCRCIRNQRAIVVIQLEVLQAECALIGSPTTQLNAMSCSSSLGNEPCFIQG

SEQ ID NO: 34152 - DNA, 527 bp, Panicum virgatum
  misc_feature: Ceres CLONE 1955332-R
tggatgcgttggatgtgagccatcatctcttgaaacagattgacaacagtttgaatggcgtttcatgctctgctcccaaggacgctttgtcctacaacccaaatgttggtggtgccggtttgggagccggacagggcatgcagacctccagtcatgcctgtggctataccactggtgtgggtggtgcaggtccagtctgtcagtaattagtgaccgtgatggcctgtgttttatatgcagtcagcctgagcactgggctatgaagtatgaactgccctgtccgagctacttggccggctgctaaacacctgtcagatgaagtggttctatgaagtttgcttttgctttagcacctactctataatgtaccgtatttatattgtgacttgtgatcatcttttttttcttcttctttttgagggcaacttgtgagcatctagttatgtcctgggaacatagtatgtcgcgttactctggaacgaatgttagtaagcacttcaagttaatcttatgctctagactgtttg

SEQ ID NO: 34153 - DNA, 1184 bp, Panicum virgatum
  misc_feature: Ceres CLONE 1955347
  misc_feature: Encodes the peptide sequence at SEQ ID NO. 34154
ggcgggttggtgatgcccgtttgccgcttcctctagcgacgcacgagcgtcgaataagaatttcgcatatccatccatccatccggtcgccatccccgaatcctcaacaacgcgtcgccgggcggctggggaaagaaaccgcgttccgtcgttgcaaccaacagcagcttcaaagcctcttccttccttcgccacgaatcaaatccccaacccctagcggacaagacttcccaatcccacgcgcagcggcagtcgccgctggatcggagtcggaggacaccaaccactcgtcgccggcctcttcctccccgcccgccggtcaccatgagcttcatcttcggcaagaagaagaccccagccgagctgctgcgggagaataagtggatgctggagaagtcaatcagggagattgagagggagaggcagagcctgcagaaccaggagaagaagctcatcaacgagatcaagaaggtggccaagcagggacagatgggagctgtaaaaatcatggcgaaggaccttatccgcacaaggcaccagataacaaaattttatgccctgaaatcccagctacaaggtgtatctcttcgcattcaggcactgaaatcaacacaagcaatgggtgaagctatgaagggtgtcacaaaagccatgggacaaatgaacaggcagatgaatctgcctgctctgcagaagataatgcgggagtttgagatgcagaatgagaagatggagatggttagtgaagtgatgaatgatgccattgatgaggcattggagggcgacgaggaggaggaagagacagaagagctagtgaaccaagtccttgatgaaattggcattgatgtcaactcagagcttgtcaaggctcctgccacggcagttgctaaaccggtcgcagcgggaaaagttcctgctcaagctgaagccgcaggcgaggcggatggtggaatagatgatgacttgcaggcgcggcttgataacctgaggaagatgtgatgattggagtctgacaaaatattcacacgctttgtttgtagttttgtacctcaaatatagccattgcggcaaaccttttggcattggccatttgtacataggatagaatatatctggtactgtgatctaggctttgacatatatacatattcctaattccattgggtgcacttcggttttgattc

SEQ ID NO: 34154 - protein, 224 aa, Panicum virgatum
  misc_feature: Ceres CLONE 1955347
  misc_feature (17)..(187): Pfam Name: Snf7 Pfam Description: Snf7
MSFIFGKKKTPAELLRENKWMLEKSIREIERERQSLQNQEKKLINEIKKVAKQGQMGAVKIMAKDLIRTRHQITKFYALKSQLQGVSLRIQALKSTQAMGEAMKGVTKAMGQMNRQMNLPALQKIMREFEMQNEKMEMVSEVMNDAIDEALEGDEEEEETEELVNQVLDEIGIDVNSELVKAPATAVAKPVAAGKVPAQAEAAGEADGGIDDDLQARLDNLRKM

SEQ ID NO: 34155 - DNA, 1331 bp, Panicum virgatum
  misc_feature: Ceres CLONE 1955354
  misc_feature: Encodes the peptide sequence at SEQ ID NO. 34156
agcacattcctaccctctagctaagctaataccaccaccaccagcagcagcagccatggcggcgagcggcaagaagctcccgccgttcctcttcacgctgctgcttctgctctccaccgccgtgacgcccatcctctcgctgccggccgccgaccacgaggtcgactgcgactgcgacaagcccaaggcgcccaagccgtcgcacccgcccaagacaaaaccctcccacccgtcgcccaagcccaagaaccccaagccgcccaagggcccctcctacccgtcgccggcgacgcgcccgcccaagggccgcccctccaacccgccgatcactcgtcctcgtccgccggtcgtcggcccccccaagggccccgtcacgcgcccgccggtcgtggggccaccggtcacgcgcccgccggtcacacgtccgccggtcgtcatcagcccgccggtgacctacccaccaccgattaccggccctccgacgacgacgccaccggtcactggcccaccggtcacggtccccccgatcaccggcccgccctcgacgacgcctccggtcaccggcccgcccttgacgaaccctcccggcggtggaagctcgacgccgtgcccgccgcctcctcccgcgaccccgactccgacgccgtcgtcgccgacgtgcccggcggactcgctgaagctgggcgcgtgcgtggacctgctgggcgggctggtgcacgtcgtgctcggcgaccccgtggtgaacaagtgctgcccgctgctggagggcctggtggagctggaggcggccgtgtgcctctgcaccaccatcaagctcaagctcctcaacatcaacatctacctgcccctggcgctccagctcctcatcacctgcggcaagacgccgccgcccggctacacctgcaccgtctgatcgatcaatgcaactagctagtaacccttgcacaatgcaggggttttggagtgagtttcttctgtaatttgaagagagatcaaccgacatgagaggatgtcatcgtctgcttcttcctagctatggtagctgtgtttagttgtttttctgttgtggttcgatcgatctcaggttctcgaccggcctgttaagtcgtttcagactttcagttaatttggctggccctcggcagcttgattgttggtgttggtgtggtttcagtttgattcgagagagtcgttgatggctgatttctactgccatcaggtgacgatgaagagattgcatgtccccaataatttttgcacttgttttcccgtgtgatttgtgcttgcttgcttgtggaacttattaattagttctagcactctcaactctc

SEQ ID NO: 34156 - protein, 285 aa, Panicum virgatum
  misc_feature: Ceres CLONE 1955354
  misc_feature (202)..(283): Pfam Name: Tryp_alpha_amyl Pfam Description: Protease inhibitor/seed storage/LTP family
  misc_feature: Functional homolog of the protein sequence given in SEQ ID NO 50191
  misc_feature: Useful for making plants with modulated salt sensitivity
MAASGKKLPPFLFTLLLLLSTAVTPILSLPAADHEVDCDCDKPKAPKPSHPPKTKPSHPSPKPKNPKPPKGPSYPSPATRPPKGRPSNPPITRPRPPVVGPPKGPVTRPPVVGPPVTRPPVTRPPVVISPPVTYPPPITGPPTTTPPVTGPPVTVPPITGPPSTTPPVTGPPLTNPPGGGSSTPCPPPPPATPTPTPSSPTCPADSLKLGACVDLLGGLVHVVLGDPVVNKCCPLLEGLVELEAAVCLCTTIKLKLLNINIYLPLALQLLITCGKTPPPGYTCTV

SEQ ID NO: 34157 - DNA, 1267 bp, Panicum virgatum
  misc_feature: Ceres CLONE 1955358
  misc_feature: Encodes the peptide sequence at SEQ ID NO. 34158
aggttaaagcgacggcgctgcccccagccgtccgccttgcccttcctcttccccgaaggcctggtcctcctcctcctgccacctccactaacattccgccagctagggttaggcaccccccgcagcagcgatggcgatcaagcggaccaaggcggagaagaagcaggcgtacgaccgcaagctgtgcagcctgctggacgagtacaccaaggtgctcatcgccctcgccgacaacgtcggctccaagcagctccaggacatccgccgcggcctcaggggcgactcggtcgtgctcatggggaagaacacgctcatcaggcgctgcatcaaggcctacgccgacaagaccgggaaccacaccttcgacccgctcatggacctcctcgtcggcaacgtcgggctcatcttcaccaagggcgacctcaaggaggtccgcgaggaggtcgccaagtacaaggttggcgctcctgctcgtgttgggctggtcgctcctgttgatgttgttgtcccccctggcaacactggcctggatccttcccagacctctttcttccaggtgctcaacatcccaaccaagattaacaagggtactgtcgaaatcatcacccctgtggagctcatcaagaagggtgacaaagtgggctcatctgagtctgccctgctcgccaagcttggtatccgccccttctcgtacggtcttcagatcaccaatgtctacgaggatgggtccgtattcagccctgaggtgctcgacctgaccgaggaggacctggttgagaagttcgccactggtgtctccatggttgcctctctgtccctggcgctctcgtacccaacccttgctgctgcaccccacatgttcatcaatgggtacaagaacgtgcttgccgttgctgtggagacggactactcatacccgcatgctgacgagatcaaggagtacctcaaggacccgagcaagtttgccatcgctgcccctgtcgccgctgcagactccggtgctgctgctgctcccaaggaagaagagaaggcacctgagcccgccgaggagtcggacgaggagttgggcttcagcctgttcgacgagtagagctgctctagcatagcccgcgctgctgcaagtttttggcctttgcttatgagacactacaccagagtactatcaccctattatttagcgtaccttgtttctagtagacaaagaactcagttgtgtccctacctagtgtgtaatcgacgatggtaatggtaatctggtatgttaagc

SEQ ID NO: 34158 - protein, 319 aa, Panicum virgatum
  misc_feature: Ceres CLONE 1955358
  misc_feature: SWISSPROT Homolog: EC 4.2.99.18 DNA-(apurinic or apyrimidinic site) lyase
MAIKRTKAEKKQAYDRKLCSLLDEYTKVLIALADNVGSKQLQDIRRGLRGDSVVLMGKNTLIRRCIKAYADKTGNHTFDPLMDLLVGNVGLIFTKGDLKEVREEVAKYKVGAPARVGLVAPVDVVVPPGNTGLDPSQTSFFQVLNIPTKINKGTVEIITPVELIKKGDKVGSSESALLAKLGIRPFSYGLQITNVYEDGSVFSPEVLDLTEEDLVEKFATGVSMVASLSLALSYPTLAAAPHMFINGYKNVLAVAVETDYSYPHADEIKEYLKDPSKFAIAAPVAAADSGAAAAPKEEEKAPEPAEESDEELGFSLFDE

SEQ ID NO: 34159 - DNA, 617 bp, Panicum virgatum
  misc_feature: Ceres CLONE 1955361-R
  misc_feature: Encodes the peptide sequence at SEQ ID NO. 34160
ttggtggacgttcggcatcttcctgcacgagctcatgtacggcaagacgccgttcaaggggcagacgaaccgcgccacgctgttcaacgtcgtcggccagcagctcaagttccccgactgccccgggacgagcaacgctagccgggacctgatcaggggcctgctgtccaaggagccccagagccggctcggcgtcaagaggggcgccgccgagatcaagcagcaccccttcttcgagggcgtcaactgggcgctcatccggtgcagcaccccgcccggagtgcccagggccgtcgagcccgccgccgcggtggcgatgccggcgccggtgaagcccgcgccggtggcgaaggtggagatcaacagcggcagcaagaggatggcaggagccggtgtcgagtccggagggaagttcctagactttgagttcttttaggaaattaggaagctttaacgcacaatatttgtgatcccagaggtaggtatagttgcatacttgcatagtggagtgctagcattttggccagtgatctgatgtgtctgactggtttcagttctatgttgcattacctcactctgttgttagacatccatgccatggcactagttagttactt

SEQ ID NO: 34160 - protein, 144 aa, Panicum virgatum
  misc_feature: Ceres CLONE 1955361-R
  misc_feature: SWISSPROT Homolog: EC 2.7.11.1 Non-specific serine/threonine protein kinase
WWTFGIFLHELMYGKTPFKGQTNRATLFNVVGQQLKFPDCPGTSNASRDLIRGLLSKEPQSRLGVKRGAAEIKQHPFFEGVNWALIRCSTPPGVPRAVEPAAAVAMPAPVKPAPVAKVEINSGSKRMAGAGVESGGKFLDFEFF

SEQ ID NO: 34161 - DNA, 596 bp, Panicum virgatum
  misc_feature: Ceres CLONE 1955361
aatgcagcagcagccgtcacgctcacagcacgccaagcaccacccacacccaggagcggcgaggcacacgcgcttccgcacccaggtgctggaggcgcccctggatcccggatccgaccccgagtaccaggatttccagttccgcttcgtcccggagatgttcgagctccagatgggcggcgtcggcggcggggggaacggtgagggcaaggtgacggagaaggttcttgagttcgagttcgacaaggtccggatcagcattgcgtccagcgacgacgaggcgggcggggacgcgccgcccaggagctccttctccggggcgagccacccgccggagccggtggacgagatggacgccgtcttcgtcgccgtcgacggccgcgacaaggcgccggccccgaagccggccgtctcgtgggacgcgtccccgcccccgagcggcgccgcgagcccgcacagcagcatcgacagctccggcgccgcggccacggtgacgagcgtcgccccgagctgcaccgtcaccagccggagcgccaagaccagcgtcagcagcagcgcggccagcgacggcagcggctgggacagcggcgccggcg

SEQ ID NO: 34162 - DNA, 556 bp, Panicum virgatum
  misc_feature: Ceres CLONE 1955364-R
  misc_feature: Encodes the peptide sequence at SEQ ID NO. 34163
tttattccacctgtcatacacagagacttcaagagcagcaatatttttttggataaggacttccatgcaagagtttcagattttggtctagccaaacttggatctgatagagctggtggtcatgtcaactcaagttttaggcacacaaggtaatgttgcgtacctcaagtgtttattgatgacacatgatctattggatttgattgtctttttctgtttacaaaacttgtacaaaattatgaagatgacattatgagttttttttgctaatcttgtgccagaattataatgctaaaatgggcttcatgggttggaattgtaatctgtaatgggatgtggtgggccagaatttttatgggctgtgtagatctagtgggctataaatgtggccacatcatcatctatatcgtccacgaaggtaggcatgtcatcatccacggaggtaggcatgtcatcatccacggaggtagccacatcatcgtccatgtaggcagagttgagcagccacgtcgtggtgatgcaattcacgacaatttttatgacgtttattttagtc

SEQ ID NO: 34163 - protein, 50 aa, Panicum virgatum
  misc_feature: Ceres CLONE 1955364-R
  misc_feature: SWISSPROT Homolog: EC 2.7.11.1 Non-specific serine/threonine protein kinase
  misc_feature: Functional homolog of the protein sequence given in SEQ ID NO 50301
  misc_feature: Useful for making plants with modulated heat sensitivity
  misc_feature: Functional homolog of the protein sequence given in SEQ ID NO 50265
  misc_feature: Useful for making plants with modulated drought sensitivity
  misc_feature: Functional homolog of the protein sequence given in SEQ ID NO 50524
  misc_feature: Useful for making plants with modulated nitrogen use efficiency
FIPPVIHRDFKSSNIFLDKDFHARVSDFGLAKLGSDRAGGHVNSSFRHTR

SEQ ID NO: 34164 - DNA, 552 bp, Panicum virgatum
  misc_feature: Ceres CLONE 1955364
acactccacactgagatcccctcctgcctcctctctcgcagcgtcctccctcctgccctctatggatggcggcggcgcaagccccggcctcatcgccgccccttcctactctgcctctacgcacggcggcggcgcaagcccggcagaggctggcctctgcgcacggcaacggagaccctacgaaggcgtcgcgcacgcgcctcccgctggagccgaggcctcagtgagcgccagctgctcaagctggccggacgtgtggctggctggacctgtgctcgcctgcctcccgaagccccacctcacgggctggtctgcggcggtggcggatctcctctcttcaaatctgctcgcggacgcggcgccggagtagccccgactccctcccccgatgcatccggccccactggcaagatccgtcgccgtcgtccaccccggcccgctcgcaggagtgggggcgcgagcccttctcagtagcgctgcgccgccgggtgaggtcaggcgcctcggaggccgcgagtccattgccagcaagccctcctcatcgtccccccg

SEQ ID NO: 34165 - DNA, 523 bp, Panicum virgatum
  misc_feature: Ceres CLONE 1955395
  misc_feature: Encodes the peptide sequence at SEQ ID NO. 34166
agtgctcctcctgcgccgccgcctccactcctctcctctcttcgtctcgtctagctcccctccccggatcgggaggcgtatccgcccttatcccagtgtgatattcaaaaggaagtcaagatggtgaagttcacagcagaagagctgcgacgcattatggacaaaaagcacaacatccgtaacatgtctgttattgctcacgtggaccacggcaagtctacacttacagattctctagtggcggctgctgggattattgcccaggaagttgccggtgatgtccgcatgactgatactcgtgcagatgaagcagaacgtggtatcacaattaaatccactggtatctctctttactatgagatgactgacgagtcactcaagacatacaagggtgccagagatggtaatgaatacttgatcaaccttattgattcacctggacacgtggacttttcgtctgaagtcacggctgctcttcggatcacttgatggggctctggttggggttgactggattgagggt

SEQ ID NO: 34166 - protein, 122 aa, Panicum virgatum
  misc_feature: Ceres CLONE 1955395
  misc_feature (17)..(122): Pfam Name: GTP_EFTU Pfam Description: Elongation factor Tu GTP binding domain
  misc_feature: SWISSPROT Homolog: EC 2.7.7.6 DNA-directed RNA polymerase
MVKFTAEELRRIMDKKHNIRNMSVIAHVDHGKSTLTDSLVAAAGIIAQEVAGDVRMTDTRADEAERGITIKSTGISLYYEMTDESLKTYKGARDGNEYLINLIDSPGHVDFSSEVTAALRIT

SEQ ID NO: 34167 - DNA, 441 bp, Panicum virgatum
  misc_feature: Ceres CLONE 1955395-R
tggaggctggctcgcaggcggcacagcttgttttggatatccgtaagaggaaggggctgaaggagcagatgacccctctatctgagttcgaggacaagctctaggattttatcgtacgctttctgcttcttgggccagttaccctgtagtttgagccttatgcatcgccggagaactttccttttgtttttattgcatttatttgtcggattgcttgtgtttgacgtgactatggttatagcccgtgctactggaactacatttttctatctcttatgctatagcagatttgcaacatagcttgaacctgttgtgatctgtgagttgtagcttttgcctcgatgtgatgtttctctgtttcttcttttatttgggttatgtcaaatttttttgttgttgaaagaaatacacctgataggggctaaaagagccattatgtcg

SEQ ID NO: 34168 - DNA, 509 bp, Panicum virgatum
  misc_feature: Ceres CLONE 1955403-R
  misc_feature: Encodes the peptide sequence at SEQ ID NO. 34169
acttgaccgacatgggaacaagaaagccggtggtatcctcgcaatggcgaaggttgcagctccaaatatggccctgaaggtccttgacatggcaatgcaagttcacggtgcagctggtgtctcttcggataccgtcttatcgcacctatgggcaactgccaggacactgcggatcgcagacggccctgatgaagtccatctcggaacgattgcaaagctggagctgcaaagagcaagattgtaagtactacggacaggatgaagtaaagtttcgagaataaacgaagtaacagcaatctgctcacgagactagggaatggcagcatcactggtagtggttgatagacaatgagtaaataatggcgctgtagccatcaatgtgtgttgtacaattgccctgttagtggcattgcatcgatatatctgtccacgaaactgatcttttcaatcttggcgctgccgtacagtcatgagcagtagatttgaacatcgatcggctgtaacagtgc

SEQ ID NO: 34169 - protein, 80 aa, Panicum virgatum
  misc_feature: Ceres CLONE 1955403-R
  misc_feature: SWISSPROT Homolog: EC 1.3.99.21 (R)-benzylsuccinyl-CoA dehydrogenase
LDRHGNKKAGGILAMAKVAAPNMALKVLDMAMQVHGAAGVSSDTVLSHLWATARTLRIADGPDEVHLGTIAKLELQRARL

SEQ ID NO: 34170 - DNA, 403 bp, Panicum virgatum
  misc_feature: Ceres CLONE 1955403
ctctcgggcctcgcagtgtcctccccttctcgtctcctctccctcggttccgcccccctccaggctcccgctgctgccggcgacgatggcgaagctcatctcggagctgctgtggcctgtggacccggcgcacgcgctggacgaggcggcgctgctgcgctacgcggtcgccaacgttccgggcttcccgggccccgcgccgacgctggcgctcacccagtttgcgcacggccagtccaaccccacctactgcatccaggcctccgctcccgggggagggaccaggcgctacgtcctgcggaagaagccgcccggggccatcctccagtccgcgcacgccgtcgagcgcgagtaccaggttctcaaagctctgggttctcacacggatgtccctgtcccaaag

SEQ ID NO: 34171 - DNA, 608 bp, Panicum virgatum
  misc_feature: Ceres CLONE 1955407
  misc_feature: Encodes the peptide sequence at SEQ ID NO. 34172
acgtcgattcgccgccgctgctcccccaccgccagccgcggaggacatagcgatggcgtccactttctccttcccggagatgacgccggctcagctcgcggaggcgctgcacaccttcggcatcgcgcccaccgccaacctccgcgccgaggacatcgccaccccgcagctcgacctcctccccggcgtcctctccctcttcctcgccaccatcgtcggcgacgaccccgacgaccagctagggttcgacctgctgcagaagttcgacaacccggagcaccacatgggcgccataggccttagtcgcatttaccggagggcacgggacgtccttgagtccatccacttcgggggcctcacgttccgcgacctcacccgccccgaaccgcgccgcgtcgtctacatcctcagcgccatcgtcaactacctccacttcaggcacgagaggctcgccctcctcaaccccatcgcagaagaggtctccagcgttgacgagcgcctcccggagggcaaggctaggatcgccgagctccagaaggcgaaagaggatcatgcgtccaaggagcagatggacgagcctgccgtccagcagcgccaggcggaggtca

SEQ ID NO: 34172 - protein, 185 aa, Panicum virgatum
  misc_feature: Ceres CLONE 1955407
  misc_feature (2)..(146): Pfam Name: Nuf2 Pfam Description: Nuf2 family
MASTFSFPEMTPAQLAEALHTFGIAPTANLRAEDIATPQLDLLPGVLSLFLATIVGDDPDDQLGFDLLQKFDNPEHHMGAIGLSRIYRRARDVLESIHFGGLTFRDLTRPEPRRVVYILSAIVNYLHFRHERLALLNPIAEEVSSVDERLPEGKARIAELQKAKEDHASKEQMDEPAVQQRQAEV

SEQ ID NO: 34173 - DNA, 695 bp, Panicum virgatum
  misc_feature: Ceres CLONE 1955407-R
aaatggcaatgcataaagtccaggacaaaaccaatactcttcagatgtatacaaaggtccatgagaaactatcaaagcatctctctaaaatcgatgctctacatgaaacgagcaatgctgctaaagcttctgagaaggaggttaaatcactcaaagccaagattagtgatcaaagtttggagatgaagacccttcatattaaagctgatgaatggcaatcaaaagtacatgaaactgaggaccggctcaaggcaaaggagaaagaaaaggaccaaagaatcggagagaataaacagaagatggctgcactgaaatctgaagttgaatcagaacttaagtgccttgcagatagggaaagggaaactgaggagaaagttgcaaaggctgctgatttgtgctccaaagctgatgcggtagaggctgctggcagaaaaaaacgagaggaaatctttgcccagtttgagcaagtttgcgagacggctaacctgcacatggatggcattgatcgttccgtcagagaagttgacgaagcgaatatgaccattataggccagtgtgtcgcttcatgtggcaactagtatcctgtggcaagaatgatggatgtatatgtcgaatctgatgttatctgtgatgagtacaactaggggttcgaccagcaattattttgatgcaaatgccaggttgagtggtgtgct

SEQ ID NO: 34174 - DNA, 1141 bp, Panicum virgatum
  misc_feature: Ceres CLONE 1955411
  misc_feature: Encodes the peptide sequence at SEQ ID NO. 34175
atgctttttggttacggatcttttggttatgatgattttggcatagtacttgttttcttcggttgggaaagaaaaggtgccagcgtttgattttcaaaaaccattgcagggccaagcaaagcgttttgcatgtgctcatgtgtgttcgtcgttgtcgtctgactgaatttttgctgaagtttttgtctgaatgaaatcatataggtacgggctgccgttcgtgtccccgaacaacatcctggtgacgacgatcaacgggacggggtcgctgatcgaggccatctacgtggtgatcttcctcatcttcgcggagcggcggatccggctgcggatgctgggcctgctgggcgtcgtcacctccatcttcgccgcggtggtgctcatctcgctgctggccctccacggcaacgcccgcaagatcttctgcggcctggccgccaccatcttctccatctgcatgtacgcctcgccgctctccatcatgaggctggtgatcaagacgaagagcgtggagttcatgccgttcctgctctccctgtccgtgttcctctgcggcacctcctggttcatctacggcctcctcggccgcgaccccttcgtcattatccccaacgggtgcgggagcttcctgggcctgacgcagctgatcctgtacgcaatctaccggaacaacaagggcaccgccgcgccggccggcaagggggaggccgccgcggaggtggaggacgcgaagaaggtggccgccgcggtggagctggccgacgccacgaccaacaaggtcgccagccaggtgtaggctgcggcctctgtacccgaggcttgctggtgcctggctgggagatggtggtggtgcagtggtggtgtcaggcagcctgaaaagctaggccgcctaatgacgaattagtttgctgatgatgaagcagattgttgttgctttcttggccttgcgctgtcactctgatctcgatcgctccctaaaaatgtaccttcagggagaggtatgacacagggttatcaagtcgtgtctctgcaagtgtgaagttttctgtttgtttttcctgatttctctcttccgctgtttctctgaaagaaaatgtactgatcattttataagaaactgagctgcccaagggctgaatct

SEQ ID NO: 34175 - protein, 201 aa, Panicum virgatum
  misc_feature: Ceres CLONE 1955411
  misc_feature (77)..(163): Pfam Name: MtN3_slv Pfam Description: MtN3/saliva family
MKSYRYGLPFVSPNNILVTTINGTGSLIEAIYVVIFLIFAERRIRLRMLGLLGVVTSIFAAVVLISLLALHGNARKIFCGLAATIFSICMYASPLSIMRLVIKTKSVEFMPFLLSLSVFLCGTSWFIYGLLGRDPFVIIPNGCGSFLGLTQLILYAIYRNNKGTAAPAGKGEAAAEVEDAKKVAAAVELADATTNKVASQV

SEQ ID NO: 34176 - DNA, 1099 bp, Panicum virgatum
  misc_feature: Ceres CLONE 1955412
  misc_feature: Encodes the peptide sequence at SEQ ID NO. 34177
actcccaccacagtccgcagcagcagctagcgaccggtctcagcaaccctccttcggctcacgcaatggccgcctccaccatggcgatctcctccccggcgatgggcggcacccccatcaaggtgggctccttcggcgagggccgcatcaccatgcgcaagaccgcggccaagcccaaggtggcggcgtccggcagcccgtggtacggccccgaccgcgtcaagtacctcggccccttctccggcgagcccccgagctacctgaccggcgagttccccggcgactacggctgggacaccgcggggctgtccgccgaccccgagaccttcgccaagaaccgcgagctggaggtcatccactcccggtgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctgatccacgcccagagcatcctcgccatctgggcctgccaggtcgtgctcatgggcgccgtcgagggctaccgcattgccggcggcccgctcggcgaggtcgtcgacccgctctaccccggcggcagcttcgaccccctcggcctggctgacgaccccgaggccttcgccgagctcaaggtcaaggagctcaagaacggccgcctcgccatgttctccatgttcggattcttcgtccaggccatcgtcaccggcaagggcccgctcgagaacctcgccgaccacctcgccgatccggtcaacaacaacgcctgggcctacgccaccaacttcgtccccggcaaataagctccgatccattggctctgcaacttcattgtcttccggagggggcgtacgtggatccattgatgctgcaagctgctgcatgtgtgtctcttgtttcacgttattgcatttcaggggcaagtcgagatgatgagttggcgttgtacactaagatgaaagatgatgtttgtgcaatagtagtgattttgttccctggggttaatcattgatttgtcaggttattattaagggcactttattggttt

SEQ ID NO: 34177 - protein, 262 aa, Panicum virgatum
  misc_feature: Ceres CLONE 1955412
  misc_feature (61)..(229): Pfam Name: Chloroa_b-bind Pfam Description: Chlorophyll A-B binding protein
MAASTMAISSPAMGGTPIKVGSFGEGRITMRKTAAKPKVAASGSPWYGPDRVKYLGPFSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGK

SEQ ID NO: 34178 - DNA, 639 bp, Panicum virgatum
  misc_feature: Ceres CLONE 1955416
  misc_feature: Encodes the peptide sequence at SEQ ID NO. 34179
ggctttccctaattattgtcagtagcagcggatccctcgcctctccacaccgcccgccgcgccgagcacgcctccacctcctccccttccccgatctagatccgcccgtccctccgccgcggctgctgcgccacccctctccctcctctccgctgctcctcctcctcccaggcggcgtcggtatatgggttccaaatcggtggaccaagtgcttgatgccgccgccgcgggggtccattactccgcactccgtttggacgagctcaacgtccaaggttccatgtccgccgaggaacaaccgacgacgtcaggcctggagaatggccaccaggagccctttgttattggtgttgctgggggcgcatcttcaggcaaaactaccgtatgcaaaatgatcatcgaccagctgcgtgatcagcgcgtggttgttgttacacaggagtccttttactatggactgactgatcaggagctaatccatgttcatgattataactttgatcatccagatgcattcgatacagagttacttctctcgtgcatgaaaaacttgaagcgtggcaaagctgttgacattcctaattacaattttaagacatacaagagtgtcccaaatgcaagaaaggttaatccttcaga

SEQ ID NO: 34179 - protein, 151 aa, Panicum virgatum
  misc_feature: Ceres CLONE 1955416
  misc_feature: SWISSPROT Homolog: EC 2.7.1.48 Uridine kinase
MGSKSVDQVLDAAAAGVHYSALRLDELNVQGSMSAEEQPTTSGLENGHQEPFVIGVAGGASSGKTTVCKMIIDQLRDQRVVVVTQESFYYGLTDQELIHVHDYNFDHPDAFDTELLLSCMKNLKRGKAVDIPNYNFKTYKSVPNARKVNPS

SEQ ID NO: 34180 - DNA, 402 bp, Panicum virgatum
  misc_feature: Ceres CLONE 1955416-R
  misc_feature: Encodes the peptide sequence at SEQ ID NO. 34181
ccccaaggagtgcatgtggtgagcaagagattcccaagagtgaagatagtgacatcggagattgagtttggtctaaacgacgattttcgtgtgatccctggaatgggtgagtttggagacagatactttgggacagacgattatcagtcatcaaccccttcgttctgtgatgataaaaatcgtgtcaggcttctgtgagagttttttcccagacacagcaagccccagctgtggcatattctcgaaattttgggaaacttatgttcgcatttcaaaactctggaatgcccatattataatcaaatgtattcgttactggtaactgtgtaccatagaacattacagacttagggtcttgggatgcctcatctcataagctcgcttcttaaaacaattggagcc

SEQ ID NO: 34181 - protein, 65 aa, Panicum virgatum
  misc_feature: Ceres CLONE 1955416-R
  misc_feature: SWISSPROT Homolog: EC 2.4.2.9 Uracil phosphoribosyltransferase
PQGVHVVSKRFPRVKIVTSEIEFGLNDDFRVIPGMGEFGDRYFGTDDYQSSTPSFCDDKNRVRLL

SEQ ID NO: 34182 - DNA, 1650 bp, Panicum virgatum
  misc_feature: Ceres CLONE 1955419
  misc_feature: Encodes the peptide sequence at SEQ ID NO. 34183
accacacatacccctgcctgtgcctctgcctcccaccagaaaagcacacccaccttctctcccccctccaccatcctcaaaaactataaccaggctgtctgtccccaacgatgcgcaccacttccacctttgttccgctcactctcatcagcctgagcctcctctcctcccccaaatgagtgccaccgagttccgttctgctggtgccgcggccatggagctcggagaagtgatggggctgcagcaaggcatcgccggcaccgcgccttcacccagggagggcgacctgggtctcaagcgagcaggcctcacccaggcagcagctgcagcggcttcccacccctcccccttccttgacgagcagaagatgctcagattctccaaggctgcacaggcattgccctcaggcttggatcttggaaggccaaatgagcaggctttcctgctatccaggaccaagaggccctttactccctcccagtggatggagctggagcaccaggctctcatatacaagtatctccatgcaaaggccccaataccttccagcctgctcatttcaatcagtaaaagcttcaggtcatccaatagagtgagctggacacctctttatcaagggtacaccaatgcagactctgatccagaacctggaagatgccgtcgaacagatggaaagaaatggcgatgctccaaggaagcaatggctgatcacaagtactgtgagcggcacatcaacagaaatcgtcatcgttcaagaaagcctgtggaaaaccaacctaaaaagaccgccaaagaggcacctgctggctcgctgccatgtgctgtgtcacagggtagtttgaagaaggcaaaagttaacgactcgaagcctggcactgtcagctattggacagatagtttaaacaggacgatgttgagcaaagagaaagcaaaccagtcaacagaagacaacagtgctccattgctaaattctacwaatcgacaacccaccttgtccctgctctctcaactgaagcagcataataaaccagataagttcagccctgcagtgcatagtgatacaatattgaaagcctgggaaagcagaaaccagccaatccataagagcatttcctccacacagctgcatgatgctgaatccctccagtcagttcttcaaaacttcagcctggaaaagaatgagaacatggattctgagagaaacaaatattctgattccatgctagtttcatcaacttcctaccactccactcgaggtccacagacaacctgccttatacctaacatgacccaagtgcaggctgattgcatctcaagttcttgggagatgcctcaaggtggacctctgggcgaaatcttaacaaactccaagaataatgacgactcaaacaaaaagtgtgaatctaggtcatatggttggttattgaatcttgaccattcaccatgattcctcaatttatgaggaaattgacatagatatctcaccatgcaagtgactcagaaacgaacattaagatgaccttgagtccttgatagttgttccatgcatgctcgctactttttttgctttcgttttgtagtattcagctagttgaattatctgtaattctgaatctgtctgtatcttaaactagttttgtcacatattat

SEQ ID NO: 34183 - protein, 423 aa, Panicum virgatum
  misc_feature: Ceres CLONE 1955419
  misc_feature (155)..(200): Pfam Name: WRC Pfam Description: WRC
  misc_feature (96)..(132): Pfam Name: QLQ Pfam Description: QLQ
MSATEFRSAGAAAMELGEVMGLQQGIAGTAPSPREGDLGLKRAGLTQAAAAAASHPSPFLDEQKMLRFSKAAQALPSGLDLGRPNEQAFLLSRTKRPFTPSQWMELEHQALIYKYLHAKAPIPSSLLISISKSFRSSNRVSWTPLYQGYTNADSDPEPGRCRRTDGKKWRCSKEAMADHKYCERHINRNRHRSRKPVENQPKKTAKEAPAGSLPCAVSQGSLKKAKVNDSKPGTVSYWTDSLNRTMLSKEKANQSTEDNSAPLLNSTNRQPTLSLLSQLKQHNKPDKFSPAVHSDTILKAWESRNQPIHKSISSTQLHDAESLQSVLQNFSLEKNENMDSERNKYSDSMLVSSTSYHSTRGPQTTCLIPNMTQVQADCISSSWEMPQGGPLGEILTNSKNNDDSNKKCESRSYGWLLNLDHSP

SEQ ID NO: 34184 - DNA, 617 bp, Panicum virgatum
  misc_feature: Ceres CLONE 1955424-R
  misc_feature: Encodes the peptide sequence at SEQ ID NO. 34185
aaatagcatctggcagtgagaaaggggagttgatcgtggacatcattaaggaagggaggattgtcccatcagagataaccgtggaactcatcaggaaagctatggaagcgagcaatgccaataaggttcttattgatggcttcccaaggtgtgaggaaaacagaatcgcttttgaaagaattgttggaagagaaccagacattgtggttttctttgactgtcctgaggatgagatggttaaacgccttctaggccgtaaccaggggcgggttgatgataacattgagacaatcaagaagcgtcttaaggtgtttgagagtttgaatattcctgttattgactactattcttctaggggaaaggttcgcaagataaatgccacgggcactgcagatgaaatctttgaagcagtctgcaagctcttttcgtccttaaggttctgatgaggatactgtcttccaaggaatcccgggagttcgcttaggaattatctggtatttatttttcttaaagccagtgctcactttgcgccgtctaaatctttggtgcagtaattgtacatacacgctatgcctttaccaaataatacccacagaaatacatatgccttgtgacac

SEQ ID NO: 34185 - protein, 146 aa, Panicum virgatum
  misc_feature: Ceres CLONE 1955424-R
  misc_feature (1)..(120): Pfam Name: ADK Pfam Description: Adenylate kinase
  misc_feature: SWISSPROT Homolog: EC 2.7.4.3 Adenylate kinase
IASGSEKGELIVDIIKEGRIVPSEITVELIRKAMEASNANKVLIDGFPRCEENRIAFERIVGREPDIVVFFDCPEDEMVKRLLGRNQGRVDDNIETIKKRLKVFESLNIPVIDYYSSRGKVRKINATGTADEIFEAVCKLFSSLRF

SEQ ID NO: 34186 - DNA, 342 bp, Panicum virgatum
  misc_feature: Ceres CLONE 1955424
agagagaagagaaacggaactgagaaaaaagaggggaagagccggagcaaccgagggaggtggaggagacggcggccagcgagcgagcgccggaaggggaagagctccactagagcgggcggttgcgaggagacgaggagatgtggcggaggcggctgggagctttccttctccgatccccaccgtcttcctcctccacagccgcctcttcttgccagcatcgccgccaccacctcctccccagcgaggaacctccagccctcaatcgtcttgcaaggctcttcacgtcccaagctggaagtgatggtggcaattcccagaagccgttcattgctttcgtct

SEQ ID NO: 34187 - DNA, 786 bp, Panicum virgatum
  misc_feature: Ceres CLONE 1955425
  misc_feature: Encodes the peptide sequence at SEQ ID NO. 34188
aaaccccgcaacagtaaacacgcccactcatcacactctcagataagctaagccaggctccccctcaccatggcagcaatgccgccgctccccgcctcctcccccctcctgctgtgcctcctcctcctcctcgccgcgctgtgccccgcggcgcgggcggcgcggttcgcgtgcaacgccacggcgccgcgggcctccacgtgccaggcgctcatctcctacgcgccgcccaacggcacggccacggccacgctcgccgccgtgcgcgcgctcttccagctccgctcccaccgcgcgctgctggcggccaacggcctcccgctctccacgccgcccacggcgcccgcgcccgtgccgctgcgggtgcgcctgccctgcctctgctcgggcggcgccggggccaccttccagcggcccacctaccgggtccgcgccggggacacgctcgacgccatcgcgcggggcgccttcgcgggcctcgtcacctaccaggacatcgccgccgccaacaacgtctccgacccaaacaaggtcgccgtcggccagcagctctggatccccgtgccctgcagctgcgaccccgtcggcggcgaccccgtcgtgcacctcacgtacgtcgcgccggccgggagctccgtcgctggcatcgcgcacgagttcggctccacggaggagaccgttctcgccgtgaacaagatgcccgacgccaagggccttctcgctggccaggttcttgatgtgccgctccgaacttgtggttctgcgattagcaacacaaccattgga

SEQ ID NO: 34188 - protein, 238 aa, Panicum virgatum
  misc_feature: Ceres CLONE 1955425
  misc_feature (118)..(164): Pfam Name: LysM Pfam Description: LysM domain
  misc_feature (182)..(225): Pfam Name: LysM Pfam Description: LysM domain
  misc_feature: SWISSPROT Homolog: EC 3.5.1.28 N-acetylmuramoyl-L-alanine amidase
MAAMPPLPASSPLLLCLLLLLAALCPAARAARFACNATAPRASTCQALISYAPPNGTATATLAAVRALFQLRSHRALLAANGLPLSTPPTAPAPVPLRVRLPCLCSGGAGATFQRPTYRVRAGDTLDAIARGAFAGLVTYQDIAAANNVSDPNKVAVGQQLWIPVPCSCDPVGGDPVVHLTYVAPAGSSVAGIAHEFGSTEETVLAVNKMPDAKGLLAGQVLDVPLRTCGSAISNTTI

SEQ ID NO: 34189 - DNA, 542 bp, Panicum virgatum
  misc_feature: Ceres CLONE 1955425-R
caagtggggggccatgttcctcggcaacacgtcctccaattcatcttgtgagagcaggacgtgctcttacggtgggtacaccaacagcacatctttcgccatcctcaccaacatcaccaccagcaacacgtgcaacgctgggatggctccaatggcgcagccggctcactccttggcattccggttggagccggcgtggttgagatggaccgagcttgttgtctctcttcacgtcgtcttcctctgtctaggctatctgcgccaagactgaatgttgctgtcatctgtattttgttagactctgcccccctgattcgtagtttgatgttgtgagtaatgtggtgcagtgcttgcgagactttggcctgtacctggttggatttgcaagtgcaaacgcaaggggaacactttgttttgtgttagaaggtagatcaggaaacaattgtactttgtcaaacttttgcaaagatactttctgtggttatgattttagcctttcagtgttctagaatctgaatgtgaactcgtaaggcattggattc

SEQ ID NO: 34190 - DNA, 1248 bp, Panicum virgatum
  misc_feature: Ceres CLONE 1955426
  misc_feature: Encodes the peptide sequence at SEQ ID NO. 34191
aaaaaaaagaagtccctcccctttctcctctcgtctcgctcactcgctcggccgtcggccgccttctttgcaagcggcgacgacaggggagtggtgccgccgtttccagttcttcgtcggacgcttcgccggccgacaagtaatggcgtcgccaatctctgcaagacgctatcagcaatttcctttagtacataacaatggacttccaagattttctcgagtaaagatggcatgcttgggaataaaacaaactagatatcattctgaaaccaacttatcttcatcagcaagtcatggagatgccagcaagctccatcctgtagtcaaaatgtgtggcatcacatcagctagagatgcagaaatggctgtagaggccggagctaaacttataggcatgatactgtggcctaactctaaacgctccgtttctttatctgaggcaaaagaaatatcaagagttgcacaatcttatggtgctgaatcagttggtgtctttgtggatgatgatgaagatactatcttacgagtgtcggattcatgtgaccttaactttatccagctccatggagatgaatctcgtgcattggttcatactctttccaagaataaccacattgttcatgtgctaaatgctgatgaagatggaaaactaatcaactctcctcctgttttggaatatgcacttgattggttcttagtggacagtgcaaaaggcggaagtggaaagggattcaactggcagaggttccagatgccgacagtcaaaagcaagaatggatggctattagctggaggacttcatgcagataatgtttgtcgagccttttctgctctgaaaccaaatggagttgacgttagcagtggcatatgtgctcctgacggtatccgtaaagaccccaacaggatttcttccttcataagtaatgtgaaatccctgagttgcagatcataatgtcatttggttattgggagcttagtttcattcatttacttaccttgcggagactagctaatttggcgttgaacgcaatctgaagccaaagctgttcagcatggccggttgaggggaaaatagtgatcaaatttctgaagagcaaacgttatatgtattgtatttgttggtagtgtgatgtaataagtggattttgcatgcatctccagatgaaaggcaataataaaccacacatcgtacatcgatgtattttctgcagcaataaagtaaagggctaaaggctatacttattcgct

SEQ ID NO: 34191 - protein, 269 aa, Panicum virgatum
  misc_feature: Ceres CLONE 1955426
  misc_feature (61)..(261): Pfam Name: PRAI Pfam Description: N-(5'phosphoribosyl)anthranilate (PRA) isomerase
  misc_feature: SWISSPROT Homolog: EC 5.3.1.24 Phosphoribosylanthranilate isomerase
MASPISARRYQQFPLVHNNGLPRFSRVKMACLGIKQTRYHSETNLSSSASHGDASKLHPVVKMCGITSARDAEMAVEAGAKLIGMILWPNSKRSVSLSEAKEISRVAQSYGAESVGVFVDDDEDTILRVSDSCDLNFIQLHGDESRALVHTLSKNNHIVHVLNADEDGKLINSPPVLEYALDWFLVDSAKGGSGKGFNWQRFQMPTVKSKNGWLLAGGLHADNVCRAFSALKPNGVDVSSGICAPDGIRKDPNRISSFISNVKSLSCRS

SEQ ID NO: 34192 - DNA, 1111 bp, Panicum virgatum
  misc_feature: Ceres CLONE 1955456
  misc_feature: Encodes the peptide sequence at SEQ ID NO. 34193
acctccgtctccgctgccgccgctgacgccctcgtaccaagactcgccgctcgccgctcgccgccagcatctcgcgttccgacaatccgccgcagaagaatcggccccagtccccgtctcttctcctcctcctccttccccattctaccagccgcggccatggccaccgacagcgccgcccccgccgggtccaagagtaagctgctcgtcttcgattccgtggaagatctcgcggtgtctctggcgaagtacaccgctgagctgtctcagaagttcgccaccgagaggggcgccttcaccgtcgtgctctccggcggatccctcatcgactcgctcagcaagctgacggagccgccgtacctggaatcggtggactggagcaagtggcacgtcttctgggtggatgagagagtcgtgcccaaggatcatgaggatagcaactacaagctcgccttcgatgggtttctctccaaggtgccgattcctccggggcaagtttatgctataaatgatgccttgtcagctgagggagcagcggatgactacgaagcttgcttgaagcagcttgttaagaatggtgtgattgccatgtcaacagcaactgggtttcccaggtttgatctccagcttcttggaatgggacctgatggccacattgcctctctcttccctggtcaccctcttgttaatgagaaagagaggtgggtcacctacatcaaggattctccaaagccgccaccagagaggatcacatttacatttccagtaatcaactcatctgcatatatcgcgatggtggtcactggagctgggaaagctggtccagtgcagaaagcgctttcagacaagcaaacttcttccgatctgctgcctgttgagatggctgtgcttcaagatggagaattcacttggttcactgacaagccagcagtgtccctgttgcagaacaagtgaaggccaaccatggtgatcttagttcgaagccgtttatcttaaataaaagatccaagggcctgcattgtgcatagttgcattcatcctccttggatttcatgtaagggagacttgagccctttatgtagtatgttttctagagtaatgtgtttcagat

SEQ ID NO: 34193 - protein, 317 aa, Panicum virgatum
  misc_feature: Ceres CLONE 1955456
  misc_feature (81)..(317): Pfam Name: Glucosamine_iso Pfam Description: Glucosamine-6-phosphate isomerases/6-phosphogluconolactonase
  misc_feature: SWISSPROT Homolog: EC 3.1.1.31 6-phosphogluconolactonase
  misc_feature: Functional homolog of the protein sequence given in SEQ ID NO 50130
  misc_feature: Useful for biocontainment applications
  misc_feature: Useful for making plants with modulated flowering time
TSVSAAAADALVPRLAARRSPPASRVPTIRRRRIGPSPRLFSSSSFPILPAAAMATDSAAPAGSKSKLLVFDSVEDLAVSLAKYTAELSQKFATERGAFTVVLSGGSLIDSLSKLTEPPYLESVDWSKWHVFWVDERVVPKDHEDSNYKLAFDGFLSKVPIPPGQVYAINDALSAEGAADDYEACLKQLVKNGVIAMSTATGFPRFDLQLLGMGPDGHIASLFPGHPLVNEKERWVTYIKDSPKPPPERITFTFPVINSSAYIAMVVTGAGKAGPVQKALSDKQTSSDLLPVEMAVLQDGEFTWFTDKPAVSLLQNK

SEQ ID NO: 34194 - DNA, 1081 bp, Panicum virgatum
  misc_feature: Ceres CLONE 1955462
  misc_feature: Encodes the peptide sequence at SEQ ID NO. 34195
agcgatcgaaccgtagcaatcgatcgatcaatcaatcaatcagcctgccgatcgaccgatcgaggagagcgccctgcacgtctgctgcggcctgcgggggagggggagagatggcgtcggggtaccgcgcggaggaggagtacgactacctgttcaaggtggtgctgatcggggacagcggcgtcggcaagtccaacctgctgtcgcggttcgccagggacgagttcagcctcgagaccaggtccaccatcggcgtcgagttcgccaccaagaccgtccaggtcgacgacaagctcgtcaaggcgcagatctgggacaccgccggccaggagaggtaccgcgccatcacgagcgcctactaccgcggcgcggtgggcgcgctggtggtgtacgacgtgacccgccgcgtgacgttcgagaacgcggagcggtggctccgggagctgcgggaccacacggacgccaacatcgtggtcatgctggtgggcaacaaggcggacctgcgccacctccgcgccgtctcgcccgaggacgccgcggccttcgcggagcggcacgggaccttctccatggagacgtccgcgctggacgccaccaacgtggagcgcgccttcgccgaggtgctccgccagatctaccacgtcgtgagccggaacgcgctcgacatcggggaggaccccgccgcgccgcccaggggcaagaccatcgacgtcggcgccgccaaggacgaggtctcgcccgtggacgcgggcgggtgctgctcggcttgagccttttttccctttccccctttttagccctggtcaaacgatgagacgctttcctggtaaccaaacagggcctaaggaagaaaagacaggacgtgctgccaactgccgcaatctttcttgacaattgacagggtcaagcggttggggtttgttggcgctcgacaattgacaccgtgttttggagagggccgcatgttgttttccaaccttgcaatcgctgtcctagtgtgtattcatcggcccgcccatgatacggtagcatatagtacatataattattataattattacaagtgaaaggttatgacttg

SEQ ID NO: 34195 - protein, 219 aa, Panicum virgatum
  misc_feature: Ceres CLONE 1955462
  misc_feature (16)..(177): Pfam Name: Ras Pfam Description: Ras family
  misc_feature (16)..(130): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50162
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
MASGYRAEEEYDYLFKVVLIGDSGVGKSNLLSRFARDEFSLETRSTIGVEFATKTVQVDDKLVKAQIWDTAGQERYRAITSAYYRGAVGALVVYDVTRRVTFENAERWLRELRDHTDANIVVMLVGNKADLRHLRAVSPEDAAAFAERHGTFSMETSALDATNVERAFAEVLRQIYHVVSRNALDIGEDPAAPPRGKTIDVGAAKDEVSPVDAGGCCSA

SEQ ID NO: 34196 - DNA, 1141 bp, Panicum virgatum
  misc_feature: Ceres CLONE 1955499
  misc_feature: Encodes the peptide sequence at SEQ ID NO. 34197
aatcgcctcgaaaacctctcaaaccccaccggtccaccaccaccaccagtccaccacgccgcaccgtcgcgctcaggtcgccagcccccgcaacacgacgagccaggaaggtgccatggccaccacccgcgacgtctccaccgccgccgccatgttccacgtctaccagcccctgcaggcgccgtccacagccgcgcccgcggcggcggcgggcgagggcggcggcggcggcatggcggtggtccccgcgaagccggtcaagaaggagggcggcggcgggaaggaccggcacagcaaggtgaacgggcgcgggcggcgcgtgcgcatgccgatcgtgtgcgcggcgcgcgtgttccagctcacccgcgagctggggctcaagtccgacggccagaccatcgagtggctgctccgccaggccgagccctccatcctcgccgccacggggtcgggcaccaccccggccgtcttcgtctcctcctccgcgccgtccacgtcctcctcctcccactaccaccagcagaccgtcctcggcaagcgcccgcgcgaggaaggcgacgccggcgccgcggcagccgcgtccgcgttctgggcggccctgccggcgccgccgcggacgacggaggcctggggcttctcgccgctggaggcgcaggcggcggcggcggcggccgcgtacgtgccgatggcgcaggcgcaccaccaccacctcaacctgctcgccgcgctctccggcgccgcccggcgcgccgaggaggagacccggtgactcgatccgccacagctcctgacaccttctgcgcgcattgatctttgtccgtctcttcttggctgcgttcttggcttgttttgtgctttgattgatctcctctaccagtcagtccgtccattggcagtgtcttgtgtgtcgtccaagattcgatgagagaagattgctgtggtgccttgcgctaaatgtaaataccagtccttggttagatcttactactacattcgggtcaaactaaatcgggtagctcgcgtcggggtatgccggcctgtgctaggttttctgcgcctttgattccatggaacttgcttcggttagcatcttgtctgtatcaccagcccaagaagtcatttagtacaagcataaattccg

SEQ ID NO: 34197 - protein, 217 aa, Panicum virgatum
  misc_feature: Ceres CLONE 1955499
  misc_feature (43)..(198): Pfam Name: TCP Pfam Description: TCP family transcription factor
  misc_feature: The sequence is a functional homolog of SEQ ID NO 2782 in the 10/374,780 US patent application
  misc_feature: The sequence is a functional homolog of SEQ ID NO 680 in the 10/225,066 US patent application
MATTRDVSTAAAMFHVYQPLQAPSTAAPAAAAGEGGGGGMAVVPAKPVKKEGGGGKDRHSKVNGRGRRVRMPIVCAARVFQLTRELGLKSDGQTIEWLLRQAEPSILAATGSGTTPAVFVSSSAPSTSSSSHYHQQTVLGKRPREEGDAGAAAAASAFWAALPAPPRTTEAWGFSPLEAQAAAAAAAYVPMAQAHHHHLNLLAALSGAARRAEEETR

SEQ ID NO: 34198 - DNA, 1389 bp, Panicum virgatum
  misc_feature: Ceres CLONE 1955502
  misc_feature: Encodes the peptide sequence at SEQ ID NO. 34199
gaaccctagccccgccatgccgccggccgccgacgccgcccacctagccacggcggccgaccccgacgaggacctctgctccagcgccgcggctgccgcggcggcgggggaggtcgcgccggccccgcccctcccgccgccgccggcgtccgcggaggagaggatcgagcgcgcgtgggcgcactggaggcgcctggggtccccgcgcctgatggtggcgccgatggtggacaactccgagcttcccttccgcatgctgtgccgacgctacggcgccgacgccgcgtacacgcccatgctccactcccgcatcttctccgagaacgagaagtacaggtccatggagtttaccacgtgcaaggaggaccgtccactttttgttcagttttgtgcaaatgaccctgacattttgttacaagctgcaaagatggtggaaccacattgcgactatgttgatatcaattttggatgcccccagcgtatcgcaagacgggggaactatggagcatttctcatggacaaccttcccctcgtaaaatcccttgtgcagaatctatcagctaaccttcatgttccagtctcggtaaagattcgcatatttccacggttggaagacacactagcctatgccaagatgcttgaggaagctggtgcttctcttgtggctgtccatggtcggacgagagacgaaaaggatgggaagaaatttcgagcagactgggatgccatcaaggccgtcaaagatgctctcagagtacctgttcttgcaaatggaaacattcgccacatggaggatgtgaagaactgcctggaacatactggtgctgatggtgtgctttcagcagaaactctcctagaaaatccagcactctttgctggtttcaggacaaaggaatggaaagaagatggtgatgagaatggagatagcggcttggaccaggctgatctagtgattgaatacttgaagctgtgtgagcagtaccctgtgccatggagaatggttagatcccatgtccacaagatgttgggggactggttcagggtgcatccagaggtgagggaggaactcaacaagcagaacatactcaccttcgaatggttgcatgacatggtaatgaggctcaagaaactcggtggaagagtgccactttacaaaaaagagagtgcactgcagacagcagcagatgggctagctgttagcaatgcttgagaattcccccatcaattttgagatctgcagcaccaatttttggaaagatggaatgtatgaaaaataggaactatttaacttgtattagaatagattggaagaacatcactgtggtccaacactcctctggccacgattggaacgaaattctggctgattgaactatttattggttgctc

SEQ ID NO: 34199 - protein, 397 aa, Panicum virgatum
  misc_feature: Ceres CLONE 1955502
  misc_feature (66)..(371): Pfam Name: Dus Pfam Description: Dihydrouridine synthase (Dus)
  misc_feature: SWISSPROT Homolog: EC 1.3.3.1 Dihydroorotate oxidase
MPPAADAAHLATAADPDEDLCSSAAAAAAAGEVAPAPPLPPPPASAEERIERAWAHWRRLGSPRLMVAPMVDNSELPFRMLCRRYGADAAYTPMLHSRIFSENEKYRSMEFTTCKEDRPLFVQFCANDPDILLQAAKMVEPHCDYVDINFGCPQRIARRGNYGAFLMDNLPLVKSLVQNLSANLHVPVSVKIRIFPRLEDTLAYAKMLEEAGASLVAVHGRTRDEKDGKKFRADWDAIKAVKDALRVPVLANGNIRHMEDVKNCLEHTGADGVLSAETLLENPALFAGFRTKEWKEDGDENGDSGLDQADLVIEYLKLCEQYPVPWRMVRSHVHKMLGDWFRVHPEVREELNKQNILTFEWLHDMVMRLKKLGGRVPLYKKESALQTAADGLAVSNA

SEQ ID NO: 34200 - DNA, 1254 bp, Panicum virgatum
  misc_feature: Ceres CLONE 1955503
  misc_feature: Encodes the peptide sequence at SEQ ID NO. 34201
atcctaaagagaagaagaaacaagcaagtagcaatactctctttcttgtaacatagcgcagcaaaggttactcacttacatggcaacttccatgggttgcctcgtcttgctctgccttgtttctcccctcttccttgccagtgccgtccacggccacccatggggcggcttgttccctcagttctacgaccattcatgccccaaggcgaaggagattgtgcagtccattgtagcacaggctgtggccaaggagaccaggatggcggcatccttggtcagactgcatttccatgactgctttgtcaaaggctgcgatgcatccgtgctgttggacaacagcagcagcatagtcagtgagaaagggtctaaccccaacaggaactccctcagggggtttgaggtggtcgaccagatcaaggccgctctcgaggctgcctgcccaggcactgtctcctgcgccgatatcctcgccctcgcagcccgtgattcaactgtcctggttggaggcccatactgggacgtgcctctcggccggagggattcgctcggtgcaagcatccagggctccaacaacgatatcccagcccccaacaacaccctcccaaccatcatcaccaagttcaagcgccaaggcctcaacgttgtggacgtcstcgccctctccggtggccacaccataggtatgtctcggtgcaccagcttccgtcagaggctgtacaaccaaacgggcaatggcatggctgacagcacactggatgtatcgtacgtggcacagctgaggcaggggtgcccccgctctggcggcgacaataacctcttccccttggacttcgtcaccccagccaagtttgacaatttttactacaagaacctcctggctggcaagggcctcctcagctctgatgaggttctgttgaccaagagcgccgagacagcaaccctcgtgaaggcatatgctgctgatgtcaatctcttcttccagcactttgcgcagtctatggtgaacatgggcaacatctcaccactaaccgggtcacagggcgagatccggaagaactgcaggaggctcaacaacgaccactgaggctgctttatgtactgaaattgtatctgatgttggtgatataatttgttcaaataagcaagcatggctatgattttatcagatgtctgatcttatgtttttatttaaacacattgtaaaatgtgtatctattaataagtcgatatataagatgagttgatttggttgtc

SEQ ID NO: 34201 - protein, 330 aa, Panicum virgatum
  misc_feature: Ceres CLONE 1955503
  misc_feature (43)..(291): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51032
  misc_feature: Useful for making plants with altered carbohydrate content
  misc_feature: Functional homolog of the protein sequence given in SEQ ID NO 51033
  misc_feature: Useful for making plants with altered cell wall content and/or composition
  misc_feature: Functional homolog of the protein sequence given in SEQ ID NO 51034
  misc_feature: Useful for making plants with modulated nitrogen use efficiency
  misc_feature: Functional homolog of the protein sequence given in SEQ ID NO 51417
  misc_feature: Useful for making plants with modulated oxidative stress sensitivity
  misc_feature: Functional homolog of the protein sequence given in SEQ ID NO 51035
  misc_feature: Useful for making plants with modulated light quality response
  misc_feature (188)..(188): Xaa is any aa, unknown, or other
MGCLVLLCLVSPLFLASAVHGHPWGGLFPQFYDHSCPKAKEIVQSIVAQAVAKETRMAASLVRLHFHDCFVKGCDASVLLDNSSSIVSEKGSNPNRNSLRGFEVVDQIKAALEAACPGTVSCADILALAARDSTVLVGGPYWDVPLGRRDSLGASIQGSNNDIPAPNNTLPTIITKFKRQGLNVVDVXALSGGHTIGMSRCTSFRQRLYNQTGNGMADSTLDVSYVAQLRQGCPRSGGDNNLFPLDFVTPAKFDNFYYKNLLAGKGLLSSDEVLLTKSAETATLVKAYAADVNLFFQHFAQSMVNMGNISPLTGSQGEIRKNCRRLNNDH

SEQ ID NO: 34202 - DNA, 631 bp, Panicum virgatum
  misc_feature: Ceres CLONE 1955514
  misc_feature: Encodes the peptide sequence at SEQ ID NO. 34203
acaacaacctcacatcttagagcagcagcagcccctgagctccagcatcctcaggtagctcgcagcttacctggtcacaagcttgggaaacatgaagctctcagcggctgtcctcctcgccctggtggccatccaggcagccgtgctcctctccgccgtgccgtcggcgcaggccaaggagctggaggtcggctactacaacaagaaatgcaagggcgttgagaacgtcatcaagtggcacgtcctcaaggcgctcaaggctcaccgccgcaccggcgccgcgctcgtccgcctcctcttccatgattgctttgtcagggggtgcgatggctctgtcctcctggacgcttcctacgagaaccctaacccagagaagaaggcgccggtgaacatcggcctcgccgccttcgacctcctggaggagatcaaggctgccgtcgaggacaggtgccccggcgtcgtctcctgctccgacatcctcatctacgctgcccgtgacgcggccagcatcctcagcaacggccacgtccacttcgacgtccccgccggtcgcctcgacggcttcgtctcccaggccgaggaggcccaggcagagctccccgactccactgacgacgtcgagaagctcatc

SEQ ID NO: 34203 - protein, 179 aa, Panicum virgatum
  misc_feature: Ceres CLONE 1955514
  misc_feature (47)..(178): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51054
  misc_feature: Useful for making plants with altered carbohydrate content
MKLSAAVLLALVAIQAAVLLSAVPSAQAKELEVGYYNKKCKGVENVIKWHVLKALKAHRRTGAALVRLLFHDCFVRGCDGSVLLDASYENPNPEKKAPVNIGLAAFDLLEEIKAAVEDRCPGVVSCSDILIYAARDAASILSNGHVHFDVPAGRLDGFVSQAEEAQAELPDSTDDVEKL

SEQ ID NO: 34204 - DNA, 257 bp, Panicum virgatum
  misc_feature: Ceres CLONE 1955514-R
agcaagggcgagatcaggaagaagtgcagcgccatcaaccactactaagcaggaggctgctgtactcgcagcagtggaggtcaaagaagaagaggccgtgcgtgcccagccaaacacacgttcatagatcaccttgaaccataagcttggtttttgtgtcgttccatccattcttttgattcgcattggttgtaatacactttgttttgcagttttcatctctgccaatctgttacataatatacagtttctcaagg

SEQ ID NO: 34205 - DNA, 588 bp, Panicum virgatum
  misc_feature: Ceres CLONE 1955519-R
  misc_feature: Encodes the peptide sequence at SEQ ID NO. 34206
aaggaggcacagtatagccacctggactgtgtgggacgatgagagtctcgcaagctccccatcactcacatgttatattgttcccacagaatttgcaagggcgaagtcttgtgttcagggatcagcattgaataatggtgcagagactccagagaaaggaagctctgatggcccggtcaagaaaaggttgtcctttcaaggtggaacagcgactgcctcaccaatgggacggcattctggtcctcccaaggtggggagtgcggtgaaggatattgttgccccaccacagccagaggccttggtgatcaatggtggaagcaagtgactcatgacaagtaccaggagggtaaagcggacaatgaatatatattttatccatgaagaaaggttaacgtgatatcagctctatgagtgatttgaattgttttccagttacgaccacattgtttgctctataagattcacagtacctgccagttgattccattcgttgtttctgtaaaacaagtaccggttcgtcactagaatcagtgatgtttgtatgtaaacaggtcttctatttatgtgagccatatatttctttttctg

SEQ ID NO: 34206 - protein, 107 aa, Panicum virgatum
  misc_feature: Ceres CLONE 1955519-R
  misc_feature: Functional homolog of the protein sequence given in SEQ ID NO 51454
  misc_feature: Useful for making plants with modulated salt sensitivity
RRHSIATWTVWDDESLASSPSLTCYIVPTEFARAKSCVQGSALNNGAETPEKGSSDGPVKKRLSFQGGTATASPMGRHSGPPKVGSAVKDIVAPPQPEALVINGGSK

SEQ ID NO: 34207 - DNA, 465 bp, Panicum virgatum
  misc_feature: Ceres CLONE 1955519
aagttgtccctactcctctttcccctgacccctctaatatctccccagcgacagcgagagagagaggagggaggacgagcgcatcgtggcaacaggcacctagggtgattgtttcgaggagcgtggagcggagccatggggaagaagggcaagtggttcggcgcggtctagaaagtgttcaaccctgaatccaaggataagaacgacgagagcgctaggaggaaatccccacccatcaaccctcctcccctcgatctcaccccgtccacctcgttggaagtcaatgtttcggtgcctccccctcctgctcctccggctcttcaccagattgaggacgccatcatccctgaacctcatcacgagcacagcctccacatccccgaaaaggaggcccctgctgcccctgcacctgcgtctgtgcttccacctgctgtgccaagcgaacatcttgctgcaatcaagatc

SEQ ID NO: 34208 - DNA, 627 bp, Panicum virgatum
  misc_feature: Ceres CLONE 1955534
  misc_feature: Encodes the peptide sequence at SEQ ID NO. 34209
acataacatagccatcaataggaaaggaaatccaagcaacaaacttggcaccaccctgttcctgccaagagaatcaaccatgagacctcaggtgttgctcgccacactagctgctctcgccgtcctcgcagctctgccactcatgagcaaagggagcgaggagggaggaggagtggcggccgccagcgacgacaacgcgagcccatggccgtgctgcgaccagtgcgacttctgcttcaggtcgaacccacccaagtgccggtgcctggacatctcgcgccaaggttgccacccgtcgtgccaaaactgcgtcaagtacagagccgtcggtagcgcccacgagctgcccgtctaccgctgcgccgacaccctcaccaactactgcgagcaccgctgcacaccggccgccgccgccgctgcataatattatctgaatgaacgctgccagcgacctctggttatcagctagctttgccttctcttcctgcgtgcttccacagaaaagacaggcttcctttgcttgctcatcgttttctaccgtttctggaaaaaagagctgtgtgctgtgcatacaagctcaaaactcaagtgtttggtgttgctccgtggcatgaaccaaaccctggg

SEQ ID NO: 34209 - protein, 114 aa, Panicum virgatum; identical to SEQ ID NO: 10045
  misc_feature: Ceres CLONE 1955534
  misc_feature (45)..(71): Pfam Name: Bowman-Birk_leg Pfam Description: Bowman-Birk serine protease inhibitor family

SEQ ID NO: 34210 - DNA, 540 bp, Panicum virgatum
  misc_feature: Ceres CLONE 1955534-R
  misc_feature: Encodes the peptide sequence at SEQ ID NO. 34211
ggacgcccacgagctgcagctcaacggcatccgcatcaccctgtcctccaagaacgtcaagaacttggagaaagtttgtgcggatttggtgaagggagccaaggacaagcagctgcgggttaagggacctgtcaggatccctactaaggttctccacatcaccacccgcaagtccccttgtggtgaaggaacaaacacatgggatcgctttgagttccgcatccacaagagggtgattgacctgatcagctcccctgatgtggtgaagcagatcacctccatcaccatcgagcctggtgtcgaggtcgaggtgaccatcgcagacgtgtaatggcatgcagtttagctctgtcatcttatatcttgcgttgctttagttttgtgccccctttgtgtgcttgtatgagacatctgagtgattattagcatccaagactgtttttgcgccgcctactataatcccaccatagctgtttgtctggtctgaaggcctgtgcaactcgaaattttgattcagttcagttatctgtctgtttctcc

SEQ ID NO: 34211 - protein, 109 aa, Panicum virgatum
  misc_feature: Ceres CLONE 1955534-R
  misc_feature (9)..(104): Pfam Name: Ribosomal_S10 Pfam Description: Ribosomal protein S10p/S20e
  misc_feature: Functional homolog of the protein sequence given in SEQ ID NO 50532
  misc_feature: Useful for making plants with modulated biomass
  misc_feature: Useful for making plants with modulated flowering time
  misc_feature: Functional homolog of the protein sequence given in SEQ ID NO 50533
  misc_feature: Useful for making plants with modulated phosphate use efficiency
DAHELQLNGIRITLSSKNVKNLEKVCADLVKGAKDKQLRVKGPVRIPTKVLHITTRKSPCGEGTNTWDRFEFRIHKRVIDLISSPDVVKQITSITIEPGVEVEVTIADV

SEQ ID NO: 34212 - DNA, 1184 bp, Panicum virgatum
  misc_feature: Ceres CLONE 1955537
  misc_feature: Encodes the peptide sequence at SEQ ID NO. 34213
  misc_feature (541)..(541): n is a, c, t, g, unknown, or other
attagagctccgaatcgcagcagatgtagctgactggtcgccgcgtccgccccctccctgcgtagcgtagcagcagagcacccccgatcgagcgagcaatggaggcggggggcgtgggcctggcgctgcagacgcgggcggcgggcttcggcaccggccggcgccggggcgggctgcagtcgccgatcgggagcttgagggtcgctgacccggcgggagcagcggtcgccgtgcgggctcgcgggtccaagcccgtcgccccgctccgcgcgaagaaatcgtccggaggtcatgaaaacttgcataactccgtcgacgaagcacttttgttgaagagaaaatcagaagaagttttgttctacttgaacgggaggtgtatttacttagtaggaatgatgggttctggaaaaagtaccgtggggaagattatgtctgaagttttgggttattcgttctttgatagtgacaaattggtggagcaagctgtgggaatgccttcagttgcccaaatattcaaggttcatagtgaagcgttcttcanggacaatgagagtagtgtcttgagggatttgtcctcaatgcggagattagttgttgccactggaggtggtgctgttatcsgaccagttaactggaaatatatgaagargggcctatctgtttggttagatgtgcccttggatgctcttgctaggcgtatcgctaaagtgggaactgcctcccgtcctcttctggatcaaccatctggcgatccatacacaatggccttttctaagctcagcatgcttgtggagcaaaggggtgatgcttacgcaaatgcggatgtaagagtttctctagaagagattgcgtctaaacagggtcatgatgatgtctctaagctgacaccaactgatatcgctattgagtcacttcataagatcgagagcttcgttatcgagcacgccactgacaacgcagctggtgacactcaagcagagtcgcaggtccaaaggatacagaccttgtagaatgttgaccctttttgttgtaccccgtagtgtaccaccacctagagcatcgttgagctatttattcattgccgtgccatcaagagggtaaaaaagagacttgaagcacccttctttgttataagtttgtgaaggaatggaataaggaagctaatccgaagtgtgccgttggcc

SEQ ID NO: 34213 - protein, 303 aa, Panicum virgatum
  misc_feature: Ceres CLONE 1955537
  misc_feature (100)..(276): Pfam Name: SKI Pfam Description: Shikimate kinase
  misc_feature: SWISSPROT Homolog: EC 2.7.1.71 Shikimate kinase
  misc_feature: Functional homolog of the protein sequence given in SEQ ID NO 51455
  misc_feature: Useful for making plants with modulated salt sensitivity
  misc_feature (148)..(148): Xaa is any aa, unknown, or other
  misc_feature (175)..(175): Xaa is any aa, unknown, or other
  misc_feature (184)..(184): Xaa is any aa, unknown, or other
MEAGGVGLALQTRAAGFGTGRRRGGLQSPIGSLRVADPAGAAVAVRARGSKPVAPLRAKKSSGGHENLHNSVDEALLLKRKSEEVLFYLNGRCIYLVGMMGSGKSTVGKIMSEVLGYSFFDSDKLVEQAVGMPSVAQIFKVHSEAFFXDNESSVLRDLSSMRRLVVATGGGAVIXPVNWKYMKXGLSVWLDVPLDALARRIAKVGTASRPLLDQPSGDPYTMAFSKLSMLVEQRGDAYANADVRVSLEEIASKQGHDDVSKLTPTDIAIESLHKIESFVIEHATDNAAGDTQAESQVQRIQTL

SEQ ID NO: 34214 - DNA, 672 bp, Panicum virgatum
  misc_feature: Ceres CLONE 1955551
  misc_feature: Encodes the peptide sequence at SEQ ID NO. 34215
actcactcacacagcacaagaagcaagctcgatcgccgggccccttcgtccacctccaccaccacacatctcaccacagtcagagcgaccgcttcggccatggcccggcgggtgtcgtccctgctgctgctgccgctgctgggcgcgctggcggcggcggcggcggccagcttcgaccaggagttcgacatcacctggggcgacggccgcggcaagatccaggacggcggccgccgcctcacgctcacgctcgaccgcacctccggctccggcttccagtccaggcgcgagtacctcttcggcaagatcgacatgcagatcaagctcgtccccggcaactccgccggcaccgtcaccgcctactacctctcctcgcaggggagcacccacgacgagatcgacttcgagttcttgggcaacgtcaccggcgagccctatacgctgcacaccaacgtgttcacgcaggggcagggccagcgcgagcagcagttccgcctctggttcgaccccacgaccgacttccacacctactccatcctctggaaccccaagcacatcatgtaatgttgctcaatgctcactgctcttcttcatcatcatcaaacaaactgacaaactgacaatttgaaaatccatggatgatgcagcttcatggtggaccacctgcccatc

SEQ ID NO: 34215 - protein, 154 aa, Panicum virgatum
  misc_feature: Ceres CLONE 1955551
  misc_feature (25)..(154): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Functional homolog of the protein sequence given in SEQ ID NO 50818
  misc_feature: Useful for making plants with altered carbohydrate content
  misc_feature: Functional homolog of the protein sequence given in SEQ ID NO 50904
  misc_feature: Useful for making plants with altered cell wall content and/or composition
MARRVSSLLLLPLLGALAAAAAASFDQEFDITWGDGRGKIQDGGRRLTLTLDRTSGSGFQSRREYLFGKIDMQIKLVPGNSAGTVTAYYLSSQGSTHDEIDFEFLGNVTGEPYTLHTNVFTQGQGQREQQFRLWFDPTTDFHTYSILWNPKHIM

SEQ ID NO: 34216 - DNA, 600 bp, Panicum virgatum
  misc_feature: Ceres CLONE 1955551-R
  misc_feature: Encodes the peptide sequence at SEQ ID NO. 34217
tggaacgccgacgactgggccacgcagggcgggcgcgtcaagacggactggtcccacgcgcccttctccgcctcctaccggggcttccgggccaacgcctgcgtcgccgtcgccggcggaaagacccgctgcggcgccgccgtcggcaccgagcgcgccgccgcccccgccggcgactggtacaaccaggagctcgacctcaccctgcagcagcgcatgcgctgggtgcagcgcaagtacatgatctacaactactgcaccgaccccaagcgatccccgcagggcctccccgccgagtgctccctgcagcagtagcccacctgtccaccattcccaaccgcgcgcgtcgagctccatcggctgcaatggcggatagatcatcatcggcgtcggtctcatcttctgtggggtaaataaataaggacctggcaaattcgatcgtgggacctgtaatgcatatgcagtagctggtggtaaattcttcctgtcttgtctgtagcctgtcgcctctgttctgttcgtgtcgccttgtaattgtaaccaactcgccgtgttcgtggccgtctgtaatataccgaaagccatacgtacgtgttcttc

SEQ ID NO: 34217 - protein, 104 aa, Panicum virgatum
  misc_feature: Ceres CLONE 1955551-R
  misc_feature (44)..(100): Pfam Name: XET_C Pfam Description: Xyloglucan endo-transglycosylase (XET) C-terminus
  misc_feature: SWISSPROT Homolog: EC 2.4.1.207 Xyloglucan:xyloglucosyl transferase
  misc_feature: Functional homolog of the protein sequence given in SEQ ID NO 50903
  misc_feature: Useful for making plants with altered carbohydrate content
  misc_feature: Functional homolog of the protein sequence given in SEQ ID NO 50904
  misc_feature: Useful for making plants with altered cell wall content and/or composition
WNADDWATQGGRVKTDWSHAPFSASYRGFRANACVAVAGGKTRCGAAVGTERAAAPAGDWYNQELDLTLQQRMRWVQRKYMIYNYCTDPKRSPQGLPAECSLQQ

SEQ ID NO: 34218 - DNA, 462 bp, Panicum virgatum
  misc_feature: Ceres CLONE 1955554-R
  misc_feature: Encodes the peptide sequence at SEQ ID NO. 34219
ccaaagttcacctgccctatatgcatgaatgagctgacagaagcagcatccactgtctgcggtcacattttctgccagaagtgcatcaaggctgccattcaggctcagaagaagtgccctacctgccgaaagagccttaataaaaaccagcaccaccgggtgtacctcccgacaacggagtaatccgatagtcattttggagcaagctgtgcagcacctgaccttcaccacattgtggcgattgtatggcggagctatttagagaggcttatcgatagcaatagagtattactgcgatttaacaagtggttttgccctcgcatttgggacatcataccaagctgtatcctcagtaaagtatatcctagtatcatctggatgtcggtgttattatgttcgacgcagtatcttatcctttctgtttgggatgtgaaatatggtgcaatgtgaagttttgctggt

SEQ ID NO: 34219 - protein, 60 aa, Panicum virgatum
  misc_feature: Ceres CLONE 1955554-R
  misc_feature (5)..(42): Pfam Name: zf-C3HC4 Pfam Description: Zinc finger, C3HC4 type (RING finger)
  misc_feature: The sequence is a functional homolog of SEQ ID NO 2446 in the 10/374,780 US patent application
  misc_feature: The sequence is a functional homolog of SEQ ID NO 736 in the 10/225,066 US patent application
PKFTCPICMNELTEAASTVCGHIFCQKCIKAAIQAQKKCPTCRKSLNKNQHHRVYLPTTE

SEQ ID NO: 34220 - DNA, 663 bp, Panicum virgatum
  misc_feature: Ceres CLONE 1955554
aggaaaaaaagcacaagtcttcctgccagctcgcaaccacaaaccctagtcgctcctcgcgactcagacgacgggcttgattcgttcctgtgttctgttggcttcactcaagcctgtatcttttactgcaacactatgaactcccctggtgctggaaggcggattccgaagaggcgacggacgactaagccgctttcacagccttttgacctgaactgcccccctgctgaaggggctggtgaggggggttcacctttcagcattatgcctgtctcacacatccaggcttccagcagtatgccagtctcacacagccaggcttccagtagcatgccacctgctactaatgagccacatattggcatgcatagttgccccattgatgtggaagccattgatgatgatgttgttatctattcttcaagatcactccctcaatttcaggcaagacaacagttgaccaggactgaacgtattactgtgataatagatgatgattctgaaacgaacccagaacctgcaggggatgctcttgatgagcatgtgaatacactgctatccctgggcataaaccgcaggaatctgcctctaagagcaactagcacttgccctgtaataagtttagtggacactccagaagtcaagttgatccaggcaccccct

SEQ ID NO: 34221 - DNA, 653 bp, Panicum virgatum
  misc_feature: Ceres CLONE 1955564-R
  misc_feature: Encodes the peptide sequence at SEQ ID NO. 34222
tacggtggcggcggcgccgtccagaagtacgggtacaagcaggacgtgtacggcggcaaagctgccggagggtaccctctccaccacggcgccggcggcgcgtacggctacgaggcgcacggggcggcgagcaagacggggttcaccggcggctacaaccacaaggcgtacgactacgtgagcgagagcgagagtgagagcgactctgacgagagcgactctgacgagagcgactgcgaggaggcgttccccccgcgcggccccaccaagcagggcggcgtccacggctacgcggcggcgtaccagcacgagaagcacggggccggcagcaacctcggcggcgtgcggcgctacgagtcctacgggaggcacgaggaggtcggcggccggcgccgctacgagtcgtaccagagcaccaccaaggagtacaccggcgccggcggcggctacggctacggcacgtgctccccgctcagctacggcgcgtaggcatacgcccccgatccagttgtcctctgccatgtcgtacgtgtgccggtacttggtgggatttgttgccggtgatgcagctaaataacttaagcatctatctaaaaataagagatgtactttctgccgccctaagataataatgtatgatgatgaaactcacg

SEQ ID NO: 34222 - protein, 162 aa, Panicum virgatum
  misc_feature: Ceres CLONE 1955564-R
  misc_feature: Functional homolog of the protein sequence given in SEQ ID NO 51438
  misc_feature: Useful for making plants with modulated time to senescence
YGGGGAVQKYGYKQDVYGGKAAGGYPLHHGAGGAYGYEAHGAASKTGFTGGYNHKAYDYVSESESESDSDESDSDESDCEEAFPPRGPTKQGGVHGYAAAYQHEKHGAGSNLGGVRRYESYGRHEEVGGRRRYESYQSTTKEYTGAGGGYGYGTCSPLSYGA

SEQ ID NO: 34223 - DNA, 642 bp, Panicum virgatum
  misc_feature: Ceres CLONE 1955564
acgccaacacagagcaagcagagcggcccgagcaagaagagagatagctcctgcgccatggctacggcggttgtgaagcgtggctacggcggctacgacgactacgacggctacgactacggctacgactgtggctacagcaagccgcaggtgaactaccaccgccagaacaccgagtacgtgaccaccgtcgtcgcggagatgaaccgcatgaccgtcaacgacaagcccagctgcggcggcgccggcgccggcgtgcagaagcaggccgcctacaaggaggaggtgtacgagggggccgccgccggcgtgaagaaggatgcctactacaagcaggagaagtacggcgaggcggccggagggtacggcggcggcgccgtcgtgaagaagcaaggaggatacaataagcaggaggcttgcggggagaccgacacgggccacttcggtgccggcgccatgcagacgtacgcctacgaccagcaggcggcgtacggcggcggcgtgcagcagcacggctaccagaaggacgcgtgcggcggcggagccgcgaagaagaacagctacaagcacgagccgtcgtacggcgagtgcgacgcggcggagtatggctctcgctacggttacggcggcggcgccgtgcag

SEQ ID NO: 34224 - DNA, 733 bp, Panicum virgatum
  misc_feature: Ceres CLONE 1955570
  misc_feature: Encodes the peptide sequence at SEQ ID NO. 34225
agccgccgccgctcccagcccgtgcgtgctccgctcctcgccgccgccgcacctccgccgcgaagcgcatcggaacacttccttcaacatggggaagacacgtggtatgggagctgggcgcaagctcaagacccaccgcaggaaccagaggtgggctgacaaagcatacaagaagagccatttgggcaatgagtggaagaaaccctttgctgggtcatctcatgccaagggcatcgttctggagaagattggtattgaggccaaacagccaaactctgctatccgtaagtgtgctcgtgttcagcttgtgaagaatggcaagaagattgctgctttcgtgccaaatgatggttgcttgaactacatcgaggaaaatgatgaagtgttgattgctggatttggtcgtaagggtcacgctgtgggagatattcctggtgtccgattcaaggttgtcaaggtttcgggtgtgtctctgcttgcccttttcaaggagaagaaggagaagccaaggtcttagattgctctcgacacttgatattagcaagcatgtagtagaaaatttgaaggctttagatgtttaagaatggctgcttgctatgtttacagctcactcttgcagttgttaatctaagattgtgttggtgaaaacttcctgtcagacttgcttctgttaagagaatagtactatcatgagttttgttcgccgagaatgttagcagcttgccttttccgg

SEQ ID NO: 34225 - protein, 142 aa, Panicum virgatum; identical to SEQ ID NO: 12276
  misc_feature: Ceres CLONE 1955570
  misc_feature (8)..(141): Pfam Name: Ribosomal_S12 Pfam Description: Ribosomal protein S12

SEQ ID NO: 34226 - DNA, 899 bp, Panicum virgatum
  misc_feature: Ceres CLONE 1955584
  misc_feature: Encodes the peptide sequence at SEQ ID NO. 34227
aaaaaggcaagcaaagcctctcatgccaagcacgcatacctccctacttttagtctcctctacaactcttccgctctgcagctgctcgtagcatagcatcctcatcttcctcctcatagtcaggtactagaacaccagcaggagaacatctgctctcttgtttcttccatggcggtggcgacagagaccccgttccatgtcctggccgtggatgacagcctcccggacaggaagctcatcgagaggctcctcaagacctcttccttccaagtcaccactgtcgattccgggagcaaggcgctggagttcctggggatccatggcgaggacagcagcccaccagtttcggttcacgcagaccagctggaggttgcggtgaatctgatcatcacagactactgcatgcctggcatgacaggatatgatctgctcaagaagatcaaggaatcaacatctctaagagacatcccagtggtgatcatgtcgtccgagaacattccttcaagaatcaatagatgcctggaggaaggagcggacgagtttttcctaaaaccagtgcggctatcagacatgagcaagctgaagccccacatactgaaaagcagatgcaaagagcactaccaccaggaacagaaccagcaatgcgacagcaacagcaacgaatgcagtaaccccccgaacaacagcagcagtgataacagcaacagccgcaagagaaaggcagaagacaaagaagaagttttgcccccgacaaacagatcaaggcacagttagctgcaaactgattataggagaattaacccccttttctcccttgtttttttgttttacttagattttggcctactgatttgtaacacaggcgttaaccatttgcaaaatattatgaacttcaacag

SEQ ID NO: 34227 - protein, 201 aa, Panicum virgatum
  misc_feature: Ceres CLONE 1955584
  misc_feature (9)..(139): Pfam Name: Response_reg Pfam Description: Response regulator receiver domain
  misc_feature: SWISSPROT Homolog: EC 3.1.4.17 3',5'-cyclic-nucleotide phosphodiesterase
  misc_feature: Functional homolog of the protein sequence given in SEQ ID NO 51179
  misc_feature: Useful for making plants with modulated low light sensitivity
  misc_feature: Useful for making plants with modulated nitrogen use efficiency
  misc_feature: Functional homolog of the protein sequence given in SEQ ID NO 51180
  misc_feature: Useful for making plants with altered carotene content
  misc_feature: Useful for making plants with altered lignin content
  misc_feature: Useful for making plants with altered terpenoid content
  misc_feature: The sequence is a functional homolog of SEQ ID NO 932 in the 10/666,642 US patent application
MAVATETPFHVLAVDDSLPDRKLIERLLKTSSFQVTTVDSGSKALEFLGIHGEDSSPPVSVHADQLEVAVNLIITDYCMPGMTGYDLLKKIKESTSLRDIPVVIMSSENIPSRINRCLEEGADEFFLKPVRLSDMSKLKPHILKSRCKEHYHQEQNQQCDSNSNECSNPPNNSSSDNSNSRKRKAEDKEEVLPPTNRSRHS

SEQ ID NO: 34228 - DNA, 906 bp, Panicum virgatum
  misc_feature: Ceres CLONE 1955586
  misc_feature: Encodes the peptide sequence at SEQ ID NO. 34229
ctatcttgtggggagatggcggtttctttcgctaacctcaactctgaggcagggcttaaaaagcttgacgactaccttctcactcacagctacattactggttaccaagcttccaaggatgacttggctgtctactcctcattttctgctgctccctcatccaagtatatcaacgtcacaaggtggttcagtcacattgatgcactcttgaggctgagtggagttactgcagagggccaaggtgtcaaggttgaatcatctgctgttccatcagcatcaacacctgatgttgctgacacagcggctgcacctgctgatgacgacgacgatgatgatgttgacctttttggcaaggacaccgaagaggagaagaaggctgctgaagagcgtgctgcasctgtcaaggcttctggcaagaagaaagaatctgggaagtcgtcagttttgcttgatgtgaagccatgggatgatgagactgacatggccaagcttgaggaagcagtaaggaatgtcaagatggaaggactgctctggggtgcatccaagcttgtcccagttgggtatggcatcaagaagcttcagatcatgttgactattgttgatgaccttgtctctgttgacactctgatcgaggaccatctgtgcgctgagccagtgaatgagtacgtccagagctgtgacattgttgccttcaacaagatctaaatctgctgagctccggctgtgtggtcagtggacagtgcaccggtccaatttatccagagttttgcatcactatgtctgccccgtgtgtcgactagttattgcctgtgaggtttttggaacctagtcaaaagtgtaccagttactgttaccagggttaatttgccttatttgaaagaccgactggctggatttttcgtttcc

SEQ ID NO: 34229 - protein, 229 aa, Panicum virgatum
  misc_feature: Ceres CLONE 1955586
  misc_feature (140)..(229): Pfam Name: EF1_GNE Pfam Description: EF-1 guanine nucleotide exchange domain
  misc_feature: SWISSPROT Homolog: EC 6.1.1.16 Cysteine--tRNA ligase
  misc_feature (128)..(128): Xaa is any aa, unknown, or other
MAVSFANLNSEAGLKKLDDYLLTHSYITGYQASKDDLAVYSSFSAAPSSKYINVTRWFSHIDALLRLSGVTAEGQGVKVESSAVPSASTPDVADTAAAPADDDDDDDVDLFGKDTEEEKKAAEERAAXVKASGKKKESGKSSVLLDVKPWDDETDMAKLEEAVRNVKMEGLLWGASKLVPVGYGIKKLQIMLTIVDDLVSVDTLIEDHLCAEPVNEYVQSCDIVAFNKI

SEQ ID NO: 34230 - DNA, 692 bp, Panicum virgatum
  misc_feature: Ceres CLONE 1955588
  misc_feature: Encodes the peptide sequence at SEQ ID NO. 34231
gacggaacgcaatcttgcaatccagcccccgaaagaaaccttaaatcgcccccaggttctcgatcgcaccgaggaaggaggaggaatggcggccgaggtgatcgcgtgccacaccaaggaggagttcaagacccagatggacaaggccaaggaggccggcaagctggtgatcattgacttcactgcctcctggtgtggtccttgccgcatcatcgcccctgtgtttgctgaattagccaagaagttcactgatgctttcttcctgaaggttgatgttgacgagctgaaggacattgccgcggagtacaatgtcgaagcgatgccgaccttcctcttcatcaagaatggtgaaaagatccacactgtcgtcggtgccaggaaggaggagctccaggccggcatcgagaagcatgccgcccccactgctgcttccgcgtccgcctaaggcgatagcgtgtcacctgtcatcaataagggccagcccatggcgtggtagcagtaggcgtcgcaactttcagtttggtttgggtgaattgtgagctatgtccaactctggaggccggatatgtttggttcccgtgctggatctgttatcatcctgaatgcctgtgtttttttttttgggtaattcctgaatgcctgtgttgatatggatgctttgtgactgaagtttgaatccggattgtctgact

SEQ ID NO: 34231 - protein, 119 aa, Panicum virgatum
  misc_feature: Ceres CLONE 1955588
  misc_feature (5)..(109): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature: Functional homolog of the protein sequence given in SEQ ID NO 50138
  misc_feature: Useful for making plants with modulated nitrogen use efficiency
MAAEVIACHTKEEFKTQMDKAKEAGKLVIIDFTASWCGPCRIIAPVFAELAKKFTDAFFLKVDVDELKDIAAEYNVEAMPTFLFIKNGEKIHTVVGARKEELQAGIEKHAAPTAASASA

SEQ ID NO: 34232 - DNA, 571 bp, Panicum virgatum
  misc_feature: Ceres CLONE 1955598
  misc_feature: Encodes the peptide sequence at SEQ ID NO. 34233
aagccacgcgttactgacgtcaagcgccgccccctcctcccattcctctgcggctctgcctgctcggatccacctccacctctcgcgcccgccgccgccgccgccgtcgccgcgatgggcctcttcgacgcgctctaccgcgtggtgatgcgccgcaacgccgtctacgtcaccttcgtcgtcgccggcgccttcgcgggcgagagggcggtggattacggagtccacaagctctgggagatgaacaacgtcgggaaaaggtatgaagatataccagttctggggcaaaggccagctgaagaatgagagcattggagctcagactacccaggatgtcgctttccatgaaattagattccatttaagcaatggtttatcattcctttttgacataataacaaccaatgtaaaatccaaactctttccgggagttgctacccgttcaattactcagcaggctgttggagtttcctgatgcatggttagaacctgttatctagccaggcatcggcatgtttggcatgtttggtcgaaaacttgaaatgccatgaatgagaaatgttttgttggc

SEQ ID NO: 34233 - protein, 63 aa, Panicum virgatum; identical to SEQ ID NO: 13073
  misc_feature: Ceres CLONE 1955598
  misc_feature (4)..(58): Pfam Name: UCR_UQCRX_QCR9 Pfam Description: Ubiquinol-cytochrome C reductase, UQCRX/QCR9 like

SEQ ID NO: 34234 - DNA, 814 bp, Panicum virgatum
  misc_feature: Ceres CLONE 1955615
  misc_feature: Encodes the peptide sequence at SEQ ID NO. 34235
gaccatcgtagtagcaaagctagcccacttttccttgacttgaccccgcgcgccggacggagctctttttttaaaggcagcaagcccaaccaaacccttctccttcgagaggtcgccgaggagagctgcgcctgcgagggaggaggaggagcttcggaggggaagaagaagaggggggagccatgctggaccatctcgtcgggctggtgagggtgcgcgtggtcaggggggtgaacctcgccatccgcgacctccgatccagcgacccctacgtcgtcgtccgcatcggcaagcagaggctgaggacgaagggggtcaagaagaacaccaaccccgaatggaacgaggaactcaccctctcgattgaagaccctgcacatcctgtcagactggaagtgtttgacaaggacacattcgtcgatgatttgatgggcaccgcagagctggacatccgcccgttggttgaggtcgtgaagatgaagctccaggatgttgccgatggaactgtggtaaagaaactggtgcccaacagacagaactgcctggccgaggagagctccatttacatctccgaggggaaggtgaagcaggacctggttatcaggctgaagaacgtggagtgcggggagatagagctccagcttcagtgggtcgacctccctggttccaagagtgtatgagctccgctctgccctgctgttctcaggggttctcgagtgaaagtaaagttcatgtgacgaatgtaaatgtaatctaaggatggttatggtacagcaagtgctgaactgctgattaggattttttatgttctttt

SEQ ID NO: 34235 - protein, 165 aa, Panicum virgatum
  misc_feature: Ceres CLONE 1955615
  misc_feature (9)..(87): Pfam Name: C2 Pfam Description: C2 domain
  misc_feature: SWISSPROT Homolog: EC 2.7.11.13 Protein kinase C
MLDHLVGLVRVRVVRGVNLAIRDLRSSDPYVVVRIGKQRLRTKGVKKNTNPEWNEELTLSIEDPAHPVRLEVFDKDTFVDDLMGTAELDIRPLVEVVKMKLQDVADGTVVKKLVPNRQNCLAEESSIYISEGKVKQDLVIRLKNVECGEIELQLQWVDLPGSKSV

SEQ ID NO: 34236 - DNA, 667 bp, Panicum virgatum
  misc_feature: Ceres CLONE 1955630
  misc_feature: Encodes the peptide sequence at SEQ ID NO. 34237
actctcccccctccccccagagcagagagcagacagagcccagcatgtcgtcgtcgtccaaggtcttcaccctcgaggaggtcgccaagcacaacaccaaggacgactgctggctcatcatcgccggcaaggtgtataatgtgaccaagtttcttgaggatcaccctggaggtgatgatgttctgttgtcttccactgccaaggatgctactgatgacttcgaagatgtgggccacagcaccactgctcgtgcgatgatggacgagtacttagtcggcgaaattgatgcaactacaatacccactaaggtgaagtacacgcccccgaagcagccgcactacaaccaggataagacccctgagttcatcatcaagattctccagtttttggtccccttggcaatattgggcttggctgtcgccgtaaggatctacaccaagtcggaatcctcctaataccgtcatcattcgatcaaagattacaactgaataagttagtgaggattgtacgagctagcatggcctgtcatgaatttggaaacttcagtctctgtgatggtatggttacgtgcaacatctattcgtaaagtgagacaagtgaagtggatggatattcagttctatttgccttattccttaggaatgtcaagatgcacattatgttgctc

SEQ ID NO: 34237 - protein, 136 aa, Panicum virgatum
  misc_feature: Ceres CLONE 1955630
  misc_feature: SWISSPROT Homolog: EC 1.7.1.1 Nitrate reductase (NADH)
MSSSSKVFTLEEVAKHNTKDDCWLIIAGKVYNVTKFLEDHPGGDDVLLSSTAKDATDDFEDVGHSTTARAMMDEYLVGEIDATTIPTKVKYTPPKQPHYNQDKTPEFIIKILQFLVPLAILGLAVAVRIYTKSESS

SEQ ID NO: 34238 - DNA, 945 bp, Panicum virgatum
  misc_feature: Ceres CLONE 1955634
  misc_feature: Encodes the peptide sequence at SEQ ID NO. 34239
gatctacagtgttactgacttgcgtggtgctcccctcgcgcaggcaagctgtccgccgacggcgctacgacccccgctggcctgatctcggcggcggtggcgcacgccttcgccctgttcgtggccgtttccgtcggcgccaacatctccggcggccacgtgaacccggccgttaccttcggcgccttcgtcggcggcaacatcaccctgttccgcggcctcctgtactggatcgcccagctcctgggatccaccgtggcgtgcttcctcctccgcttctgcaccggcggcctcgccaccggcaccttcggcctgaccggcatctccgtgtgggaggccctggtcctcgagatcgtgatgaccttcgggctggtgtacacggtgtacgcgaccgccgtggacccgaagaagggcagcctgggcaccatcgcccccatcgtcatcggcttcatcgtgggcgccaacatcctggtcggcggcgccttcgacggcgcgtcgatgaaccccgccgtgtccttcggccccgccctcgtgagctggtcctggacccaccagtgggtgtactgggtcggccccctcattggcggcggcctcgccggmgtcatctacgargtgcttcttyatctcccacacccacgagcagctccccaccaccgactactgagctgaggggtgagggttcggttgccgccgccgacgttcgcgtgcagccgccggttcctccgtccgtttgatcagttcggcaccgcagccgtttaagttagttttccctcgctccgcgtgctgcttgcatcgaccaccgccatgcttagcttgtaccatgaacccgaactttccgccgccgctgcgccgctccccatggtttgcttcgatcagtcgcatcaagttggaaactgtaaccgccaccgtgaattccggaccccgtttgcatgcttctgtaaaaaa

SEQ ID NO: 34239 - protein, 103 aa, Panicum virgatum
  misc_feature: Ceres CLONE 1955634
  misc_feature (1)..(84): Pfam Name: MIP Pfam Description: Major intrinsic protein
  misc_feature (89)..(89): Xaa is any aa, unknown, or other
MTFGLVYTVYATAVDPKKGSLGTIAPIVIGFIVGANILVGGAFDGASMNPAVSFGPALVSWSWTHQWVYWVGPLIGGGLAGVIYEVLLXLPHPRAAPHHRLLS

SEQ ID NO: 34240 - DNA, 759 bp, Panicum virgatum
  misc_feature: Ceres CLONE 1955642
  misc_feature: Encodes the peptide sequence at SEQ ID NO. 34241
cctagccccccgccgccgccagccctcgccctcttccaaaccctacccgcacccccgccgccgccgccatgccgccgaagctcgacccgtcgcaggtggtggaggtcttcgtccgcgtgacgggcggcgaggtcggcgcggcgtcgtcgctggcgcccaagatcggcccgctcgggctctccccgaagaagatcggtgaggacatcgccaaggagacggccaaggactggaagggcctccgcgtcaccgtcaagctcaccgtccagaaccgccaggccaaggtctcggtcgtgccctccgccgccgcgctcgttatcaaggcgctcaaggagcccgagagggacaggaagaaggtcaagaacatcaagcacagcggcaacatcagcctcgacgacgtcatcgagatcgccaggaccatgagggctaggtccatggccaaggagatggccgggaccgtcaaggagatcctcggcacctgcgtcagcgtcgggtgcaccgtcgacggcaaggaccccaaggacctgcagcaggagattgacgacggcgaggtcgagatcccctcagcttaaaggctaaggagattgtcattgatgctgctgaagtggtgctctgttctgcatgctgttgtaccttaccaaacaatgtgattccaccttttttttactaccgctattagtgttgtcctgtgagagaactcaatgttattactgcatccttttccattgggagtccggaatggagactttcaaacacatctgc

SEQ ID NO: 34241 - protein, 166 aa, Panicum virgatum; identical to SEQ ID NO: 28731
  misc_feature: Ceres CLONE 1955642
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain

SEQ ID NO: 34242 - DNA, 923 bp, Panicum virgatum
  misc_feature: Ceres CLONE 1955645
  misc_feature: Encodes the peptide sequence at SEQ ID NO. 34243
ttccgagtctgctctagggtttttgccacgccgccgccgcctcctcctctcccaacaaccgaaacctcaagatgacggcccagaccgccgaggagcttgccgcccagatagagcagcagaagctcgaggagcagaagaccgaggcagaggaggtcgtggttgaggatgatgaggatgaggatgacgatgatgaagatgatgacaaggacgacgatgaagtggagggacaagaaggtgatgccagtggcaaatcaaagcaaagcaggagtgagaaaaaaagccgcaaggcaatgctgaagcttggcatgaagtccatcactggtgtcagccgtgtcactgttaagaaaagcaagaacatattgtttgtcatctccaagccagatgtattcaagagcccaaattcagacacatatgttatctttggtgaggccaagatcgaggacctcagctcccagctgcagacgcaggctgcagaacagttcaaggcccctgacctgagccagatgatgccaaagcctgagacctctggcctgggccaggaggacaacgaggaggaggttgacgagaccggtgttgagcccaaggacattgagctggtgatgacccaggcatcggtgtcgcggatgaaggctgtcaaggctctcaagtcatctggcggagacatcgtatcggctatcatggaccttacaaattagccatcgtgccggctgtcatgaatgaactttttcttgtctcttttgtgtgctatgcagctgtgcgaaccttatgctttgataaaaaaaattttatagttgttgaacccttacgtcaaggtcattccagtatgattcccttttttgctgcctgcagctacaatttatagcttatggtcttgtctgtactctcttttatcagaatcatgagatctcctttttcgccgccag

SEQ ID NO: 34243 - protein, 207 aa, Panicum virgatum
  misc_feature: Ceres CLONE 1955645
  misc_feature (65)..(124): Pfam Name: NAC Pfam Description: NAC domain
  misc_feature (168)..(205): Pfam Name: UBA Pfam Description: UBA/TS-N domain
MTAQTAEELAAQIEQQKLEEQKTEAEEVVVEDDEDEDDDDEDDDKDDDEVEGQEGDASGKSKQSRSEKKSRKAMLKLGMKSITGVSRVTVKKSKNILFVISKPDVFKSPNSDTYVIFGEAKIEDLSSQLQTQAAEQFKAPDLSQMMPKPETSGLGQEDNEEEVDETGVEPKDIELVMTQASVSRMKAVKALKSSGGDIVSAIMDLTN

SEQ ID NO: 34244 - DNA, 708 bp, Panicum virgatum
  misc_feature: Ceres CLONE 1955653
  misc_feature: Encodes the peptide sequence at SEQ ID NO. 34245
gaaccagaggacggtaggtggtaaaggactgtcgtcggtgctggttggtttttgtgtgtgtgtgtggcatcgttatcctcatcgtcttggtagctagctagtgatgcttgaatgcatctatgcatgccaccgagatcatccaagaagtacaggggcacgtaattctcattttctgccagcagggcatgtgatgtgagatcgccaagtgatccaaagccggccgttgcttatggaccaattagtgatggaaaaccatgtcgacaagctaaggacgatgatcctcgatctctcactcacctctgcccggatcgatcgacatcgacgacgatatgagctccgtggacgccaccggcggcgagaagaagacgtcgtggccggaggtggtgggcctgccggcggaggaggccaagaagatcatcctcaaggacatgcccgacgccgacgtcgtcgtcctgccggccggctcgccggtgaccatggactggaggtccaaccgcgtccgcgtcttcgtcgacaccgtcgctcggaccccggcggtgggctgaaccaacgataaaccgcctcctgctggatcaaagccgctgctagctcacccttgattttcctgaatgtcttcaccataaaagggaagacctagagatcgaagcacaaataatggagctagctagcggctatctgaaataaaatttatggaatgcatgaataaat

SEQ ID NO: 34245 - protein, 71 aa, Panicum virgatum
  misc_feature: Ceres CLONE 1955653
  misc_feature (12)..(71): Pfam Name: potato_inhibit Pfam Description: Potato inhibitor I family
MSSVDATGGEKKTSWPEVVGLPAEEAKKIILKDMPDADVVVLPAGSPVTMDWRSNRVRVFVDTVARTPAVG

SEQ ID NO: 34246 - DNA, 666 bp, Panicum virgatum
  misc_feature: Ceres CLONE 1955655
  misc_feature: Encodes the peptide sequence at SEQ ID NO. 34247
catgacaatccccaagggaaccttgttccccatgtgcggcatgaaccttgccttcgacagggatctcattggccctgctatgtactttggtctcatgggtgatggccagcctattggtcgctacgacgacatgtgggctgggtggtgtgtgaaggtcatctgcgaccacttgagcctgggtgtcaagactggcctgccatacatctggcacagcaaggctagcaaccccttcgttaacttgaagaaggaatacaagggcatcttctggcaggaggacatcatccccttcttccagaacgtgaccatccccaaggagtgcgacacggtccagaagtgctacatctacctttctgggcaggtgaaggagaagctgggcaagatcgacccctacttcgtcaagcttgccgacgccatggtcacctggatcgaggcctgggatgagctgaacctaaccgccgccgccgctgcgaagggcaaggccaagtagagggagtccctggtcttcacttccccttcgaagtgatgaaagtatgattggggcctgcctaggccccatagatatagctccttttgagagggaagagagattaattcagcagcagcttttataattctttgttgttatgataccgtggttcttttgtagttgatgaaagggatttgtcc

SEQ ID NO: 34247 - protein, 151 aa, Panicum virgatum
  misc_feature: Ceres CLONE 1955655
  misc_feature (1)..(143): Pfam Name: RGP Pfam Description: Reversibly glycosylated polypeptide
MCGMNLAFDRDLIGPAMYFGLMGDGQPIGRYDDMWAGWCVKVICDHLSLGVKTGLPYIWHSKASNPFVNLKKEYKGIFWQEDIIPFFQNVTIPKECDTVQKCYIYLSGQVKEKLGKIDPYFVKLADAMVTWIEAWDELNLTAAAAAKGKAK

SEQ ID NO: 34248 - DNA, 659 bp, Panicum virgatum
  misc_feature: Ceres CLONE 1955656
  misc_feature: Encodes the peptide sequence at SEQ ID NO. 34249
gtagacagagccacagcccaccgcagcacacaattccaaaagaaagagagagatagagagaaaaagaaaggagaaggggggctagggttttggcgtccgaaatcgcagccatcgacgccgcctcatccaactccagcgagcaaggagattccaaggcggcgtcggccccggcccctaatcccctctatcggcagcgcagatggcttccggcggcccggcgctcgagtcgctcgtcgaccaggtcatctccgtcatcaccaacgatggccgcaacattgtgggcacgctcaggggatttgaccaggccaccaacattatcctcgacgagtcccacgagagggtctattctacgaaggagggagtccaacaacttgttcttggtttgtacattatcagaggtgacaacataagcgttgtgggtgaggtggacgaagacctggatgcaaggttggatctgtcgaagctaagagcacacccactgaagccggtcatccattgagcgctgctgcgggatcagatgcacttggactgggtgcgtcggtattctgattattgttgtatgcgggatgtagcatggtcgtcgagggggatcgagtaatatggacactgtatcgtgcttactattgtgaatcaatgaatgtgttggctgttgggttgcg

SEQ ID NO: 34249 - protein, 99 aa, Panicum virgatum
  misc_feature: Ceres CLONE 1955656
  misc_feature (6)..(75): Pfam Name: LSM Pfam Description: LSM domain
MASGGPALESLVDQVISVITNDGRNIVGTLRGFDQATNIILDESHERVYSTKEGVQQLVLGLYIIRGDNISVVGEVDEDLDARLDLSKLRAHPLKPVIH

SEQ ID NO: 34250 - DNA, 733 bp, Panicum virgatum
  misc_feature: Ceres CLONE 1955657
  misc_feature: Encodes the peptide sequence at SEQ ID NO. 34251
gtgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcctccgagcagtcgatgctggacgccatcgaagccatgaacggcaaggagctcgacggccgcaacatcaccgtcaaccaggctcagtcccgcggcggcggcggcggcggcggctacggcggcggtcgtcagggtggctacggcggcggcggcggctacggaggcggtggtggctacggcggtggtcgccgtgagggcggctacggcggaggcggtggcggcggtcgccgcgagggcggctacggtgatggtggctacggcagccgcggtgactccggtggtaactggaggaactgatggggtggccctcccgtgctggcagccaagttatcctatatatctattagtgttcgtgtcactgtttgatccgagttacccctgagttttgttcgtgtgttaccgttcgattaggtgttggttcccatgtttaccgttcccgagttgtttccgcaataaaatgagaagaaaagagtgtctctcggttcac

SEQ ID NO: 34251 - protein, 154 aa, Panicum virgatum
  misc_feature: Ceres CLONE 1955657
  misc_feature (10)..(81): Pfam Name: RRM_1 Pfam Description: RNA recognition motif. (a.k.a. RRM, RBD, or RNP domain)
  misc_feature (48)..(146): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: Functional homolog of the protein sequence given in SEQ ID NO 50144
  misc_feature: Useful for making plants with altered terpenoid content
  misc_feature: Functional homolog of the protein sequence given in SEQ ID NO 50179
  misc_feature: Useful for making plants with modulated phosphate use efficiency
MAAADVEYRCFVGGLAWATDNASLQQAFASYGDVLDSKVITDRETGRSRGFGFVTFSSEQSMLDAIEAMNGKELDGRNITVNQAQSRGGGGGGGYGGGRQGGYGGGGGYGGGGGYGGGRREGGYGGGGGGGRREGGYGDGGYGSRGDSGGNWRN

SEQ ID NO: 34252 - DNA, 658 bp, Panicum virgatum
  misc_feature: Ceres CLONE 1955666
  misc_feature: Encodes the peptide sequence at SEQ ID NO. 34253
caatcttgacaagtgcagtacttatgtgtcgacagaaaatgttgttggtacgcgaggatacctagatccagaataccatgccacaatgcgactgacaaggaagagtgacgtattcagcttcggcgtggtgctgctggagttgatcacggggaagccagcaattctgcctgccccggattttattagtatcatccaatggacgtcgcggcgcttgaggtgcggcgagattgagagcgtcgtggatgagcgcatgaatggcgaccatgacatcaacagcatctggaaggcagctaacgttgctcgtgactgcactgcacccacttcgacggagcggcctaccatgaccgacgtggttgcgcagctgcaggagtgcctggtgctagaagaagcccgtgcaggtgttgacactggcaacagcggcgatctcaactcgaattacagcacaaatgcgaacactgctaatgctagtcagcgtagcgctgcgtttgagatggtggaaatgatggacactggtcctgccacaagatgaaggcttccttgaagtctgtttcaaccactagtattttcttaataagatattgatggtgtgttttctagtgtatacgagtgtcgtgccatggacatgtgcagcacgatctcagttctcaaaaaggctttg

SEQ ID NO: 34253 - protein, 175 aa, Panicum virgatum
  misc_feature: Ceres CLONE 1955666
  misc_feature: SWISSPROT Homolog: EC 2.7.11.1 Non-specific serine/threonine protein kinase
NLDKCSTYVSTENVVGTRGYLDPEYHATMRLTRKSDVFSFGVVLLELITGKPAILPAPDFISIIQWTSRRLRCGEIESVVDERMNGDHDINSIWKAANVARDCTAPTSTERPTMTDVVAQLQECLVLEEARAGVDTGNSGDLNSNYSTNANTANASQRSAAFEMVEMMDTGPATR

SEQ ID NO: 34254 - DNA, 671 bp, Panicum virgatum
  misc_feature: Ceres CLONE 1955674
  misc_feature: Encodes the peptide sequence at SEQ ID NO. 34255
acacaacagatcaagatcattaccaaggcaagcttggtagctgctgtccattcttgctccttgaaaatacaccaggaaaaagataaacacattcattgattagccttcttgtgccttccgagtaaccgtcgtacatttccaaagttaaggcaagatgagttccgtgaagaccctgcgcaagaacaactggaaagacgctctccagaaggctaaacaggaggataggctgctggtgatggaattcatggcttcgtggtccgagccctccaagctgatgaaccctattgtcgccaacaccatagcccccgaccccaagttcagagacaaggtcgacttctgcatgctcgacgtcgacgagttcaaggatttggctcgctcgctccgtgtggaggcgctgccgactttcctgctggtgaaggactactacgtgaagaaacgcgtcgtgggggtcgacaaggatgaactccggagcagcatcttagagcagttgggtcaggcatcgtccaataatgcctgatgggcctcaagaatctctgatggtgtctgggcacacgcatgcatatcgatgtgatgagcccttggtgtatgtgtaattccttcagggccgctagatcacgcacatcttgaggccctgaacataaataaataaataaataaataaggtttggtat

SEQ ID NO: 34255 - protein, 120 aa, Panicum virgatum
  misc_feature: Ceres CLONE 1955674
  misc_feature (3)..(111): Pfam Name: Thioredoxin Pfam Description: Thioredoxin
  misc_feature: SWISSPROT Homolog: EC 1.8.1.9 Thioredoxin-disulfide reductase
MSSVKTLRKNNWKDALQKAKQEDRLLVMEFMASWSEPSKLMNPIVANTIAPDPKFRDKVDFCMLDVDEFKDLARSLRVEALPTFLLVKDYYVKKRVVGVDKDELRSSILEQLGQASSNNA

SEQ ID NO: 34256 - DNA, 766 bp, Panicum virgatum
  misc_feature: Ceres CLONE 1955684
  misc_feature: Encodes the peptide sequence at SEQ ID NO. 34257
agatcccagcttcacgatcccccttcggccgccacccctcaagaccccaaacctcttggcccttccctcctcccaccgccgccgccaaagccccgcgtcgaagaaatggtgagagtaagtgtgctcaatgatgcccttaagagcatgtacaatgctgaaaagcgtggcaagcgccaggacatgatcagaccttcgtcgaaggttatcattaagttcctcatcgtcatgcaaaagcacggatacattggggagtttgagtttgttgatgatcatcgttctggtaagatagtagttgaactcaatggaaggctcaacaaatgtggtgtgatcagcccacgctttgatgttggtgtgaaggaaattgagtcctggacagcgaggctgcttccctcacgtcagtttggctacattgttctcaccacctctgccggcatcatggaccatgaagaggcgaggagaaagaatgtgggagggaaggtccttggcttcttctmctaagaaaacctagtatccacatatcagattatcccagaaactgttattaagttaaaagaatatagttatcgtagctgtctagaagacaaaagcatgcgaagatcacctgttctgcattgccttgttctggattttgttgacccatttagttgctgcttggccccctttttggctcgtgcatcagttggatgcaatctgctggtgtacctggtatgttagttctgaatcttggtactacgatgagctcacttgagctgagcgcatgttgagc

SEQ ID NO: 34257 - protein, 130 aa, Panicum virgatum
  misc_feature: Ceres CLONE 1955684
  misc_feature (5)..(130): Pfam Name: Ribosomal_S8 Pfam Description: Ribosomal protein S8
  misc_feature (130)..(130): Xaa is any aa, unknown, or other
MVRVSVLNDALKSMYNAEKRGKRQDMIRPSSKVIIKFLIVMQKHGYIGEFEFVDDHRSGKIVVELNGRLNKCGVISPRFDVGVKEIESWTARLLPSRQFGYIVLTTSAGIMDHEEARRKNVGGKVLGFFX

SEQ ID NO: 34258 - DNA, 709 bp, Panicum virgatum
  misc_feature: Ceres CLONE 1955688
  misc_feature: Encodes the peptide sequence at SEQ ID NO. 34259
aggacagtcccgtcagtcggaccccgcctccgcccctcacctcccgctcgccggaggcccggccgcggccggcggcgatggggcacggcgccagctgcggccgccccagggacggaggtggacttcttcggcgccgcgcactcgggcgacctcgcccgcctcgccgcccccctgcgctcccgccccaccctgctcagccggaccacgctcttcgaccgcctctccgcgctccacatcgccgccgcccacggccacctccaggtggtctcgctggcattggacctttgcgtgcacccggatgtcgtcaaccgccacaagcagacggcgctgatgctcgcggcgatgcacgggaagacggactgcgttcgccggttgctcgacgccggcgccaatatcgtgatgttcgattcgtcgcacgggcggacgtgcctgcactacgcggcgtactacgggcacgcggactgcctccgggccatcctctcggcggccaagtccgcgccggtgtcggaatcctgggggttcgcgcgcttcgtgaacgtgcgggacgacgccggggcgacgccgctgcacctcgcggcgaggcagggctggcggcgctgcgtccacgtcctgctcgagaacggcgccatcgtgtcggcctccagtggcgccttcgggtcgggattcctcctcctcctcctctcatgtcaaacgacgacgcatttttatg

SEQ ID NO: 34259 - protein, 236 aa, Panicum virgatum
  misc_feature: Ceres CLONE 1955688
  misc_feature (105)..(137): Pfam Name: Ank Pfam Description: Ankyrin repeat
  misc_feature (184)..(216): Pfam Name: Ank Pfam Description: Ankyrin repeat
  misc_feature (72)..(104): Pfam Name: Ank Pfam Description: Ankyrin repeat
  misc_feature: SWISSPROT Homolog: EC 2.1.1.43 Histone-lysine N-methyltransferase
RTVPSVGPRLRPSPPARRRPGRGRRRWGTAPAAAAPGTEVDFFGAAHSGDLARLAAPLRSRPTLLSRTTLFDRLSALHIAAAHGHLQVVSLALDLCVHPDVVNRHKQTALMLAAMHGKTDCVRRLLDAGANIVMFDSSHGRTCLHYAAYYGHADCLRAILSAAKSAPVSESWGFARFVNVRDDAGATPLHLAARQGWRRCVHVLLENGAIVSASSGAFGSGFLLLLLSCQTTTHFY

SEQ ID NO: 34260 - DNA, 786 bp, Panicum virgatum
  misc_feature: Ceres CLONE 1955702
  misc_feature: Encodes the peptide sequence at SEQ ID NO. 34261
aagctaagccccaccacgtaacactcgctgtaattaccaaaatgccactcttcttcttcaaattcgcaccactcgtcccccggctccgccgcctctccacggcggcggcgaccgccgccggcgaggatcctaagctatcgcggatcgcggacgagctcctcgccctctccccagccgagctagacgactacgccgcgctcctgcgcctcaagctccgcctctcgctcacctccagcgcggccgcgggaggcgcctctccggccggggccggggacgccgcggcgggagcagaggaggcagccgccgcggtgaagacggcgttcgacgtgaagatcgagaagtacgaggccgcggcgaagataaagatcatcaaggaggtgcgcgcggtgacggacctgggtctgaaggaagcgaaggagctggtggagaaagcgccggtcgtggttcgcacggggttgcccaaggaggaggccgaagcgctcgcggccaagctcaaggccgccggcgccgccgtagcactcgagtgatcccacgaaggtgtcgcctctttttttccctattctttcgacgatgcaaatgcaacgtacgcgtgttccttaattgaattggaatttgatgggattgcagcggccgagcaggggtattgcgctcttgtagcttttaactagcctcaagcttaatcactgatatgagtgaatgagtgatacattgatacatttttccagaatcacacaataaggtgttccttcactatgctatatattactagcctggattggtttgagc

SEQ ID NO: 34261 - protein, 161 aa, Panicum virgatum
  misc_feature: Ceres CLONE 1955702
  misc_feature (94)..(161): Pfam Name: Ribosomal_L12 Pfam Description: Ribosomal protein L7/L12 C-terminal domain
MPLFFFKFAPLVPRLRRLSTAAATAAGEDPKLSRIADELLALSPAELDDYAALLRLKLRLSLTSSAAAGGASPAGAGDAAAGAEEAAAAVKTAFDVKIEKYEAAAKIKIIKEVRAVTDLGLKEAKELVEKAPVVVRTGLPKEEAEALAAKLKAAGAAVALE

SEQ ID NO: 34262 - DNA, 750 bp, Panicum virgatum
  misc_feature: Ceres CLONE 1955703
  misc_feature: Encodes the peptide sequence at SEQ ID NO. 34263
tccgcgcaagccatggatccagccgctccccgccgcgggcgcctacagatccacctcctggtggtggccctcaccgtactcgtggccctcgtcgcgcggtccggcgccgaggtcatcaccctcaccgaggagaccttctccgacaagatcaaggagaaggacacagtatggtttgtgcaattttgcgtcccctggtgtaaacactgcaagaaccttgggacactttgggaggacctgggaaaggttatagaaggtgaggatgaaattgagatagggcaagtcgactgtggtgtcagcaaaccagtatgctccaaggtgaatatccattcctacccaacattcaaggtgttttatgaaggcgaagaagtagcaaaatataaaggaccaagggatgtggaatcactgaagaactttgtgttgaatgaagctgagaaagcgggtgaggcaaagcttcaagctgattgaagctagaacatgggcgtagacaaggatcttgcttagatcttttttatcttgccaccgtgtcctgtatcctggcatttgatagaatacaaggacagttcctagaaaagaaaataccttgtatcgtttgagttttcacctgctagtccgaatcagctaatggaagttcacatgtactccagtccatactaagtgttcgacattgataaacttcaccactgcttaaaatgcaacgacacaaaagcctatttatatcacttgcgcattcgccggcagttacaatggtcg

SEQ ID NO: 34263 - protein, 150 aa, Panicum virgatum
  misc_feature: Ceres CLONE 1955703
  misc_feature (33)..(138): Pfam Name: Thioredoxin Pfam Description: Thioredoxin
  misc_feature: SWISSPROT Homolog: EC 5.3.4.1 Protein disulfide-isomerase
MDPAAPRRGRLQIHLLVVALTVLVALVARSGAEVITLTEETFSDKIKEKDTVWFVQFCVPWCKHCKNLGTLWEDLGKVIEGEDEIEIGQVDCGVSKPVCSKVNIHSYPTFKVFYEGEEVAKYKGPRDVESLKNFVLNEAEKAGEAKLQAD

SEQ ID NO: 34264 - DNA, 899 bp, Panicum virgatum
  misc_feature: Ceres CLONE 1955707
  misc_feature: Encodes the peptide sequence at SEQ ID NO. 34265
accactacacccagccgaccaaatcgccggagaagggcgcgccatggagccggcggtagagaagaaggaggccgaacaggaggagcagcagctgccgcaagcgcgcaaggaagacgcgcccgccgccgaggaggacgaggcagattcggaggagaccgagcgccgcaaccgcgacctcaaggccggcctccacccccttaggcgcaagctggttctctggtacacgcgccggacgcctggggcgaggtcgcagtcgtacgaggacaacatcaagaagatcatcgatttcagcactgtcgaatcgttctgggtttgctactgtcacctcgcgcgcccgtcttctctgccgagccccactgatcttcatctcttcaaggatggcatccggccactttgggaggaccctgcgaatcagaatggtggcaagtggataattaggttcaagaaggctgtttcaggccgtttctgggaggatttggtgctggtgctagtaggcgaccaacttgaatatagtgatgatgtttgtggtgttgtgctcagtgtccgttttaatgaagacattttaagtgtttggaatcggaacgcatctgaccaccaggctgtgatgactttaagggattcaatcaagagacaccttaagctgccacacagctatttgatggagtacaaaccacatgatgcttcgcgacgcgacaactcatcctacaggaacacatggctgagaggataagctccatgattctcgcctgctttggaactatttcactgtgatctccggtgcttgacttttcaacatcagttctgaagaaagtagactctatgtaccaagcatgcggcttattatgccatgtactagtcaaacgcaatacactataatgctcaaccatcctttatttacc

SEQ ID NO: 34265 - protein, 228 aa, Panicum virgatum
  misc_feature: Ceres CLONE 1955707
  misc_feature (22)..(228): Pfam Name: IF4E Pfam Description: Eukaryotic initiation factor 4E
MEPAVEKKEAEQEEQQLPQARKEDAPAAEEDEADSEETERRNRDLKAGLHPLRRKLVLWYTRRTPGARSQSYEDNIKKIIDFSTVESFWVCYCHLARPSSLPSPTDLHLFKDGIRPLWEDPANQNGGKWIIRFKKAVSGRFWEDLVLVLVGDQLEYSDDVCGVVLSVRFNEDILSVWNRNASDHQAVMTLRDSIKRHLKLPHSYLMEYKPHDASRRDNSSYRNTWLRG

SEQ ID NO: 34266 - DNA, 783 bp, Panicum virgatum
  misc_feature: Ceres CLONE 1955708
  misc_feature: Encodes the peptide sequence at SEQ ID NO. 34267
ctccacttcgcatcacgcaacgcccacaggcactcgtcacgcacacatccaaacccacttcccgatccgacccggaggttcggagcggagatgaagtcgagggcgaggtccagcggagccgactccaggctctccgtgaggaagtccaaggccgagaaggacccgaacaagcccaaaaggcctccgagcgccttcttcgtcttcatggaggagttcaggaaggactacaaggagaagcaccccaatgtcaagcaagtctccgtgattggcaaggctggtggtgacaagtggaagtccctgtccgatgctgagaaagctcccttcgtgtccaaggccgagaagctcaaagctgagtacaccaagaagatggacgcctacaataacaagacggctggaggccctacagcttctggtgactctgacaagtccaagtccgaggtgaacgacgaggatgaggagggtgacgagtgatgcatccatgtctctccagccaagtcgtcgcagtcagtagtagggaagtcttcgtcggcctaaccgggcattgctgctccttatcctctggatgctgtcggtctctctagatgtagcagtagtagctgtccactctcgagttggtagttgcaagtgtcgtccctgaagtgaagcagtttagtggtagtgtgttcgcttcttcggcacttaaccgttgttggaatttatgtcaccctgcagtctgtacttaccccaagcatcagttcctgtttaaatctcagatctgaatagatgagttattttgctgaactg

SEQ ID NO: 34267 - protein, 126 aa, Panicum virgatum; identical to SEQ ID NO: 18826
  misc_feature: Ceres CLONE 1955708
  misc_feature (28)..(97): Pfam Name: HMG_box Pfam Description: HMG (high mobility group) box
  misc_feature: Functional homolog of the protein sequence given in SEQ ID NO 50397
  misc_feature: Useful for making plants with altered lignin content
  misc_feature: Useful for making plants with altered terpenoid content
  misc_feature: Functional homolog of the protein sequence given in SEQ ID NO 50396
  misc_feature: Useful for making plants with altered alkaloid content

SEQ ID NO: 34268 - DNA, 857 bp, Panicum virgatum
  misc_feature: Ceres CLONE 1955715
  misc_feature: Encodes the peptide sequence at SEQ ID NO. 34269
tccatcccccccccctccccccaatctccagcctcaaaccccccggcagcgccaccgccgcgcctcaccgcttccggcgatctcgtgggcccctcggaaggaaggaagggacgagagaagatgagttccggcgccggcaggggcaagcccaagggcaccaaggcggtgtcgcggtcgtccaaggccggcctgcagttccccgtcggccgcgtcgcgcgctacctcaagacgggcaagtacgccgagcgcgtcggcggcggcgcgcccgtctacctctccgccgtcctcgagtacctcgccgcggaggtgctggagctggccggcaacgcggcgcgcgacaacaagaagaaccggatcgtgccgcgccacatccagctcgccgcgcgcaacgacgaggagctcagcaagctgctcggcgccgtcaccatcgccgccggaggggtgctgcccaacatccaccagacgctgctgcccaagaaggccggcggcaagggcaaggccgacatcggctccgcctcccaggagttctagccgccgccggcgcggatggcctccctccctccgcctgggcccggctttagtcggagccgccgatgcggcggcttcttcttggttcactagtagtagttctagtgtctcgcctaggctaggataggttttgcaatggatggcttatcgtgggaagtttgctgtatcaatcaatcaatcaatcttgctggaatggatgaaatggtcggtcgctgctgcttgcaatggttctgtgatctttcttttgtgtaaatttcacctctgaatcgcggcagacgaattcacctgcttgcttatgagatgaattttcatctgaatgtttccttgtc

SEQ ID NO: 34269 - protein, 136 aa, Panicum virgatum
  misc_feature: Ceres CLONE 1955715
  misc_feature (18)..(91): Pfam Name: Histone Pfam Description: Core histone H2A/H2B/H3/H4
MSSGAGRGKPKGTKAVSRSSKAGLQFPVGRVARYLKTGKYAERVGGGAPVYLSAVLEYLAAEVLELAGNAARDNKKNRIVPRHIQLAARNDEELSKLLGAVTIAAGGVLPNIHQTLLPKKAGGKGKADIGSASQEF

SEQ ID NO: 34270 - DNA, 870 bp, Panicum virgatum
  misc_feature: Ceres CLONE 1955726
  misc_feature: Encodes the peptide sequence at SEQ ID NO. 34271
gatcgagcttgcacaggaggagagcaggtgcagctagcaatggccgtgggcatgaggggtttgctggtgctgacgcttgggctcgcgatggctgcgacctcgtcggcggccatctacaaggtcggcgacgcagccggttggaccatcctcggcaacatcaactacaccgactggactacgaagaagaccttccatgttggagacatcgtagagttcacgtacccccagggcatccacaacgtgctggaggtgaccaaggccgactacgacagctgctccaactccacgcccatcgccacgcacacctccggcgacgacaagatcgccatcaagaggcccggccaccgcttcttcatctgcggcgtgcccggccactgcgccgccggccagaaggtcaacatccgcgtcctcaagccgcggtcctctgatgccccttccaaggctcccgcgcccgcgccggcgcgctcggcggcggcgacccccagtggcagcagcgagccgagcgccgcctcgccgccggccgcctcgtccactgacagcacctccgacgcgccgacgaccaccgcgcccgcgcccaacgccaacggcgccagggtccgtggaggttaccgagctgtcgtagcgatggcgttggcggcggtcgcctccatggcaatgctgcagtagatcacggctccctagtggccttgtgcagtcgagagtctacatgtgattttttttttaagtaagcgtctaccttggattgtttcgccacgatgtgtgcttcagtgtgaaacttttttgttttggggtcatggttcacttgcacatgcgactgatttcccaggatcatgtacttctctgtcgatattaatttgtctattctgttcg

SEQ ID NO: 34271 - protein, 208 aa, Panicum virgatum
  misc_feature: Ceres CLONE 1955726
  misc_feature (34)..(117): Pfam Name: Cu_bind_like Pfam Description: Plastocyanin-like domain
MAVGMRGLLVLTLGLAMAATSSAAIYKVGDAAGWTILGNINYTDWTTKKTFHVGDIVEFTYPQGIHNVLEVTKADYDSCSNSTPIATHTSGDDKIAIKRPGHRFFICGVPGHCAAGQKVNIRVLKPRSSDAPSKAPAPAPARSAAATPSGSSEPSAASPPAASSTDSTSDAPTTTAPAPNANGARVRGGYRAVVAMALAAVASMAMLQ

SEQ ID NO: 34272 - DNA, 846 bp, Panicum virgatum
  misc_feature: Ceres CLONE 1955729
  misc_feature: Encodes the peptide sequence at SEQ ID NO. 34273
tgtaggaaggactggtagtggcaagtcaactttggtccaagcattattcaggctcgttgagccagccgagggaaaaataatcgttgatggaatagacatatgcacactgggtctccatgatctgagatctcgcttcggcataattccccaggaacctgttctgtttgaaggaacaattcgaagcaacattgatccgattgggcagtattcagatgcagaaatatggcaggctctggagcgctgccagctgaaagatgtagtagtttcaaagcctgaaaaacttgatgctccagtggctgatagcggagagaactggagcgtaggccaaagacagctcctttgtcttggtcgtgtcattttgaagcagactcaaatcttatttatggatgaggctactgcttcagtcgactctcaaaccgatgcgacaattcagaagatcacgcgacaagagttttcgtcatgcacaataattagcattgcacacagaataccaacagtcatggactgtgatagagttttggttctggatgcaggtctggtaaaagaatttgatgcaccatcaacgttgatcgaacatccatccctttttggtgcgatggttgaggagtatgctaaccgctcgtcgaacttataactccatccatgatactccggattttaagaaataagagtatagttttgaaagattgacttgagagtacatacgtagaatcttgtgcagagaataaaccttagaagtttgacagtatttggagtgagccatggcgaacccaagatctccttatcatttgtgcctttttgttacaagctcacagagggggcagaaataatatgaaagttatcttt

SEQ ID NO: 34273 - protein, 210 aa, Panicum virgatum
  misc_feature: Ceres CLONE 1955729
  misc_feature (1)..(178): Pfam Name: ABC_tran Pfam Description: ABC transporter
  misc_feature: SWISSPROT Homolog: EC 3.6.3.44 Xenobiotic-transporting ATPase
VGRTGSGKSTLVQALFRLVEPAEGKIIVDGIDICTLGLHDLRSRFGIIPQEPVLFEGTIRSNIDPIGQYSDAEIWQALERCQLKDVVVSKPEKLDAPVADSGENWSVGQRQLLCLGRVILKQTQILFMDEATASVDSQTDATIQKITRQEFSSCTIISIAHRIPTVMDCDRVLVLDAGLVKEFDAPSTLIEHPSLFGAMVEEYANRSSNL

SEQ ID NO: 34274 - DNA, 690 bp, Panicum virgatum
  misc_feature: Ceres CLONE 1955731
  misc_feature: Encodes the peptide sequence at SEQ ID NO. 34275
ctcgccggttcatctctgtttcttcccccactttcccttttctctgtccctctcctcccttggtcttcctttcctggcctcctggcggcgacgactgggcgagcggcggcgccatttgtcaagtcttcgcccacccctttgccggcgtcgagcatccaccagagatggacacatcaagccccgcagcattcgtcaatggagagaatctgaaaatgtttgtggggcgaagagtgcgcacggtggtccaagtccaacgcatcgaaggtggaatggttgtcgggcagtccactgacgggcgcccgttgactatcaaaagtgccatggacattcctgtatcgcacttcatggaggtttatggaattgctgaaaatgaccagaccatccgcgctgaagtctgcacagattttggtcccaactttgatgccaaggcatttgaagggttgtgcaagctcgcaagtgacaagttcaagcacctgttcctgtagaggtcatcattgttcggaggacctttagccgactaaagctttttcggtgctgatgacgtctctagatttaagattttgctaaatgttccggcattcagcccagtactgttacttaaaagtcagtattggacagctattagtacgtattaacccaagcagtgttaggaagacatgcgaaatctatctagttgaagaacttatggtc

SEQ ID NO: 34275 - protein, 106 aa, Panicum virgatum
  misc_feature: Ceres CLONE 1955731
  misc_feature (1)..(105): Pfam Name: Rep_fac-A_3 Pfam Description: Replication factor A protein 3
MDTSSPAAFVNGENLKMFVGRRVRTVVQVQRIEGGMVVGQSTDGRPLTIKSAMDIPVSHFMEVYGIAENDQTIRAEVCTDFGPNFDAKAFEGLCKLASDKFKHLFL

SEQ ID NO: 34276 - DNA, 1047 bp, Panicum virgatum
  misc_feature: Ceres CLONE 1955732
  misc_feature: Encodes the peptide sequence at SEQ ID NO. 34277
cacagccacaccacgcacagagagacgcagcagcagcagcagggcactacgactcgtactagctagctagctagctactcgtagcagctgctagctgcaggtaaccatggcgaagaagaaagccgccgtggtcgccacgctcctggccctgaacctcctcttcttcgccttcgccaacgcctgcggctgcaagtgcggcgcctgccctagtccaggcggcggcggaaggggaggaggaggcagtgggggtggtggatctggcagcggcggtggtggcagcggcagcggaggcgggggaggcagcggtggaggcggcagcggcagcggcggcggagggagcagcggcggaggaggaggcacaggcggcggcggcggaaggggaggaggaggaggaggcagtgggggtggtggatctggcggcgggggaggcagcggtggtggtggcagcggcagcggaggcgggggaggtagcggtggaggcggcagcggcagcggaggcgggggaggtagcggtggaggcggcagcggcggcggcggcggagggagcagcggcggaggaggaggcacaggcggcggtggaggaggaagtagtcggtgtcccatcgacgccctcaagctgggcgtgtgcgccaacgtgctgagcgggctgatcaacgtgaccctggggacgccgccgcggacaccgtgctgcacgctgatccaggggctggcggacctggaggcggtggtgtgcctgtgcacggcgctgcgagccaacgtgctgggcatcaccctcaacctgcccatcaacctcagcctcctcgtcaactactgcgggaggcgcgtccccccgggcttccagtgcgcctgatgcatgcctgcccggccgcctgcagctgcagatccatcgacgttcaagcctagctagctcatgatactcctaatatatacatacatgcatgcatatatgtgcatgtgtgttcaataattcaccaagctatctcatctctcatatatctatagtagctaatgtaatttgtgcgttaatgaaagtgtactttattatcc

SEQ ID NO: 34277 - protein, 247 aa, Panicum virgatum
  misc_feature: Ceres CLONE 1955732
  misc_feature (164)..(246): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Functional homolog of the protein sequence given in SEQ ID NO 50178
  misc_feature: Useful for making plants with modulated nitrogen use efficiency
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Functional homolog of the protein sequence given in SEQ ID NO 50545
  misc_feature: Useful for making plants with modulated oxidative stress sensitivity
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Functional homolog of the protein sequence given in SEQ ID NO 50142
  misc_feature: Useful for making plants with altered lignin content
  misc_feature: Functional homolog of the protein sequence given in SEQ ID NO 50143
  misc_feature: Useful for making plants with altered alkaloid content
  misc_feature: Functional homolog of the protein sequence given in SEQ ID NO 50144
  misc_feature: Useful for making plants with altered terpenoid content
  misc_feature: Functional homolog of the protein sequence given in SEQ ID NO 50179
  misc_feature: Useful for making plants with modulated phosphate use efficiency
MAKKKAAVVATLLALNLLFFAFANACGCKCGACPSPGGGGRGGGGSGGGGSGSGGGGSGSGGGGGSGGGGSGSGGGGSSGGGGGTGGGGGRGGGGGGSGGGGSGGGGGSGGGGSGSGGGGGSGGGGSGSGGGGGSGGGGSGGGGGGSSGGGGGTGGGGGGSSRCPIDALKLGVCANVLSGLINVTLGTPPRTPCCTLIQGLADLEAVVCLCTALRANVLGITLNLPINLSLLVNYCGRRVPPGFQCA

SEQ ID NO: 34278 - DNA, 913 bp, Panicum virgatum
  misc_feature: Ceres CLONE 1955742
  misc_feature: Encodes the peptide sequence at SEQ ID NO. 34279
aagaagctaggccagttcaggaagaacacaatcaggtagcagcaaccgatcagtggccatggcggctacgagtgctgccaagagcctgctgctctgcttgacagcattcgcctttcttcaccacctccagtttcagtaccctgctgtagctgcaacatcgctcagcaaaaatgggagcagggacggcggccacgggaggaccttcagcctcacgctgtaccagcaggagaccatcaacaagaccgcgtacatcatcgtcgacggcgtggccggcgcgggcgtcagcgagaccaccacgccgttcggcaccatctacgtcttccgcgacgacctcacggtgcgcgccgacagggcctccccggtggccggcgtcgctgaggggagctccatcaccaccaccctcgacgggctgcaggccctgtcgctggccaagatcaccgtcgaccaccgcggccaccggggttccgtgtccgtcctcgggggcacctacatcaccaagccgtccgactaccccgtggtgggtggcaccggcgacttcgcctacgcgctgggctacgtccggtcgacgccggtggacctgcggggacgaacggtgacgtacaagatggagcttcacttgtattggccgccgtacgcccactacgctcctgttccacacaaggccgtataggtatcagtctatggagtgtatggactagtatacgtgatatacgcatcatctacaccgttctcaataatctctggtcctggtgtatttttctaagtatatttgtaggagtatacagttttatattaagggtcgttttggcatgttcatgtttttggttgcccaccaaacggatcctagcattacacggtggtgtattttcttttcaatttttttggataaaataaaggagcggaatgccagtgt

SEQ ID NO: 34279 - protein, 203 aa, Panicum virgatum
  misc_feature: Ceres CLONE 1955742
  misc_feature (19)..(187): Pfam Name: Dirigent Pfam Description: Dirigent-like protein
MAATSAAKSLLLCLTAFAFLHHLQFQYPAVAATSLSKNGSRDGGHGRTFSLTLYQQETINKTAYIIVDGVAGAGVSETTTPFGTIYVFRDDLTVRADRASPVAGVAEGSSITTTLDGLQALSLAKITVDHRGHRGSVSVLGGTYITKPSDYPVVGGTGDFAYALGYVRSTPVDLRGRTVTYKMELHLYWPPYAHYAPVPHKAV

SEQ ID NO: 34280 - DNA, 744 bp, Panicum virgatum
  misc_feature: Ceres CLONE 1955744
  misc_feature: Encodes the peptide sequence at SEQ ID NO. 34281
atcttctcagtagtacactcgctagctagctaagctgctatataaattaaattaaagctagtagtactgatcgatcggcatcgccggccggagatcgacgtgacgacgatgatgaagaagcagcagcgagctgtggtggtgctgctgctgctgctggtggccgccggcggcgcgtctgcggcgtcgtgcaacgccgggcagctgacggtgtgcgcttcggcgctgacgtcgggcggcaagccctcggcggcgtgctgctccaacctcraggcgcagcaggggtgcttctgccagttsgccaagaaccccgcattcgcgcgctacatcaacagccccaccgcgcgcaaggtcgtcgcatcctgcggcgtcgcactcccacgctgctagatagctacctcgctcattagttagctagctagctagctagctagcttatckgtatctatacatacatacatacatatgatcgctcgatcgatyttagatcgtctacgtgtggctcgctgctgttcatccatccgctcgctacgtgtgtatatatacacmcacacaacgacsgataaataaaagatgcatgggttgcctccggaccgctccctatatagctactttgttgtgtactactagtatcaatcaatcctactttctgatgtcttcactacatgtgaaaagctgataattttatagctgtagctactccatgtaataattttgttgcattatcgaaagtgtatgtctgaagcc

SEQ ID NO: 34281 - protein, 92 aa, Panicum virgatum
  misc_feature: Ceres CLONE 1955744
  misc_feature (27)..(92): Pfam Name: Tryp_alpha_amyl Pfam Description: Protease inhibitor/seed storage/LTP family
  misc_feature: Functional homolog of the protein sequence given in SEQ ID NO 50399
  misc_feature: Useful for making plants with modulated biomass
  misc_feature (54)..(54): Xaa is any aa, unknown, or other
  misc_feature (63)..(63): Xaa is any aa, unknown, or other
MMKKQQRAVVVLLLLLVAAGGASAASCNAGQLTVCASALTSGGKPSAACCSNLXAQQGCFCQXAKNPAFARYINSPTARKVVASCGVALPRC

SEQ ID NO: 34282 - DNA, 869 bp, Panicum virgatum
  misc_feature: Ceres CLONE 1955755
  misc_feature: Encodes the peptide sequence at SEQ ID NO. 34283
gccttgctcttccttacctggcggcgacgactcggcgagcggcggcgccatctgtcctgtcttcgcccagccctttgccggcgacgagcgcgtcctccagatctgagacatgcctaagataaagacaagccgtgtgaaatatccagaaggatgggagcttattgaaccaacacttcgtgatttggaggccaaaatgagggaagctgaaaatgatccacatgatgggaagaggaagtgtgaagctttatggcccatcttccgtatttctcatcagaagagccgctacatatatgatctttactatcgaaggaaggaaatatcgaaagagctatatgagttttgcttggaccaaggctacgcagatcgcaatctgattgcgaagtggaaaaagccaggttatgagcgcctctgctgcctccgctgcatacaaacacgagaccacaactttgcaaccacctgtgtctgcagggtccccaagcatctcagggaggagaaagtgatagaatgcgtccactgcggatgcagggggtgtgccagcggtgattaaagcctcgatctcatggttggaaaataatcgctctagatgtctcgatatacttgagctcctatggaaagttgaaaacaaacaccgtatgagtatgaccaggcgattataacttgcgcaatggtacgggtgtggagatgtgccactgccagtggtggttaaaagcttgctcatctcgtgttgaaaaatggcgtcaaactatcgctgtatttgatccccgctggggacaagcactgtataatctgttgatttcaacttgtgcaatgtattgtaaaaaaaatcaagtgactattttcatggaccgcttacaaatatttgtgactgt

SEQ ID NO: 34283 - protein, 145 aa, Panicum virgatum
  misc_feature: Ceres CLONE 1955755
  misc_feature (1)..(143): Pfam Name: G10 Pfam Description: G10 protein
MPKIKTSRVKYPEGWELIEPTLRDLEAKMREAENDPHDGKRKCEALWPIFRISHQKSRYIYDLYYRRKEISKELYEFCLDQGYADRNLIAKWKKPGYERLCCLRCIQTRDHNFATTCVCRVPKHLREEKVIECVHCGCRGCASGD

SEQ ID NO: 34284 - DNA, 943 bp, Panicum virgatum
  misc_feature: Ceres CLONE 1955758
  misc_feature: Encodes the peptide sequence at SEQ ID NO. 34285
aaaaaaaaggtcagaagcctcgtccgttcatctcctccctctgtttctccaccccttccccttctctcggactctctcgatccttgctcctctttccccttgcggcgacgactgggcgagcggcggcgccatttgttacgtcttcgtccagcccctttgccggcggcgagcatcctccaggtaattttcttgtctgtagcatagacaagatggttaatgcgatcaaggggttgttcatctcctggtaagctcctgatacaactgaaaattgaatccatcattttagttattgttaaccaaatatccctttaaatttgttcataacaagccacattcctaccaatcctttccccccgccacagtgatatacctatggcacagtttattgttaatctgaatgcttcaatgccggcatcagagaggttcatcgtgcacatgctcgatcctacacacatgtttgttcagccccatgtggcagaaatgatcagaagcaagataggggagttcagggaccagaatagctacgagaagccgcagtgaaggatcatcccacctcgcagtttgcattgtttccctccctcccaaagatgcataccttgcactcaaatctgcacaactgctatagaatggttggttggatggcattgccatgcctcaccctgtcacccgtgatgatctagaataatgtatgtattcgtgtttctagtctcagaagcagctgtattgcagtgacttatttgtatccggattgatccttttatctggccctttgccacttggcaacgcacttggtggcgccgataaattgaaagtgcgttgcctgcttaggaaagggtaagatgtcttgcatgtattgctgttgtggactcgactctgatgtttgtgagctttttatgagtctgatggttccgtgaaataaaaaaagtagcactattgtcgtcgt

SEQ ID NO: 34285 - protein, 55 aa, Panicum virgatum
  misc_feature: Ceres CLONE 1955758
  misc_feature (1)..(55): Pfam Name: Tbf5 Pfam Description: Transcription factor TFIIH complex subunit Tfb5
MAQFIVNLNASMPASERFIVHMLDPTHMFVQPHVAEMIRSKIGEFRDQNSYEKPQ

SEQ ID NO: 34286 - DNA, 685 bp, Panicum virgatum
  misc_feature: Ceres CLONE 1955759
  misc_feature: Encodes the peptide sequence at SEQ ID NO. 34287
atcgcactcagcaagcagcaatcttcccgagcaaatcccctcgtcgaatccaccagcgaagcaaatctctacccttcctcccccgatggcccgcacgaagcagacggcgaggaagtccaccggcggcaaggcgccgaggaagcagctggcgacgaaggcggcgcgcaagtcggccccggccaccggcggagtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagactgacctccgcttccagagctccgccgtcgccgcgctgcaggaggcggccgaggcctacctcgtcgggctcttcgaggacaccaacctctgcgccatccacgccaagcgcgtcaccatcatgcccaaggacatccagcttgcccgccgcatccgtggcgagagggcctaggtgtcgtcgccgtggaggggaagtagtagaaatagtagcttgccttctgtgtccaatcagaaggtgttgagatgtgctgggttccttagctttggttgttggttcgtctactgctgtaatttatcccatcgtatcttctgttccttggtgttgcaatggatcaatgaaatgcaatggcaccttgttacc

SEQ ID NO: 34287 - protein, 136 aa, Panicum virgatum; identical to SEQ ID NO: 10238
  misc_feature: Ceres CLONE 1955759
  misc_feature (58)..(132): Pfam Name: Histone Pfam Description: Core histone H2A/H2B/H3/H4

SEQ ID NO: 34288 - DNA, 488 bp, Panicum virgatum
  misc_feature: Ceres CLONE 1955766
  misc_feature: Encodes the peptide sequence at SEQ ID NO. 34289
attacccctcaaacatacacgaagaagcagcattcgaagtgcttacatcttgtgagattaaaatctgcaggtatatatctctgaagaagatgagcagctcggcagttggtgagggcaaggggtgtgatgctactcccaagacagagtggcctgagctagtgggaagcacgatcaaggaggcgacggagaagatcaatgcggagcggccggacctcaatgtggagccggtccctgttggcaccatagtcccccaagatttcgacccgaagcgcgtccgtctctgggttgacaccgtcgccgaggtccccaggattggctgaaccagcttaacgcaaagccaccgaataatgaatgctacatgcatgtgttccacagaccattctacataggtcaattaaataaataaaaaatatggctgtgatggagcgttctggtatgctattaaaattgtcatgtttcggatatacacaattattattttcaatatc

SEQ ID NO: 34289 - protein, 76 aa, Panicum virgatum
  misc_feature: Ceres CLONE 1955766
  misc_feature (17)..(76): Pfam Name: potato_inhibit Pfam Description: Potato inhibitor I family
MSSSAVGEGKGCDATPKTEWPELVGSTIKEATEKINAERPDLNVEPVPVGTIVPQDFDPKRVRLWVDTVAEVPRIG

SEQ ID NO: 34290 - DNA, 958 bp, Panicum virgatum
  misc_feature: Ceres CLONE 1955767
  misc_feature: Encodes the peptide sequence at SEQ ID NO. 34291
cactgtttgagggagtcgttcagcggaatgatgaaattgaagacgatggaaaaagagttgagaacttgatccggggaatcttagctggaaatatttttgatctaggatctgcacagcttgcagaagtttttgctaaagatggcatgtcattcttggcaagttgccaaaatcttgtatctcgaccttgggttattgatgaccttgatgcttttaagagcaaatggaccaagaaatcatgggaaaaggcagttatctttgtcgataactctggtgctgatgttatcttgggaatattaccatttgcgagggagttgctccgacgtggcacaaaggtgatacttgctgctaacgacatgccttcgatcaatgacgtcacctatccagagctgattgagattataaacaagctcaaggatgcagatggaaagcttgcaggtgtggatgcatccaacctgcttgttgccaactctggtaacgatctgcctgttattgatttgtctagtgtgtcacctgaacttgcctttatggcagatgatgctgatctggttgtcctagaaggcatgggaagagcaatcgaaactaacctatatgcacaaatgaaatgtgactcgatcaagattggaatggttaagcatcctgaagtcgcccaatttttaggaggaagactttatgattgtgtcttcaagttcaacgaagcctgaatgctaagctacctcagataactcctgttcacgtcgcagttgcagtcgtattgctgcaattttgctcgagatccgaaatgctcgtttgcttcagtagagatagcaagtgaaataagttgtctgtggcttcgtggaagtgtcagcactcagcaagggtggttacggaattgttggcttgtaagaattgttgcccaaaatgaaacttctggacgtatttgttcccgttggtctacaatgattgtttggaattagttggc

SEQ ID NO: 34291 - protein, 232 aa, Panicum virgatum
  misc_feature: Ceres CLONE 1955767
  misc_feature: SWISSPROT Homolog: EC 2.7.1.33 Pantothenate kinase
LFEGVVQRNDEIEDDGKRVENLIRGILAGNIFDLGSAQLAEVFAKDGMSFLASCQNLVSRPWVIDDLDAFKSKWTKKSWEKAVIFVDNSGADVILGILPFARELLRRGTKVILAANDMPSINDVTYPELIEIINKLKDADGKLAGVDASNLLVANSGNDLPVIDLSSVSPELAFMADDADLVVLEGMGRAIETNLYAQMKCDSIKIGMVKHPEVAQFLGGRLYDCVFKFNEA

SEQ ID NO: 34292 - DNA, 901 bp, Panicum virgatum
  misc_feature: Ceres CLONE 1955782
  misc_feature: Encodes the peptide sequence at SEQ ID NO. 34293
ctgctcttggaaatcctctggagcgttccgtttcaccgtttcaggttttccatggcggcggcggcgcagctgcacggatcggccgcgaccgcggcggcctaccgccggactcgagcctactcagttccatcctcatgccgggcgctctggagccctctcgtgggttacccgaagctttcgatttctaccaagggagttgggttgaagccatttggttttgctgctaaaatttcaacaaatgagaacactcaagttgaagaattaaacttgcaatcagatcagatgaaggaatttgtacaggcagagggacactcccagaagaggagtgctaaaatccatgacttttgtcttgggatcccttttggtggtcttttattttccatgggccttctaggatacatgttctccagaagtaccataagtattgtcttgggcgttgcaccagggcttgccactctgctacttggtacactcagtctaaagttttggaggagcggtaaatccagtttcctgtttatcctggcccaagcagcaatttctgctttcctggcttggaagtattctcacgcttacttcttgacaaacagactccttccttggggcttctatgcttccctaagcactgcaatggcttgtttctacgggtatgtgctgcttgccggaggaaatcccccaccaaagaagttggcggccatcccaccgcagtaaaagagagattcagttcggtctaggatcagcatggtttggccaagttcatcatgctgtggcagcagtatagcacaattttgataatcgaatttgtatattccccaacctgcggttcactgctggctgggcttatgtttttgtctgatacctaaacttagctaataaagattcacaggatgattgccctgcctcc

SEQ ID NO: 34293 - protein, 218 aa, Panicum virgatum
  misc_feature: Ceres CLONE 1955782
  misc_feature (98)..(201): Pfam Name: TMEM14 Pfam Description: Transmembrane proteins 14C
MAAAAQLHGSAATAAAYRRTRAYSVPSSCRALWSPLVGYPKLSISTKGVGLKPFGFAAKISTNENTQVEELNLQSDQMKEFVQAEGHSQKRSAKIHDFCLGIPFGGLLFSMGLLGYMFSRSTISIVLGVAPGLATLLLGTLSLKFWRSGKSSFLFILAQAAISAFLAWKYSHAYFLTNRLLPWGFYASLSTAMACFYGYVLLAGGNPPPKKLAAIPPQ

SEQ ID NO: 34294 - DNA, 897 bp, Panicum virgatum
  misc_feature: Ceres CLONE 1955786
  misc_feature: Encodes the peptide sequence at SEQ ID NO. 34295
accagcacttgcttgtcattcccaagcaaacgcattcatccagcaccggccgcactcagctcgtcaagctaagttcacattcacgcacaatccaagcaatggctcgcgctcatcaggtggtggctatcgccgtcgttgccgccgtcgtgctgctcgccgccgcggcaacgaccaccgaggccgccgtgacctgcgggcaggtgagctcggccatcggcccctgcatcgcctacgcccgcggcactggctccggcccctccgcagcctgctgcagcggcgtgaggagcctcaactcggcggccaggagcaccgccgacaggcgcgccgcatgcaactgcctcaagtccgccgccggcagggtgagtggcctcaaacttggaaacgccgcaagcatcccgtccaagtgcggagtcaacatcccctacaccatcagcccaaacgtcgactgctccagggtgagctaaacgacgaccagtaccgtcgctacctatctacttaattatcgtctatgatcgagttcgatgatgatgaataaaaatctctccggcgtcacgtgcactgtcgtcatgcgctagctcatctcgcgtggtacgtcgtcgctcagcatgtgatgagcgatcgagagacggagtcctctccgatccttgtgtccttttgcatgcttcgtacgttttgtgtctgcatctgcatagtagtgtgtcctccatttccgtttggaggagacccactctgtaccttgtccactataccttttaatacatcatacaccacttttttgtacgctccatgactttatttcgatgcttctctgcttcattcctcgtctctcctgctgcaaatattttttttatttacagttttacacaatttctaagtgatgagtaaaatcattgtatt

SEQ ID NO: 34295 - protein, 121 aa, Panicum virgatum
  misc_feature: Ceres CLONE 1955786
  misc_feature (32)..(117): Pfam Name: Tryp_alpha_amyl Pfam Description: Protease inhibitor/seed storage/LTP family
MARAHQVVAIAVVAAVVLLAAAATTTEAAVTCGQVSSAIGPCIAYARGTGSGPSAACCSGVRSLNSAARSTADRRAACNCLKSAAGRVSGLKLGNAASIPSKCGVNIPYTISPNVDCSRVS

SEQ ID NO: 34296 - DNA, 822 bp, Panicum virgatum
  misc_feature: Ceres CLONE 1955798
  misc_feature: Encodes the peptide sequence at SEQ ID NO. 34297
atttttttccggcctcttcctcgcgcggcgcctacccacccaaccccccgggttcgaagcgtgcgaagggagcgaagcagcgcggagagatggcccgtaccaagcaaactgctcgcaagtccacaggagggaaggctcccaggaagcagcttgcaactaaggctgcccgtaagtcagccccaaccactggaggagtgaagaagccccatcgctaccgccctggcactgttgccctccgtgagatccgcaagtaccagaagagcactgagctgttgatcaggaagctgcccttccagaggcttgtcagggaaattgcacaggacttcaagactgatctgcgtttccagagccatgctgtgcttgccctccaggaggctgctgaggcgtaccttgttggtctgtttgaggacaccaacctgtgcgccatccatgctaagcgcgtgaccatcatgcctaaggacatccagctggccaggaggatccgtggcgagagggcttaatcatctcaatcatgacaatcaaagtctcgtgtcgaagtagtgggttaatgtggtgccatgttcaggacatctgagtagggcttgttttgtggatcatattaagttcctcttctgcagcactatatgttgctactacctttgttggtgttgttactagggtcgtcgaatacttaaattgtctcgtctagtgttggtaccgcgttgacagtttgacatttgtgtgctatgttgctgctgactagccgtgtttgtgcgctgctggattgtaagcttcattgctgtggctgatctgttcgttaaatggtatcgtgttacgttgtgc

SEQ ID NO: 34297 - protein, 136 aa, Panicum virgatum; identical to SEQ ID NO: 9871
  misc_feature: Ceres CLONE 1955798
  misc_feature (58)..(132): Pfam Name: Histone Pfam Description: Core histone H2A/H2B/H3/H4

SEQ ID NO: 34298 - DNA, 911 bp, Panicum virgatum
  misc_feature: Ceres CLONE 1955809
  misc_feature: Encodes the peptide sequence at SEQ ID NO. 34299
atcccaaccccggccgggccgcccgccgcgccgcctgccagcagatcgaagagaagacagccagagccagcagcagatcgaagcatgtcgggcgtgtgggtgttccggaacggcgtggtgcggctggtggagaacccgacgtcgggggcggcggcggcggcgtcggggaagcgcaaggcgctgctgcacacgccgtccggggaggtggtctcctcctacgcgtcgctcgagcgcaagctggcggcgctggggtgggagcgctactacgccggcggcggcggcgacgggatgctgcagtaccacaagcgcacctccgtggacctcatctcgctgcccaaggacttcgcccacttcggctccgtccacatgtacgacatcgtcgtcaagaaccgcgacgccttccgcgtcatcgacgcctagctagctagcttcttgctgctcgctcgctcgcttgcatcatcatcatcttcaattcctcatcgtcgtcaagctagccttctcttgcatctatctaagctagtgtgtacgtgtgatcgagatcatcagtttgtacgttcgttcgtacatatgtatgcaatctagctttcacgtatatgtacgtaccttttgtgtacgcggcttgtcgacgtatatttatttatacgcgcctgcatagggagtactctagtcagtattcatggatcgatttggttgccgtggtcgtggtgtgcgcgcgcgcgcgcacgcatccagtatggtatgtagtactgagttttcgtgtggttgttttctctttcactgccttctttttttaaaaaaacgttttttttctcactgccttgtgccttcttgcatctcatcgtgcgtgcaagtgtgcactgatccgttcctgcgatgtttctttgtcacctttcaatttttcaatttctcag

SEQ ID NO: 34299 - protein, 111 aa, Panicum virgatum
  misc_feature: Ceres CLONE 1955809
  misc_feature: Functional homolog of the protein sequence given in SEQ ID NO 50423
  misc_feature: Useful for making plants with modulated flowering time
MSGVWVFRNGVVRLVENPTSGAAAAASGKRKALLHTPSGEVVSSYASLERKLAALGWERYYAGGGGDGMLQYHKRTSVDLISLPKDFAHFGSVHMYDIVVKNRDAFRVIDA

SEQ ID NO: 34300 - DNA, 819 bp, Panicum virgatum
  misc_feature: Ceres CLONE 1955824
  misc_feature: Encodes the peptide sequence at SEQ ID NO. 34301
atagctcgtcatttattggcaaagatcgaaaaggttaatatgaaggaggagaaagaaataatagtaacgtggtcccgggcatctagcattctacccgcaatggttggccatacaatcgcgattcataatggaaaggaacatatacctatttacataacaaatcctatggtaggtcgcaaattgggggaattcgtgcctactcggcatttcacgagttatgaaagtgcaagaaaggatactaaatctcgtcgttaagtgaattcagaatagaaagattcagaataaacaaaatttataggattaaaataaagtaaaggtaggcgggtaataatcttatttatgacaagtttcaaattggtaaagtatacccctaggataaagaagaagaagaacgggctaaggaaactcgcaagaaaagttccaaccgatcgtctgcttaaatttgaacgggttttcaaagcacaaaaacgcatacatatgtctgttttcaaagcacaaagagttcttgatgagattcgctggcgttactatgaggaaaccgttatgatactgaacctcatgccttatcgagcgtcttatcccatcttaaagttggtttattcggcagcagcaaatgctactcattatagggatttcgacaaagcgagtttattcatcactaaagccgaagtcagtaggagtactattatgaaaaaattcagacctcgagctcgaggacgtagttctttcataaaaaaaaccatgtgtcatataacaattgtactaaatatagtaaagaaatctaaataatctttagatcaatccaagatttcgattccc

SEQ ID NO: 34301 - protein, 84 aa, Panicum virgatum
  misc_feature: Ceres CLONE 1955824
  misc_feature (1)..(73): Pfam Name: Ribosomal_S19 Pfam Description: Ribosomal protein S19
IARHLLAKIEKVNMKEEKEIIVTWSRASSILPAMVGHTIAIHNGKEHIPIYITNPMVGRKLGEFVPTRHFTSYESARKDTKSRR

SEQ ID NO: 34302 - DNA, 573 bp, Panicum virgatum
  misc_feature: Ceres CLONE 1955832-R
  misc_feature: Encodes the peptide sequence at SEQ ID NO. 34303
ccgcaaggtcaagaagcgccgcctctcgcacaagacggcgcgtcgtggcaagttcctcctcaaggccgacgatgccgtctacgaggagctcgtcaagctggccgaccaggggaaggatgcccaagccaaggacctccccgtagacgaggaccttcccggcatggggcagttctactgcctccactgcgaccgttactttgcaagcgagagcgtcaaggatgagcactaccgctcaaagcgccacaagaaaagggtgaaggtaatgtcaggaccagctccacacacgcaacttgacgctgaacttgctgctggaatgggaatgcctgacaatggcctgaagctcatgtccatgtgaagtaacaaggaacctcttgttagtacttgtaccgtgtttttcttgctgtcatacatctgaagtttctttgcttggtagctaatggagttagtagatggtgttatgtcaaagacttgttctaagagaggcttcatcagaatgagagggtttttgtgagggtcaggggttaatgcctgtatcatgaaatcagttacggatcaacgataatgtcttgtatc

SEQ ID NO: 34303 - protein, 117 aa, Panicum virgatum
  misc_feature: Ceres CLONE 1955832-R
  misc_feature: The sequence is a functional homolog of SEQ ID NO 1130 in the 11/479,226 US patent application
  misc_feature: The sequence is a functional homolog of SEQ ID NO 494 in the 10/412,699 US patent application
  misc_feature: Functional homolog of the protein sequence given in SEQ ID NO 51456
  misc_feature: Useful for making plants with altered lignin content
RKVKKRRLSHKTARRGKFLLKADDAVYEELVKLADQGKDAQAKDLPVDEDLPGMGQFYCLHCDRYFASESVKDEHYRSKRHKKRVKVMSGPAPHTQLDAELAAGMGMPDNGLKLMSM

SEQ ID NO: 34304 - DNA, 789 bp, Panicum virgatum
  misc_feature: Ceres CLONE 1955835
  misc_feature: Encodes the peptide sequence at SEQ ID NO. 34305
acaaagcaagcaagcgaccattctcttctccaccagcgccgcctcctcccccgatctttctccgcctccgccgtgatcccaaggaccaccaaaccctagcacgaagtcgcctcctctgtccaatcatggccaacagcaacctccctcgccgcatcatcaaggagacgcagcggctgctcagtgagccagctccaggaatcagtgcctcgccatctgaagagaacatgcgctacttcaatgtcatgatccttggcccgtcgcagtcaccctatgagggaggagttttcaagcttgaattattcttgcctgaagaatatccaatggctccaccaaaggttcgctttctcacaaaaatttatcaccctaacattgacaagcttggtaggatatgccttgatattttgaaggacaagtggagtcctgcccttcagatccgaacagttcttttgagcatccaggcgctgctcagtgccccaaatcctgacgacccgcttgctgataacgttgcaaagcactggaaagctaatgagactgaagctgtaggaacagccaaagagtggacccgtgtatatgcaagcggagcatgagctttggacgatgcaaaagtggagctcaactcgaacggccattggctggttacatttcgggtctactcatatgtggaaatttatcctctttattatggtgtgtacttgagtctgatgtacattagtctagctgggcatgtaaagtgtttctttcgtacgtctggtccttgagagaacatatatatcataataattatcctgg

SEQ ID NO: 34305 - protein, 153 aa, Panicum virgatum
  misc_feature: Ceres CLONE 1955835
  misc_feature (9)..(146): Pfam Name: UQ_con Pfam Description: Ubiquitin-conjugating enzyme
  misc_feature: SWISSPROT Homolog: EC 6.3.2.19 Ubiquitin--protein ligase
MANSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLADNVAKHWKANETEAVGTAKEWTRVYASGA

SEQ ID NO: 34306 - DNA, 638 bp, Panicum virgatum
  misc_feature: Ceres CLONE 1955839
  misc_feature: Encodes the peptide sequence at SEQ ID NO. 34307
gaaccgcacgcagacaccacagaccgcagggcaccccgtgtcggcagcggagcagaagcagcgagcgatccatggcggcccaggctctcctctccgggcggcagctgctcggccgccccgtgcagtcggccgtctcccggtcctcgtcggccaggaaggcgcccttcgtcgtcagggccagctccagcccgctcttcaacccgctcgggttcggcaagacggagaaggagatgaaggagctcaagctcaaggagatcaagaacggcaggctcgccatgctcgccatcctcggatacttcatccaggggctcgtcaccggcgtcggcccctaccagaacctgctcgaccacctcgccgaccccgtcaacaacaacgtgctcaccagcctcaagttccactagatgccgccgccgccgcctgttgtcgttgtagtggaagcgagaggtgatcgtcgatgtgctgttcatatgctggcgggctggctggctgatggaagaggtttgcatcgtgcatgatctatccatggccggcctgcttgctgcttgtaacaaattagtaaatccatcctgttaattgagaccagaaattgtattgcacatggtaaatcaatgtacaattccgatcgattgggtgatgtc

SEQ ID NO: 34307 - protein, 109 aa, Panicum virgatum
  misc_feature: Ceres CLONE 1955839
  misc_feature: Functional homolog of the protein sequence given in SEQ ID NO 50109
  misc_feature: Useful for making plants with modulated nitrogen use efficiency
  misc_feature: Functional homolog of the protein sequence given in SEQ ID NO 50113
  misc_feature: Useful for making plants with modulated oxidative stress sensitivity
MAAQALLSGRQLLGRPVQSAVSRSSSARKAPFVVRASSSPLFNPLGFGKTEKEMKELKLKEIKNGRLAMLAILGYFIQGLVTGVGPYQNLLDHLADPVNNNVLTSLKFH

SEQ ID NO: 34308 - DNA, 743 bp, Panicum virgatum
  misc_feature: Ceres CLONE 1955840
  misc_feature: Encodes the peptide sequence at SEQ ID NO. 34309
gataacagccacatgtttcccatggccccagatatcgctcgcgaagtcctcgtgcaagttcgcgctcaacggtctcaagaactggatgaagcccgagaaggtacctgcggccataactacgttcccgtcctctgcgcaaatcgtgcctgagcccctcggtgtggtgctcgtcatctccgcctggaactacccattcctgctctctattgatccggtaattggagcaatagccgctggaaatgctgttgttctgaagccatcagaaatagcgccggcaacctcgtccatgttcgcaaagctgctgcctgagtatgttgacagcacatgtattaaagttgtagaggggggtgttgaggaaacgactgcgctcttggaacaaaaatgggataagatcttctacacaggtagcgggactatagcacgcatagttttggcagccgccgcaaagcatctgaccccagtggctctggagcttggtggaaaatgccctgctattgtcgattcagacgttgatcttcatgttgctgttaagaggcttgctgttggcaaatggggatgtaacaatggccaagcatgcatcgctccagattacgttataacgacgaaatcatttgcaccagagctggtgaactctttgaaaagagttctggagaggttctacgggaaggatcctctggaatcggcggatctgtctcgtatcgttaattctaaacattttcagagattgacagaattggtagcag

SEQ ID NO: 34309 - protein, 247 aa, Panicum virgatum
  misc_feature: Ceres CLONE 1955840
  misc_feature (1)..(246): Pfam Name: Aldedh Pfam Description: Aldehyde dehydrogenase family
  misc_feature: SWISSPROT Homolog: EC 1.2.1.3 Aldehyde dehydrogenase (NAD(+))
ITATCFPWPQISLAKSSCKFALNGLKNWMKPEKVPAAITTFPSSAQIVPEPLGVVLVISAWNYPFLLSIDPVIGAIAAGNAVVLKPSEIAPATSSMFAKLLPEYVDSTCIKVVEGGVEETTALLEQKWDKIFYTGSGTIARIVLAAAAKHLTPVALELGGKCPAIVDSDVDLHVAVKRLAVGKWGCNNGQACIAPDYVITTKSFAPELVNSLKRVLERFYGKDPLESADLSRIVNSKHFQRLTELVA

SEQ ID NO: 34310 - DNA, 827 bp, Panicum virgatum
  misc_feature: Ceres CLONE 1955842
  misc_feature: Encodes the peptide sequence at SEQ ID NO. 34311
atcactgcccacacctaagccctcctgcatcattgtactactcatctgtctaggccggccattgttccagaagccatcatggctggcgccgcagttatcgccggcctggtgctcctcgccgccgccgccgcggctccggcgtccgccacggattacgtggtcggcgactcgtccgggtggaacagtggcgtggactacaccacctgggcgaaaggcaagaccttcagcgttggcgacaacctggtgttccagtacagcgcgatgcacacggtggcggaggtgagctcggcggactacagcgcgtgctcggccagcaactcgctgcagtcgtacagcgaccagaacaccaagatcgcgctcaccgcgcccggcacgcgctacttcatctgcggcaccgcgggccactgcagcggcggcatgaagctcgccgtgaaggtgtccgccgcggccgccaccgccccggcggcgtcgtccccgcccgccgacgacggtacgcccccggagaccaccacgccgtccgcgtcgacgccccccgcgacgacgacgacggcgcccacgaccaggtccacctcgaccagcaccgccggggaggccccgcccgcgatgggcgtcctggccggcgccgcggggctcgtcggcctcgccctgatggcctaggcaagaggcagtgctctgctgtccgtccccgtggcttctccgtttggttgcggtcggttgttttacgcgctctcaattcacgtctctgtgtcgcgaacgtctgctcgtgttgtgtacctgtacctgtacctgtacgatcattctagatttagaggaactactgttctctg

SEQ ID NO: 34311 - protein, 192 aa, Panicum virgatum
  misc_feature: Ceres CLONE 1955842
  misc_feature (34)..(114): Pfam Name: Cu_bind_like Pfam Description: Plastocyanin-like domain
MAGAAVIAGLVLLAAAAAAPASATDYVVGDSSGWNSGVDYTTWAKGKTFSVGDNLVFQYSAMHTVAEVSSADYSACSASNSLQSYSDQNTKIALTAPGTRYFICGTAGHCSGGMKLAVKVSAAAATAPAASSPPADDGTPPETTTPSASTPPATTTTAPTTRSTSTSTAGEAPPAMGVLAGAAGLVGLALMA

SEQ ID NO: 34312 - DNA, 885 bp, Panicum virgatum
  misc_feature: Ceres CLONE 1955843
  misc_feature: Encodes the peptide sequence at SEQ ID NO. 34313
aaaccctagatctcgtctcgccgccccgatccgaatcgcatggattcgtcgtcgtcctccagcctgagccagcagcctgagttcgactacctcttcaagctgctgcttatcggcgactccggcgtcggcaagagcagcctcctcctccgcttcaccgccgactccttcgaggacctctcccccaccataggtgttgacttcaaggtgaagatggttaacattggtggcaagaaactcaagcttgccatttgggacacagctggacaggagagatttaggaccttaaccagctcatactacagaggagcacagggaatcattatggtgtatgatgtcacaagacgagaaacatttaccaatctttctgatatatgggcaaaggaaattgacctgtattcaaccaaccaggattgtataaagatgcttgttggaaacaaagtagacaaggaaagtgagagggctgtcacaaaaaaagagggaatcgaatttgctagggaatacggatgtttatttctggaatgcagtgcgaaaacaaaagtaaatgtagaacagtgctttgaggaactcgtcctaaagatattagacacgccaagcctactagctgatgcttcgtcaggggccaagaagaacattttcaaacagaagccaccggaagctgacgcggctgcaagcagctgctgttaacttccgtgctaatccgggtcgggtagctcctgtggatgatgatatctttgttgcataaagtgataagctttgttgtgctgatttattttgcttttggtcctgtatattgccatgctaaaattagactcacacgcataacattacattggcagcagatatataatgtgttatgttaaatctacctgacaacatcatagtttg

SEQ ID NO: 34313 - protein, 214 aa, Panicum virgatum
  misc_feature: Ceres CLONE 1955843
  misc_feature (20)..(182): Pfam Name: Ras Pfam Description: Ras family
  misc_feature (20)..(135): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 51457
  misc_feature: Useful for making plants with altered lignin content
MDSSSSSSLSQQPEFDYLFKLLLIGDSGVGKSSLLLRFTADSFEDLSPTIGVDFKVKMVNIGGKKLKLAIWDTAGQERFRTLTSSYYRGAQGIIMVYDVTRRETFTNLSDIWAKEIDLYSTNQDCIKMLVGNKVDKESERAVTKKEGIEFAREYGCLFLECSAKTKVNVEQCFEELVLKILDTPSLLADASSGAKKNIFKQKPPEADAAASSCC

SEQ ID NO: 34314 - DNA, 826 bp, Panicum virgatum
  misc_feature: Ceres CLONE 1955847
  misc_feature: Encodes the peptide sequence at SEQ ID NO. 34315
aggcggcgaatccctagttccccgtccagtccttcggcacccgaattccggcggcggcggcgatggcggcggctgctgcgaggtccggtttccggcgcatgttctccatctcggccttcgcgccgccgaagccgcccgccccgcgaccccaggccgacccctccccgaacctcttcgtctccggattaagcaagcgtaccacaacagatggacttagaaatgcttttgcaaagttcggggaagttgtgcatgctcgagttgtgacagaccgtgtcactggttattcgaaggggtttggctttgtaaggtatgctacaactgaagaggcagggaaaggaatagaaggaatggatggaaagttccttgatggatgggttatttttgcggaatacgctaaacccaaaccagcaccccaggaagcagagatgaactcgcagccacaacaatcatggggtcctccatcaagttcctggggttcacagtagatgaagagctgccagccctctatccagccttggggctcacagtggatcaagaggccatcaattcagcatctaatttatagatattgtgtgtgctgtgcgagttgtgaatgccctagacgttccgatattcttgccgtgttggagtggtcgttggattgccgtgttggagtggtcgtttacttgcgtccatgatttccacatgaagaggtagttgtcaatcccaacacggaccaaaacaaatattactatgtgcaacagatgagaaacagttgaaaacctttgcgaataatgtctgccgttgtgcttgttgtgggatgttatgcgaggatgtcattttactc

SEQ ID NO: 34315 - protein, 140 aa, Panicum virgatum; identical to SEQ ID NO: 26216
  misc_feature: Ceres CLONE 1955847
  misc_feature (37)..(108): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase

SEQ ID NO: 34316 - DNA, 992 bp, Panicum virgatum
  misc_feature: Ceres CLONE 1955850
  misc_feature: Encodes the peptide sequence at SEQ ID NO. 34317
gcacgtaactagtgtccttcctccgtcttcctcctctcgctctcatccactctccacgcccagcgccccccctcgccacggcggtgcggagcttcggcggctcggctcgagcagaagaaaatgcaacgggcagtgcaagccatcaggtcgcatggcagtgtgcttaaatatgctgttcaacaacacatgagcgctcccaaaccagcaatgcttcctgctgccttttctcgcttcatgtcagcttcatctgctcgcctagaggatagtggatttgaaactgccactgtagcagatatcttgaagtctaaaggtaagagtgctgatggatcttggctctggtgcaccacagaggacagtgtctatgatgctgtcaaatcgatgacgcaacacaatgtgggagctttggtggtggtcaaacctggacaggaaaaatcacttgctggcattgtcacagagagagattatctccggaaaatcatagtgcaaggacgatcttccaagtcaactaaggttggagacatcatgactgaagagaacaagctgatcaccgtgaagcctggaaccaaggtcctgcaagccatgcagctgatgacagagaaccgcatcagacacatcccggtgatcgaaggcacagggatgctggggatggtctccatcggcgacgtcgtccgtgcggtggtcaacgagcacagggaggagctgaaccggctcaacgcctacatccagggaggctactaggacgacgcccctacctcccagcgaagtccgcctttgatatccaataactcggaccagtgatgatgacgaaataggccgtgtgttcgcggacaatgttgttgaattgcgcaaggtgttttcccccgcgtttactatatgtgtatattgccaaaaggcgggcgtgacagtgcgcctggtgctggggcgcagccgcgcagactatctgacggtggaaacaccggaaataaaaagcgtgccgccgtgtgcttgcttcc

SEQ ID NO: 34317 - protein, 205 aa, Panicum virgatum
  misc_feature: Ceres CLONE 1955850
  misc_feature (65)..(187): Pfam Name: CBS Pfam Description: CBS domain pair
  misc_feature: SWISSPROT Homolog: EC 1.1.1.205 IMP dehydrogenase
MQRAVQAIRSHGSVLKYAVQQHMSAPKPAMLPAAFSRFMSASSARLEDSGFETATVADILKSKGKSADGSWLWCTTEDSVYDAVKSMTQHNVGALVVVKPGQEKSLAGIVTERDYLRKIIVQGRSSKSTKVGDIMTEENKLITVKPGTKVLQAMQLMTENRIRHIPVIEGTGMLGMVSIGDVVRAVVNEHREELNRLNAYIQGGY

SEQ ID NO: 34318 - DNA, 530 bp, Panicum virgatum
  misc_feature: Ceres CLONE 1955880-R
  misc_feature: Encodes the peptide sequence at SEQ ID NO. 34319
ggaggcgttccgcgtgttcgacgaggacggcgacggcttcatctccgcggccgagctgcaggccgtgctcaagaagctcggactcccagaggcgaggaacctggccacggtgcaggagatgatctgcaacgtcgaccgcgaccacgacggccgcgtcgatttcggcgagttcaagtgcatgatgcaggggatcaccgtctggggcgcctaaccgcagctccggccctcggcctccactcctctactccgtgttgccatgtatgtacctaggcatcatcgtagagtgctttacttctgcttagcgcctcttcttgaccgccggggactcttcttgttcttgatgacttcgctccgcctctgccagtagtctgagaattttagacaacaaccaaaaccatggccaccacatgcccacatgcaccgcttcctttttcttgatttattaattacaatttttctacgtgtaagaacaacgctgactatgaccagcttccgttccgtccaagtttatcttccttcgctttcttgtc

SEQ ID NO: 34319 - protein, 69 aa, Panicum virgatum
  misc_feature: Ceres CLONE 1955880-R
  misc_feature (36)..(64): Pfam Name: efhand Pfam Description: EF hand
  misc_feature: SWISSPROT Homolog: EC 2.7.11.1 Non-specific serine/threonine protein kinase
EAFRVFDEDGDGFISAAELQAVLKKLGLPEARNLATVQEMICNVDRDHDGRVDFGEFKCMMQGITVWGA

SEQ ID NO: 34320 - DNA, 234 bp, Panicum virgatum
  misc_feature: Ceres CLONE 1955880
accaacaaggcaagcaacagcagcatacgcgctccagaaatactactactattcaccaacaactcctagcaaacccaaacacgagcccggctccggaggaaacgccgggacctcagttcgcgacatggagagcaccccggcccctgccgccgacgagacaaagccgtctctgtccaagacgaagccctcgccgtcgttccgcctccgcaacggcagcctcaacgcgctgcgacg

SEQ ID NO: 34321 - DNA, 746 bp, Panicum virgatum
  misc_feature: Ceres CLONE 1955881
  misc_feature: Encodes the peptide sequence at SEQ ID NO. 34322
aatctgccgtcgcccgactcgcaccgtagcacacaaccctcacgttccgtccccaaccaccgcctcgtttcgccgccgtcgtcgggtggtcgagagaagagatggcgggccgtggcaaagcgatcggcgcgggcgcggcgaagaaggcgacgtcgaggagctccaaggccgggctccagttccccgtcggcaggatcgccaggttcctcaaggccggcaagtacgccgagcgcgtcggcgccggcgctcccgtctacctcgccgccgtcctcgagtacctcgccgctgaggttctcgagctggccgggaacgccgcgagggacaacaagaagacccgtatcgtgccgcgccacatccagcttgccgtccgcaacgacgaggagctctcgcgcctgctgggcacggtgaccatcgcgagcgggggtgtcatgcccaacatccacaacctgctgctccccaagaagtccggtggcggcagcgccaaggctgtggccggcgacgaggactagatccctgactgcaccgcccctcgggtggtggtgcttcttgtggatgcagcgtatcacttgtgcttgtgtagtagtgtgttctagactcgcctaggtgtagccttcttgtagggaggttgtatgtgtgtgccctgtaccgatgcgaaacctagttcactcttgtgttcgataaggattagttatttctgtatttgttgccatatctctataaaagatgcatcgttccgatggcttgtc

SEQ ID NO: 34322 - protein, 135 aa, Panicum virgatum
  misc_feature: Ceres CLONE 1955881
  misc_feature (19)..(92): Pfam Name: Histone Pfam Description: Core histone H2A/H2B/H3/H4
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELSRLLGTVTIASGGVMPNIHNLLLPKKSGGGSAKAVAGDED

SEQ ID NO: 34323 - DNA, 695 bp, Panicum virgatum
  misc_feature: Ceres CLONE 1955884
  misc_feature: Encodes the peptide sequence at SEQ ID NO. 34324
tcgtctcagtcggcagccgagagagttttctccctcggtctctccctccccagatccccgccatggcccgctcctcttcgcagtcccagtcctccgtcggcggcgccggcgccggcgccggagcccgcccggccaccgttggcccgcgcggcacggccgcagctgccccccgcmtgcgcsgccgccgcgcctccgccagcgccgggggagggggcttctccggcggcggagggagcaacatgcttcgattttacaccgacgaggccccgggtctgcgcctctcgccaaccatggtgctcgtcatgtcgctgtgcttcatcggattcgtcaccgccctccacgtcttcggcaagctctaccgctcccgcaccgcagcagcctccgcgtgatccatcccatcccatccctccggcgcgagtatcatcagatcacaaggttttcaatatatcatcatcagtctacttactcgtcttgcctagctttccttcctgtgctagatctggagggagatgaatggaaccctacaacttaaatgatgccctttcttttgccttgttcatcccctttcctttttttagtgcctttttatttactcccagatgcaaagagttgtgcctagtcactgtaatcatggggttgctacaattaattttgcatctcagtaacttagcgtgtgctccaggaatcgtgcatcc

SEQ ID NO: 34324 - protein, 108 aa, Panicum virgatum
  misc_feature: Ceres CLONE 1955884
  misc_feature (54)..(99): Pfam Name: Sec61_beta Pfam Description: Sec61beta family
  misc_feature (38)..(38): Xaa is any aa, unknown, or other
  misc_feature (40)..(40): Xaa is any aa, unknown, or other
MARSSSQSQSSVGGAGAGAGARPATVGPRGTAAAAPRXRXRRASASAGGGGFSGGGGSNMLRFYTDEAPGLRLSPTMVLVMSLCFIGFVTALHVFGKLYRSRTAAASA

SEQ ID NO: 34325 - DNA, 905 bp, Panicum virgatum
  misc_feature: Ceres CLONE 1955893
  misc_feature: Encodes the peptide sequence at SEQ ID NO. 34326
atcaccacacgaaacacacaggagaaacatgtctgcttccgccgcggccgcctcccgtgtcctccgcttctcctccgccactccctcacttgctcctctccaccggccgctccgccggcggcttccgtccgtccggtgctccctcgccgcttaccccggtgtccgggcgccgccggagctcgtcgactccatcctctccaaggtgaagggaactgaccgaggagtgttgctgcctaaagatgggcaccaggaagtggctgatgttgcgctgcagcttggaaagtactgcatagacgagcccgtcaagtccccacttatatttggagaatgggaggttgtgtattgctcggtgccaacgtctccaggagggctataccggacgcctctcggccgcctgatattcaaaactgatgagatgatccaggtggtggaagcccctgatgttgtcaggaacaaggtgtcattctccgtctttggtctcgagggtgcagtatcgttgaaaggtaagctgaatgtattggacagtaagtggattcaggtcatctttgaggccccagagttgaaggtaggctccttggggttccaatatggtggggagagcgaggtcaagctggagatcacttatgtcgacgagaagatcagactagggaaagggtctagaggctcgcttttcgtgttcctcagacgaggatagaacgacatgtgtgcactggggtgtgctcgacaccacaagcgcaaggggtgtgctcgtctgtacaatattgtagtattcaggatttcacatgtaaaattcagaagccaatttggggcagttttcctgcatattgtaacctaaagaacgttatctggctcgttttggacaagtgtacaaccgatgatgttttgtcaactaagtgatttatttc

SEQ ID NO: 34326 - protein, 221 aa, Panicum virgatum
  misc_feature: Ceres CLONE 1955893
  misc_feature (49)..(218): Pfam Name: PAP_fibrillin Pfam Description: PAP_fibrillin
MSASAAAASRVLRFSSATPSLAPLHRPLRRRLPSVRCSLAAYPGVRAPPELVDSILSKVKGTDRGVLLPKDGHQEVADVALQLGKYCIDEPVKSPLIFGEWEVVYCSVPTSPGGLYRTPLGRLIFKTDEMIQVVEAPDVVRNKVSFSVFGLEGAVSLKGKLNVLDSKWIQVIFEAPELKVGSLGFQYGGESEVKLEITYVDEKIRLGKGSRGSLFVFLRRG

SEQ ID NO: 34327 - DNA, 446 bp, Panicum virgatum
  misc_feature: Ceres CLONE 1955898-R
  misc_feature: Encodes the peptide sequence at SEQ ID NO. 34328
ggcctacaacaagggcgagagcactgctgccaagaaggctcctgccaaggaggaagaggaggaggatgaagaggagtctgacaagtcaaagtctgaggtcaacgacgaggatgatgaagagggtagtgaggaggatgaagacgatgacgagtaagctcaggtcaagttgatgctccattcaacaatggagtgccagaatgcaaaggccctgtgtcgggaattaaaaggagcctatccagtctactagaattattcagtttcacttcacatcgtgatgttttacttttgtctgtcctataatggatatcgttccttgttggcgccaccggcgggctagtgtttgcacggtgggcacaccggcaatacccgcttgtacctagattaccgtttccattgtcatcagctaacattgtgataatatcagtttgggtaatgttagattaagt

SEQ ID NO: 34328 - protein, 50 aa, Panicum virgatum
  misc_feature: Ceres CLONE 1955898-R
  misc_feature: Functional homolog of the protein sequence given in SEQ ID NO 50396
  misc_feature: Useful for making plants with altered alkaloid content
AYNKGESTAAKKAPAKEEEEEDEEESDKSKSEVNDEDDEEGSEEDEDDDE

SEQ ID NO: 34329 - DNA, 396 bp, Panicum virgatum
  misc_feature: Ceres CLONE 1955898
ctctctgtctcctcctccctttcccctcccaacgccaggccagacttgccctctccgcgtacagaaatccgccatgaggggggacgaatcctagcggcgccgcccaggcccatgccaacctggtggtgaaaagtaagggagcggagaaaccggccagcggccggaatggaaaggccggaaacgaccccaaaaagccaaagagggcgcccagcgccttctttctcttcatcgatgaattccgcaaggatttcaaggataacaaccctaaaaccaaatctgttgctgccgtggagaaatctgccggcaacaggtggaaatccccgacagaagcccacaacgctccttatgtcgccaaggccaataaactcacacttgagtacaacgaggccattgcgg

SEQ ID NO: 34330 - DNA, 767 bp, Panicum virgatum
  misc_feature: Ceres CLONE 1955911
  misc_feature: Encodes the peptide sequence at SEQ ID NO. 34331
gtgagggcacccaatctgctgccaaaccagctaagaaacctcgccgcaatatcaatgtacacagtcgcttatcttcatgtgcttggagattcaatccagagcatcggggtaatgataggtggggctatcatctggtacaagcctgagtggaagatcatcgatctcatctgcaccctcatcttctctgtggttgtactgtttaccacaatcaggatgctgcgcaacatacttgaagtactgatggagagcactccccgtgagattgatgccaccatgctcgagatggggctctgcgagatggatggtgtggttgctgtccacgawcttcatatctgggccatcacagtagggaaggtgctcctagcatgccatgtgacaatagcaagggaagccgatgccgatcagatccttgacaaggtgatcrgatatatcaagacagartacaacatcagccatgtgaccattcagattgagcgtgastagggatataaagggtgtcttcrctggttatcttgttcatgtcagttaatactgctttttgcaccgggtaaggcatcagccactcaaccgagccataatgtgctcacaggttcatcasctttgatgctggttaatataatctattactagtctattaggtgaaggagttattcgggtggcgtagttgtcggtctgggcattcacatggatgaatttttcggacatgttgtgagttcatcgaattgcatctgtagtgagaaataatttagcaacctgtgtcgtcacct

SEQ ID NO: 34331 - protein, 160 aa, Panicum virgatum
  misc_feature: Ceres CLONE 1955911
  misc_feature (1)..(160): Pfam Name: Cation_efflux Pfam Description: Cation efflux family
  misc_feature (108)..(108): Xaa is any aa, unknown, or other
  misc_feature (142)..(142): Xaa is any aa, unknown, or other
  misc_feature (160)..(160): Xaa is any aa, unknown, or other
VRAPNLLPNQLRNLAAISMYTVAYLHVLGDSIQSIGVMIGGAIIWYKPEWKIIDLICTLIFSVVVLFTTIRMLRNILEVLMESTPREIDATMLEMGLCEMDGVVAVHXLHIWAITVGKVLLACHVTIAREADADQILDKVIXYIKTEYNISHVTIQIERX

SEQ ID NO: 34332 - DNA, 1101 bp, Panicum virgatum
  misc_feature: Ceres CLONE 1955913
  misc_feature: Encodes the peptide sequence at SEQ ID NO. 34333
aactcccactccaaccacagcagcagctagcgaccggtctcactctcagcaatcgcctcacgcaatggccgcctccaccatggcgatctcctccccggcgatggccggcacccccatcaaggtgggctccttcggcgagggccgcatcaccatgcgcaagaccgcggccaagcccaaggtggcggcgtccggcagcccatggtacggccccgaccgcgtcaagtacctcggccccttctccggcgagcccccgagctacctcaccggcgagttccccggcgactacggctgggacaccgcggggctgtccgctgaccccgagaccttcgccaagaaccgcgagctggaggtcatccactcccggtgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctcatccacgcccagagcatcctcgccatctgggccgtccaggtcgtgctcatgggcgccgttgagggctaccgcattgccggcggcccgctcggcgaggtcgtcgacccgctctaccccggcggcagcttcgaccccctcggcctggctgacgaccccgaggccttcgccgagctcaaggtcaaggagctcaagaacggccgcctcgccatgttctccatgttcggattcttcgtccaggccatcgtcaccggcaagggcccgctcgagaacctcgccgaccacctcgccgacccggtcaacaacaacgcctgggcctacgccaccaacttcgtccccggcaactaagctccattggctctgcaacttcattgtcttccggaggaggcgtacgtggatccattgatgctgcaagctgccgcgtgtgcgtctcttgtttcacgttgcatttcaggggcaagtcgagatgatgagttggccgttgtacactaagatgaaagatgatgcttgtgcaatagtagtggttttgtttcctgttggttgatcattgatttgtcagattaatggcaccttattggtttcttctcctgcttttt

SEQ ID NO: 34333 - protein, 262 aa, Panicum virgatum
  misc_feature: Ceres CLONE 1955913
  misc_feature (61)..(229): Pfam Name: Chloroa_b-bind Pfam Description: Chlorophyll A-B binding protein
MAASTMAISSPAMAGTPIKVGSFGEGRITMRKTAAKPKVAASGSPWYGPDRVKYLGPFSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWAVQVVLMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGN

SEQ ID NO: 34334 - DNA, 875 bp, Panicum virgatum
  misc_feature: Ceres CLONE 1955920
  misc_feature: Encodes the peptide sequence at SEQ ID NO. 34335
gcgaccccaggtcagacgggatcacccgctgagtttaagcatataaataagcggaggagaagaaacttacaaggattcccctagtaacggcgagcgaaccgggagcagcacacatgcaaccatatcttcgtgggaactaacttgtaagtaaacatttgcaccgactgatcactagctaacacgatggtcgccggcagcatcaccgaggaggttgccatggccgcgccggccgagctggtgtggaaggcgatcttcgagacctgtgacgagtcctccctgcgcaacctgctgtccggcgtgatcgacggcgtcgtgaaggtcgacggcgacggcgggcccgggagccgctacaccctcaagttcagccccgccgtcggcgcagcgccggtgctcctcaagtgccggctggcggcacgcgacaacgcggcgcgcgcgattaccttcgacgaggtggcggcggagggcggcgaggtggcgccggcggcacagctcaagtcgcaggtggtccagttcaaggtggagcccgctggcgccggcggctgcgtgatcaagatcgccgtggagtcggagcgccccgacggcacgccggtgtcgctggcggacgaccaggccaagctgaccaagctggtcgtccacctcatcaagaaggtggaggggaaaatcgtgccgagcccccagtgcgcctgatgagctggcccgaagctcagatgatccaccacaagacttccgcgcgccattatataataagaataagaatcgatagcacggtagtatgatctatcgatgcatgaccaccccgtttgcgttctgttgtgtttccagtacatataaatatatataataaccaaaggtaagtgagatcctttgttttgttt

SEQ ID NO: 34335 - protein, 167 aa, Panicum virgatum
  misc_feature: Ceres CLONE 1955920
  misc_feature (1)..(163): Pfam Name: Bet_v_I Pfam Description: Pathogenesis-related protein Bet v I family
MVAGSITEEVAMAAPAELVWKAIFETCDESSLRNLLSGVIDGVVKVDGDGGPGSRYTLKFSPAVGAAPVLLKCRLAARDNAARAITFDEVAAEGGEVAPAAQLKSQVVQFKVEPAGAGGCVIKIAVESERPDGTPVSLADDQAKLTKLVVHLIKKVEGKIVPSPQCA

SEQ ID NO: 34336 - DNA, 827 bp, Panicum virgatum
  misc_feature: Ceres CLONE 1955921
  misc_feature: Encodes the peptide sequence at SEQ ID NO. 34337
gcaataagccgttcacagcatatctttgagtgcaatagctcactgcattcagtcagatcatttgttgtgtaaaatacaaatacctgaccctcaaaccatgcctaggtctgtggagcctctcatagtcggtcgggtgattggagaagttctcgactcctttaacccatgtataaagatgatagtgacctacaactcaaacaagcttgtcttcaatggccatgagatctacccatcagcagttgcatctaaaccaagagtggaggttcaagggggtgatttgcggtctttctttacattggtgatgacagatccagatgtcccaggaccaagtgatccatatctaagggagcaccttcactggatcgtgactgatatacctggtacgacagatgcctcctttgggcgagaggtcataagctacgagagcccaagacctaacatcggtatccataggttcatttttgtactcttcaagcagaagcgcaggcaaactgtaactgtgccatccatcagggatcatttcaacacccggcagtttgctgaggaaaatgaccttggtctccctgtagctgctgtctacttcaatgcacagagagaaactgctgctaggagacgctgaaaatcttattgtccacctgatgataaacaagggccttctgatcttctttctacgaggacgatgatcttattctacattaccctataaataagcaagctgcattttgcagagtgtatcagtattagattgttttcttagtgtcaagattgacaatcatgaatgattgatgcttgtggtcaaattttatatataagacaacttttcaacg

SEQ ID NO: 34337 - protein, 173 aa, Panicum virgatum
  misc_feature: Ceres CLONE 1955921
  misc_feature (19)..(165): Pfam Name: PBP Pfam Description: Phosphatidylethanolamine-binding protein
  misc_feature: The sequence is a functional homolog of SEQ ID NO 2 in US patent 7208653
  misc_feature: Functional homolog of the protein sequence given in SEQ ID NO 51458
  misc_feature: Useful for making plants with modulated flowering time
  misc_feature: The sequence is a functional homolog of SEQ ID NO 2 in US patent 7196246
MPRSVEPLIVGRVIGEVLDSFNPCIKMIVTYNSNKLVFNGHEIYPSAVASKPRVEVQGGDLRSFFTLVMTDPDVPGPSDPYLREHLHWIVTDIPGTTDASFGREVISYESPRPNIGIHRFIFVLFKQKRRQTVTVPSIRDHFNTRQFAEENDLGLPVAAVYFNAQRETAARRR

SEQ ID NO: 34338 - DNA, 692 bp, Panicum virgatum
  misc_feature: Ceres CLONE 1955931
  misc_feature: Encodes the peptide sequence at SEQ ID NO. 34339
atcatcgcatcccgcactctctcccaacagagctatcggaagaagaggagagcttttgggcttttgggggtgcgtggtgcgccatgggggaggtgaaacacctgtgcctggtgaagttcaaggagggcgtcgtggtggargacgtcctcaaaggcatgaccgaccttgtccctcagatggacatggtcaaatccttcgagtggggccaggacgtgctgaaccaggagatgctgacgcagggcttcacgcacgtcttctcgctcaccttcgcctccgccgacgacctcgccacctacatgggccacgacaagcacgccgcgttcgccgccacgttcatggccgcactcgagaaggtggtcgtcatcgacttccccgtcgtcatcgccaagccaccgccatcggcatgatcgacctgccacagcatctgtcggccattgtacggtgccttttcaggtagcagatcatcgcctatttgcagcggtgatgtactgcgtgtctaagtacgtactatgtactaaagctccttattactactcgttctgcctgatgctgtgtcccgtactctaggacgtttattgtagctgtaaggcaaagatatctatagcgtacgtgcagcactccgtgctccacagtccctaatggttggttggttatctttggaataaattttggtgatctttctggtagcagcc

SEQ ID NO: 34339 - protein, 107 aa, Panicum virgatum
  misc_feature: Ceres CLONE 1955931
  misc_feature (4)..(98): Pfam Name: Dabb Pfam Description: Stress responsive A/B Barrel Domain
MGEVKHLCLVKFKEGVVVEDVLKGMTDLVPQMDMVKSFEWGQDVLNQEMLTQGFTHVFSLTFASADDLATYMGHDKHAAFAATFMAALEKVVVIDFPVVIAKPPPSA

SEQ ID NO: 34340 - DNA, 645 bp, Panicum virgatum
  misc_feature: Ceres CLONE 1955933
  misc_feature: Encodes the peptide sequence at SEQ ID NO. 34341
agcgtcttccccaacctgcgcgagctctcgtctccggcggcggaagcgaaaggaagcaggcggccaccatggtgaagggacgcacagggcagcgcgtcaggctctacgtccgtggcaccatcctcggatacaagaggtccaagtcgaaccagtacgagaccacgtcgctggtgcagatcgagggggtgaacaccaaggaggacgtcgcgtggtacgccggcaagcgcatggcgtacatctacaaggccaagaccaagagcagcgagacgcgctacaggtgcatctggggcaaggtcacccgcccgcacggcaactccggcgtcgtccgcgccaagttcaagtccaacctcccgccggagtccatgggacgcaaggtcagagtgttcatgtacccgagcagcatctaaggttttgttgaagtagggatggccatggttatttcttacttatcttgagctgaaaattccatgttttggtgaacccctgctgtgttggcaacttagattgttcatgtactgcgaatgtggaagttttgccaaaatttgttgtctaaaggatgaaccattatcgtgatgttatgccagcaccagagcttattttgagcatcagatgccttgccattgttgtttaatattattatcttcc

SEQ ID NO: 34341 - protein, 112 aa, Panicum virgatum
  misc_feature: Ceres CLONE 1955933
  misc_feature (12)..(106): Pfam Name: Ribosomal_L35Ae Pfam Description: Ribosomal protein L35Ae
MVKGRTGQRVRLYVRGTILGYKRSKSNQYETTSLVQIEGVNTKEDVAWYAGKRMAYIYKAKTKSSETRYRCIWGKVTRPHGNSGVVRAKFKSNLPPESMGRKVRVFMYPSSI

SEQ ID NO: 34342 - DNA, 1050 bp, Panicum virgatum
  misc_feature: Ceres CLONE 1955936
  misc_feature: Encodes the peptide sequence at SEQ ID NO. 34343
gccgtttctcatttctcaaccaagaagaaagaagccgccccgccccgtccatccatcaaggtcgtaggtcgagaagcccggcggccgccatggactgccagcaggctgctaccaacggccgccaccacaacgacggcgacgccgccgagtggaagcaggtcgccgagctgagggccgtcaccgaggcgcaggaccctgcctgcaaggaggaggacgactacatgctgcgtcggttcctccgcgcccgcgaccaccacatcggcaaggcatcggcgatgctgctcaagtacctcaagtggaagccgacggccaagccccgcggctgcatctccgagtcggaggtggcgcacgagctgtcccagggtaagttgtgcctgcagggccacgaccggcaggggcggcccatgatatacggcttcggcgcccggcaccacccctccaaccgcgacctcgacaagttcaagcgcttcgtcgtctacgtgctggacgccaccgtcgccaggctgccccccgggcaggagaagttcgccgccgtcgccgacctcaagggctggggctactccaactgcgacatccgggcctacctcgcggcgctcgagatcatgcagaactactacccggagcgcctcggccgggtgttcctcatccacgtgccctacgtcttcatggccgcctggaagatcgtctaccccttcatcgacgacaacaccaagaagaagttcgtcttcgtctccgacaaggacctcgacaggacgctccgggaggccatcgacgacgcccagctgccggaggtgtacggcggaaagctcaagctcgcgtcgccggccaagagtaagtgatcatcactacgtactgatgatctgaatctctagtgatggcacggcggttcagcaatcagcagagacgacgaccccgtgcatcggtgcatgctgtattcagtggcggagctaggattgaaacttagggtatgccatatcaaaattttaacatacaattcggtattcggtacaatctaaaaaaattcggtgcataataaaatatttcacgagc

SEQ ID NO: 34343 - protein, 249 aa, Panicum virgatum
  misc_feature: Ceres CLONE 1955936
  misc_feature (93)..(249): Pfam Name: CRAL_TRIO Pfam Description: CRAL/TRIO domain
  misc_feature: SWISSPROT Homolog: EC 3.1.3.48 Protein-tyrosine-phosphatase
MDCQQAATNGRHHNDGDAAEWKQVAELRAVTEAQDPACKEEDDYMLRRFLRARDHHIGKASAMLLKYLKWKPTAKPRGCISESEVAHELSQGKLCLQGHDRQGRPMIYGFGARHHPSNRDLDKFKRFVVYVLDATVARLPPGQEKFAAVADLKGWGYSNCDIRAYLAALEIMQNYYPERLGRVFLIHVPYVFMAAWKIVYPFIDDNTKKKFVFVSDKDLDRTLREAIDDAQLPEVYGGKLKLASPAKSK

SEQ ID NO: 34344 - DNA, 864 bp, Panicum virgatum
  misc_feature: Ceres CLONE 1955937
  misc_feature: Encodes the peptide sequence at SEQ ID NO. 34345
ctcaaatcgctccctgcctcctgtcgccctccgcagcccctgcctccctgcctgcccaatctctccggccgccccgacgccgttcgtccgctcgcgcccgcccgcccgccgctcggagagagaagaccggagaccatggcggaccagctcaccgacgaccagatcgccgagttcaaggaggccttcagcctcttcgacaaggacggcgacggttgcatcacaaccaaggagctgggaactgtcatgcgttccctgggtcagaacccaaccgaggctgagctccaggacatgatcaacgaggtcgacgctgatggcaatggcaccatcgacttccccgagttcctcaacctcatggcccgcaagatgaaggacaccgactctgaggaggagctcaaggaggcgttcagggtgttcgacaaggaccagaacggcttcatctccgctgcggagctccgccacgtgatgaccaacctcggcgagaagctgaccgacgaggaggtcgacgagatgatccgcgaggcggacgttgatggcgatggccagatcaactatgacgagttcgtcaaggtgatgatggccaagtgaggccgtgtttgatggtatactaccccccgccggaaggaggaaaccgtgcattgcgtattagtaaggcatgcggctcttgtttccttcatcttcccctgaagaaaaccgtactagctgtagctgctgaacatttgagtccctctgctgccacccctgcctgcccagtctgtcgtcgaacgaaactcttgcttcctgtgtgaatctgtacggctttgcttgttctggaccctgattgcggttgaatccagtttgtagtaaaatttgttcatcggtcgaatc

SEQ ID NO: 34345 - protein, 149 aa, Panicum virgatum; identical to SEQ ID NO: 12102
  misc_feature: Ceres CLONE 1955937
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 50110
  misc_feature: Useful for making plants with modulated salt sensitivity

SEQ ID NO: 34346 - DNA, 749 bp, Panicum virgatum
  misc_feature: Ceres CLONE 1955939
  misc_feature: Encodes the peptide sequence at SEQ ID NO. 34347
aaaccctatccgcgaccgccccctcgcatcgccagccgccggcgccgccgacgccgcctatctcccaccggcctggttgcaccatgggggacgtcgatgtcgagcccgaggtcgcccccggcgcgcccaagaccaagacgttcctcaagtactgctaccgcggcgtctacctccacgcgctgctccacatgcccaccgacgacctcgtccagctcttccccgcgcgcgcgaggagaaggttccagaggggtctgaagaggaagcccatggcgctcatcaagaagctgcgcaaggcgaaaaaggatgctcctgccggcgagaagccagagccagtgaggacccatctccgcaacatgatcattgtccctgagatgattggaagcatcattggtgtctacaacggcaagacattcaaccaggttgagatcaagcctgagatgattggccactacctcgctgagttctccatctcctacaagccggtcaagcatggtaggcccggtatcggtgccactcactcctcacggttcattccgctgaaatgagttatcagcccagttatcagcctccagaatccagcacggaaggcgcatggcatgtcttgtttccttccagttgtgctgcttgttttgaacaagttacataccaatggtgttttgctctgttccagctctagaatcctagctaagcactgcacaatttatgctgttttgagttaatcttatctatactgcgatgtggttactttt

SEQ ID NO: 34347 - protein, 153 aa, Panicum virgatum
  misc_feature: Ceres CLONE 1955939
  misc_feature (55)..(136): Pfam Name: Ribosomal_S19 Pfam Description: Ribosomal protein S19
MGDVDVEPEVAPGAPKTKTFLKYCYRGVYLHALLHMPTDDLVQLFPARARRRFQRGLKRKPMALIKKLRKAKKDAPAGEKPEPVRTHLRNMIIVPEMIGSIIGVYNGKTFNQVEIKPEMIGHYLAEFSISYKPVKHGRPGIGATHSSRFIPLK

SEQ ID NO: 34348 - DNA, 864 bp, Panicum virgatum
  misc_feature: Ceres CLONE 1955957
  misc_feature: Encodes the peptide sequence at SEQ ID NO. 34349
aatccccacctcaatccgcttgtgaggccgcgtggaggctgcctgcctgccgcggcgctccggctgcgctccgatccagagcgagcgagagcaaggaccccagcgctccccgccgcgagacctcacgcggttccgacgcgatcggtgccgtcgaaccacccctgagcatcccctcgcgtgtgaagctacccagtttgctccaggattgtgtccattcgagaatatggctagaaagaggaacccaattgtctatctggatgtatccataggtgatgaactagatggaagaatgatctttgagttatttgctgatgttgctcccctgatatctgagaacttcagagctttatgcacaggggagctgggaaagactaagaagccattatgctacaagggttcaaccttccaccgtgtcatcaaggggttcatggcacaaggaggtgacttcgcaaaaggaaatggttctggtggagaaagcacatatagtgggaaatgtgcagatgaagctggtgtcctacgccatgatgatcgtggtctcttgacaacggcagatactggctcccaattttgtattactttcaagcctaattctcatcttgacagaaaacacactgtttttggcaagcttcttgttggaaatgatgtgttaaagaggatcgaacaagttgatgtgcatgaacctgattcgactccagttgttccggttaggatagtagattgtggggagctcactgaccgcaaacatcaagattctgtgaccactgaaaatgataaaaagaggggtgccaaaacaaagttgttgaaagatatatcttccgatgaggtaagtaatgaaggacaacacaagggacgtcgtaagaagtt

SEQ ID NO: 34349 - protein, 213 aa, Panicum virgatum
  misc_feature: Ceres CLONE 1955957
  misc_feature (8)..(169): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MARKRNPIVYLDVSIGDELDGRMIFELFADVAPLISENFRALCTGELGKTKKPLCYKGSTFHRVIKGFMAQGGDFAKGNGSGGESTYSGKCADEAGVLRHDDRGLLTTADTGSQFCITFKPNSHLDRKHTVFGKLLVGNDVLKRIEQVDVHEPDSTPVVPVRIVDCGELTDRKHQDSVTTENDKKRGAKTKLLKDISSDEVSNEGQHKGRRKK

SEQ ID NO: 34350 - DNA, 963 bp, Panicum virgatum
  misc_feature: Ceres CLONE 1955959
  misc_feature: Encodes the peptide sequence at SEQ ID NO. 34351
atcttcctttctctctccgccgccccgtgctcgtctccccccaattccatctccccttttcctcctcctcggtcgtcgcctccccccagagagcaggagcagccccccgctccgcagccatgaaccccgagtatgactacctcttcaagctgctgctcatcggggactcgggcgtcgggaagtcttgcctgctgctgaggtttgcggatgattcgtatctggaaagctatatcagtaccattggtgttgattttaaaatccgcactgttgagcaagatgggaagacaataaagctgcagatttgggacactgctggccaagagcgctttaggaccatcacaagcagctactaccgtggagctcatggcatcattgtcgtgtatgatgtgactgaccaggagagcttcaacaatgtcaagcagtggctgaatgaaattgacaggtacgccagtgaaaatgtgaacaagcttttggtggggaacaagtgcgacttggctgagagcagagtagtttcttatgaggctggcaaggcccttgctgatgagataggtataccgttcctggagactagtgccaaggatgcaacgaatgtggagaaggcattcatgaccatggcagcagagataaagaacaggatggcaagtcaaccagctgcaagtggtgctagcaggcctgcaacagtgcaaatgcggggtcagcctgttgctcagcaaagcagctgctgctcttgatcgactatctagatcgcagtagtgtgattgtgcagcaagcagcatgaattggttgctctatccctgtaaattaagtcttatcactatcgaaaaactttgtgttctctgttggatattggaagtatgtcacctgactgcaacacatttaagcagatgatgtgttcttactgcctgttcatattaagtgttcgattgattttcttagaaactcgaaaaaaaaataagatgcacc

SEQ ID NO: 34351 - protein, 203 aa, Panicum virgatum
  misc_feature: Ceres CLONE 1955959
  misc_feature (10)..(171): Pfam Name: Ras Pfam Description: Ras family
  misc_feature (10)..(124): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50630
  misc_feature: Useful for making plants with altered lignin content
  misc_feature: Functional homolog of the protein sequence given in SEQ ID NO 50522
  misc_feature: Useful for making plants with modulated oxidative stress sensitivity
  misc_feature: Functional homolog of the protein sequence given in SEQ ID NO 50163
  misc_feature: Useful for making plants with altered alkaloid content
MNPEYDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLNEIDRYASENVNKLLVGNKCDLAESRVVSYEAGKALADEIGIPFLETSAKDATNVEKAFMTMAAEIKNRMASQPAASGASRPATVQMRGQPVAQQSSCCS

SEQ ID NO: 34352 - DNA, 780 bp, Panicum virgatum
  misc_feature: Ceres CLONE 1955963
  misc_feature: Encodes the peptide sequence at SEQ ID NO. 34353
acttcctccattcgcgcttctcctctctctctctctctctctctctctctctctctctctctctcgctgcccgtctccactccctccgtcagatccctcgcccgggccaccatggcggaccagctcaccgacgaccagatcgccgagttcaaggaggccttcagcctcttcgacaaggacggcgacggctgcatcaccaccaaggaacttggaactgtgatgcgctcattggggcagaaccctaccgaggctgaactccaggacatgatcaatgaggttgatgcagatggcaacggaaccattgacttccctgagttcctcaacctgatggcacgcaagatgaaggacactgactctgaggaggagctcaaggaggccttccgtgtgtttgacaaggaccagaacggcttcatctccgcggctgagctccgccacgtcatgaccaaccttggcgagaagctgacagatgaggaggtggacgagatgatccgcgaagctgatgtggatggtgatggccagatcaactacgaggagttcgtgaaggtgatgatggccaagtgagatgtgctcttttgaagctagtttctctcctgatggtagtaactagtttagtgttgaaaactgactgcatttggttatcccttattccgatccgtgcgccaatgaacagatatgttgtttgttttcttccctgggatttcactgtatctgtaatttcttttggattcgtttgcgattgtattacatttatgttatctgggtacaatgatcatgccttcc

SEQ ID NO: 34353 - protein, 149 aa, Panicum virgatum; identical to SEQ ID NO: 12456
  misc_feature: Ceres CLONE 1955963
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 50110
  misc_feature: Useful for making plants with modulated salt sensitivity

SEQ ID NO: 34354 - DNA, 776 bp, Panicum virgatum
  misc_feature: Ceres CLONE 1955964
  misc_feature: Encodes the peptide sequence at SEQ ID NO. 34355
accatcctggcagagtccctgctccatggatacaagtttgacagcatcaacacggtgtactacatggcaccatttgcgacgatgatcctgtcaattccagcaatcgtgcttgaaggcagcggcgtggtgagctggctctacacctacgactctgtggcccctgcgctggtgatcatcatcacgtcgggggtgctggccttctgcctcaacttctccatcttctacgtgatccactcgacgacggccgtgaccttcaacgtggccggcaacctcaaggtggcggtggcagtgctggtgtcgtggatgatcttccggaaccccatctcggcgatgaatgccgtcggctgcgccatcacccttgtcggctgcaccttctacggctatgtgaggcacctcatctcgcagcaggccaccgccgcgcctggcccgcgcacgcccagaggccgcatggagatgctgccgctcaccggcgagaagcaaggcgacaagatttagcagcagctaccccatcttcttcatactgtcgatatcattaggaaagaataaaccagcatgtatacatctgatttaacagcctttcagcatggatcatcaggaaatttttggcatatagaagagaagcgaaatggcactagtttcagtcgagttggtgtagagcttcgtaaaagaattgctgattttttttttttttgctgctcatactagcatctttgtctgtctttgtttatggtcttgatgacgatgatatatttggtaacccagattttgttgatgtc

SEQ ID NO: 34355 - protein, 164 aa, Panicum virgatum
  misc_feature: Ceres CLONE 1955964
  misc_feature (1)..(128): Pfam Name: TPT Pfam Description: Triose-phosphate Transporter family
TILAESLLHGYKFDSINTVYYMAPFATMILSIPAIVLEGSGVVSWLYTYDSVAPALVIIITSGVLAFCLNFSIFYVIHSTTAVTFNVAGNLKVAVAVLVSWMIFRNPISAMNAVGCAITLVGCTFYGYVRHLISQQATAAPGPRTPRGRMEMLPLTGEKQGDKI

SEQ ID NO: 34356 - DNA, 468 bp, Panicum virgatum
  misc_feature: Ceres CLONE 1955968
  misc_feature: Encodes the peptide sequence at SEQ ID NO. 34357
ttccgagcctttctgctcctcccaagtcccaaggcagcgcccactagctagctagccaggaagaagaggccaagaattatccttacctgatcgagatcggccggccgatgacgacgggggaggtggtggcggcggcggcggtgccgcgggtggtctcgatcctgtcggcgctgctgcagcgggtggcggagcgcaacgacgccgcggcggcggaggggacgctggaggcggcgccggaggggcggcggcggccggtgtcggcgttccaggggctcacgaagccggccatctccatcggcgggtacctggagcgcatcttccgcttcgccagttgcagcccgtcctgctacgtcgtcgcctacatctacctcgaccgcttcctgcgccgccggcccgcgctcgccgttgactccttcaacgtccaccgcctcctcatcacctccgtcctcaccgccggcaagttcgtcg

SEQ ID NO: 34357 - protein, 120 aa, Panicum virgatum
  misc_feature: Ceres CLONE 1955968
  misc_feature (13)..(119): Pfam Name: Cyclin Pfam Description: Cyclin
MTTGEVVAAAAVPRVVSILSALLQRVAERNDAAAAEGTLEAAPEGRRRPVSAFQGLTKPAISIGGYLERIFRFASCSPSCYVVAYIYLDRFLRRRPALAVDSFNVHRLLITSVLTAGKFV

SEQ ID NO: 34358 - DNA, 543 bp, Panicum virgatum
  misc_feature: Ceres CLONE 1955968-R
acaacgcctacttcgcgcgggtgggcggcatcagcctggtggagatgaactacctggaggtggacttcctcttcggcatcgctttcgacctcaacgtcacgcccgccgccttcgcctcctactgctccgtgctccagagcgagatggcctacctcgacccgccggcgcccgtggacgccccacggctgcactgttactccgccggcacgtccgatcaccaccacgacgaccccgccgccgccgccacggctgccggctgccaccgtcacagtcagcagcagccgcagctcaccgtctgatccggtcgatggagccgtttctttttttgtcctggtggtgtcaactcggcttcttgcttcgtcttcttcttcctcttcgtcctcctcctcctcttcttcttggtacataggtgttggtcgttcctagtgagccctggggggtagtcggttaggtggattggatcatggggatttttgccatgttcgacggatcgtgggatcaatgaaatggatggatcgggttgggatccgattcgatttggcc

SEQ ID NO: 34359 - DNA, 758 bp, Panicum virgatum
  misc_feature: Ceres CLONE 1955971
  misc_feature: Encodes the peptide sequence at SEQ ID NO. 34360
actcgtctcggaaaaccctagccgccacacctcacgacccacccgagcaccagcggagggaaggggagatggcgcgcggcgtggtggcggccaagagcggcgcggccgcgggcaagaagaaggggtcggtcaccttcacgatcgactgcaccaagcccgtcgaggacaagatcatggagatcgcctcgctcgagaagttcctgcaggagcgcatcaaggtcgccggcggcaaggccgggagcctcggcgactccgtcagcgtctcccgcgagaagaccaaggtctccgtcacctccgacgggcccttctccaagaggtacctgaaatacttgaccaagaagtacttgaagaagcataacgtgcgggattggctgcgtgtgattgcagccaacaaggaccgcagcgtctatgagctccggtatttcaacattgccgagaatgagggcgaggaggaagattagagtgcactccacttatatcttagttttgaacttgttgaattttgatacttgtacctgtagtcatttgcacctatcttcacatgttatgctgtggtgaactttggatggttaatttgaagaatccttacatttggtcgcctcaacttctgagtgcctgcctactcttggtccatgcaaatttaagttgtcaactgagaaatgtctcaacttctcgcttgtactctggttgacgcctaagttgatacagtttatattgctctggtgtggaaattaccagcggtacttattctgcttgcc

SEQ ID NO: 34360 - protein, 130 aa, Panicum virgatum
  misc_feature: Ceres CLONE 1955971
  misc_feature (16)..(130): Pfam Name: Ribosomal_L22e Pfam Description: Ribosomal L22e protein family
MARGVVAAKSGAAAGKKKGSVTFTIDCTKPVEDKIMEIASLEKFLQERIKVAGGKAGSLGDSVSVSREKTKVSVTSDGPFSKRYLKYLTKKYLKKHNVRDWLRVIAANKDRSVYELRYFNIAENEGEEED

SEQ ID NO: 34361 - DNA, 772 bp, Panicum virgatum
  misc_feature: Ceres CLONE 1955972
  misc_feature: Encodes the peptide sequence at SEQ ID NO. 34362
cctttctcccccacactcgcctgcacccaccgatcgatcgagaggaaaacaatggcgatggcggcggcgaggagagccctcctaacccacctccgcatcccggtagcgcgtcccgctgcagcggcggcggcggcagcggcgggaaccgtccccgtcgctgcccggaggctcctgtcctcgactacggaggagacgaaggggtcgttcctggacaagggcgaggtcgccgaccgcgtcgtctcggtcgtcaagaacttccagaaggttgagcccgcaaaggtgacacctactgctcatttccagaaggaccttgggctcgatagcttggacactgttgagatagtgatggcgttcgaggaagaattcggattcgagatccctgataacgagacagagaagattgactccatcaagtcggcggttgacttcatcgcctcacatccacaagcaaaatgagagcatttcttgttttcctatttcagcacgctttccgatccagaactttgtgcagacagggaaacaattttctgtagcttgccccagtgggtgcatggcctgaagccgttctgcctgcacctgcagatggataggaagccagttctttctcgttctcgatcatgttgaaataaaccgtgtaccaattggttgtcgtggttttgtgaccccgtttgcagggtgttggaacaccttttgcggccaaacttgtgtacaaggcgcgtggaagtcctcagcagcgcattaatcaatagatgtattcggatgtgttttttcc

SEQ ID NO: 34362 - protein, 134 aa, Panicum virgatum
  misc_feature: Ceres CLONE 1955972
  misc_feature (60)..(127): Pfam Name: PP-binding Pfam Description: Phosphopantetheine attachment site
  misc_feature: SWISSPROT Homolog: EC 2.7.1.6 Galactokinase
MAMAAARRALLTHLRIPVARPAAAAAAAAAGTVPVAARRLLSSTTEETKGSFLDKGEVADRVVSVVKNFQKVEPAKVTPTAHFQKDLGLDSLDTVEIVMAFEEEFGFEIPDNETEKIDSIKSAVDFIASHPQAK

SEQ ID NO: 34363 - DNA, 811 bp, Panicum virgatum
  misc_feature: Ceres CLONE 1955979
  misc_feature: Encodes the peptide sequence at SEQ ID NO. 34364
tccccaccccggcgacgcggctgccccgagaccgagcaaccccactgcgagggagaggaggagcagaggagtagcgagagcaagaagatgtcgtcggcgttcagcggcgatgagacggcccccttcttcggcttcctcggcgccgccgccgccctcatcttctcatgcatgggcgcggcgtacgggacggcgaagagcggcgtgggcgtggcgtccatgggcgtgatgcggccggagctcgtgatgaagtccatcgtgcccgtcgtcatggctggtgtgctcggtatctacggcctcatcatcgccgtcatcatcagtaccgggatcaaccccaaggccaagccctactacctcttcgatgggtacgcccacctctcctccgggcttgcttgtggcctcgctgggcttgccgctggcatggccattggcatcgtcggtgatgctggtgtcagggcaaatgcacaacagccgaagctctttgtgggcatgattctcattctcattttcgcagaagcgctcgctctctatggtctcattgtgggcatcatcctctcatcccgtgccggccaatcccgtgcggattaggcgcttgctgctaccattctatattactgctgtgtttattatatgctgttttgagagaaacttgaactcgaggttcttgtctagtttattcatgttaccatgtatcaatgaaacagttgtagctgaaggaaggtggcacttccagtcatgttcgatttggtggtgtcaagaggttaagtggatttaattttatccatggtgaataaagaacacgggaattgtagcc

SEQ ID NO: 34364 - protein, 165 aa, Panicum virgatum; identical to SEQ ID NO: 10269
  misc_feature: Ceres CLONE 1955979
  misc_feature (93)..(158): Pfam Name: ATP-synt_C Pfam Description: ATP synthase subunit C
  misc_feature (14)..(79): Pfam Name: ATP-synt_C Pfam Description: ATP synthase subunit C
  misc_feature: SWISSPROT Homolog: EC 3.6.3.14 H(+)-transporting two-sector ATPase

SEQ ID NO: 34365 - DNA, 1023 bp, Panicum virgatum
  misc_feature: Ceres CLONE 1955990
  misc_feature: Encodes the peptide sequence at SEQ ID NO. 34366
acctcctgatcggcgccaacttcgcgtccgcagggtccggctactacgaccacacggcactcatgtatcacgcgatcccgctgtcccagcagctggagtacttcaaggagtaccagtcgaagctggcggcggtggccggcgccggccaggcccggtccatcgtcaccggcgcgctgtacatcatcagcgccggcgccagcgacttcgtccagaactactacatcaaccccctgctcttcaagacccagaccgccgaccagttctccgaccgccttgtcgccatcttcagcaacactgtctcgcaactctacggcatgggggcgcggcgcatcggcgtgacgtcgctgccgccgctggggtgcctaccggcgtcgatcacgctgttcgggcacggcggcggcgggtgcgtggcgaggctcaacggcgacgcccagagcttcaaccggaagatgaacgccaccgtggtcgcgctgtcgagccggtacccggacctcaagatcgccgtgttcgacatctacacgccgctctacgacctggccacgaacccgcaggcgcagggcttcacggaggcgcggcgcgggtgctgcgggacggggacggtggagacgacggtgctcctctgcaaccccaagtcggtggggacgtgccccaacgccacgtcctacgtgttctgggacgccgtccacccgtcggaggcggccaaccaagtcatcgccgactcgctcatcaccgagggcctcatcctcgtcacgtaataaaccactcggctcggtcggtcaccggctggagctgctactgctgcacctgtttgtgtgcagggcagtgtccttggatgaaacaggctacaagctacatcattgtgcgcatcctgagagaaaataacacaaaagttatcactaggtgtctctagattctgaagattctgtaaaattactcttctcttaaaaaaaaattaccgaatgatgttaatgtctcaggaaacttctactgtataagccacatcaaaatgaagcctttttgttt

SEQ ID NO: 34366 - protein, 250 aa, Panicum virgatum
  misc_feature: Ceres CLONE 1955990
  misc_feature (1)..(241): Pfam Name: Lipase_GDSL Pfam Description: GDSL-like Lipase/Acylhydrolase
  misc_feature: SWISSPROT Homolog: EC 3.2.1.51 Alpha-L-fucosidase
LLIGANFASAGSGYYDHTALMYHAIPLSQQLEYFKEYQSKLAAVAGAGQARSIVTGALYIISAGASDFVQNYYINPLLFKTQTADQFSDRLVAIFSNTVSQLYGMGARRIGVTSLPPLGCLPASITLFGHGGGGCVARLNGDAQSFNRKMNATVVALSSRYPDLKIAVFDIYTPLYDLATNPQAQGFTEARRGCCGTGTVETTVLLCNPKSVGTCPNATSYVFWDAVHPSEAANQVIADSLITEGLILVT

SEQ ID NO: 34367 - DNA, 753 bp, Panicum virgatum
  misc_feature: Ceres CLONE 1955995
  misc_feature: Encodes the peptide sequence at SEQ ID NO. 34368
actcgcgccgctttcctcccttcccgcgccgccgccgccggaagcacccaaccgccgtcgcccgagtcaacaccccaaagcagccatggggcgtatgcacagccgcgggaagggtatctcgtcgtcggcgcttccgtacaagaggaccccgccgacctggctcaagactgccacctctgatgtggaggagatgatcacgaaggcggcgaagaagggtcagatgccgtcgcagatcggcgtcctgctccgtgaccagcacggtatcccccttgttaagagcgtcaccggcagcaagatcctccgcatcctcaaggcccatggtctggcaccagaaatcccggaggacctgtactttctcatcaagaaggcggtggcaattaggaagcatctggagaggaacaggaaggacaaggactccaaattcaggcttattcttgtggagagcaggatccaccgccttgctcgctactacaagcgcaccaagaagctcccgcccacctggaagtatgagtccaccaccgcaagcactctggtggcctaagtgaggagctcagcatcagagacactcccagcggcttgaagctggccctattcttgggatatcgctttataagtttagagcctactagaaatcgtgaatctcctgtggaggatggtgtaaaaccctttttggttccgcagatctgcctgttgttgacttttgctactctgcatccagattttgcagctacattgatcatttacattacatgc

SEQ ID NO: 34368 - protein, 151 aa, Panicum virgatum
  misc_feature: Ceres CLONE 1955995
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15
  misc_feature: Functional homolog of the protein sequence given in SEQ ID NO 50384
  misc_feature: Useful for making plants with modulated nitrogen use efficiency
MGRMHSRGKGISSSALPYKRTPPTWLKTATSDVEEMITKAAKKGQMPSQIGVLLRDQHGIPLVKSVTGSKILRILKAHGLAPEIPEDLYFLIKKAVAIRKHLERNRKDKDSKFRLILVESRIHRLARYYKRTKKLPPTWKYESTTASTLVA

SEQ ID NO: 34369 - DNA, 685 bp, Panicum virgatum
  misc_feature: Ceres CLONE 1955996
  misc_feature: Encodes the peptide sequence at SEQ ID NO. 34370
ttgaaaagagctatgagctacctgatggtcaagtaatcaccattggtgcagagagattcaggtgccctgaggtcctcttccagccatccatgattggtatggaggctgctggaatccatgagacgacctacaattcaatcatgaagtgcgatgtggatatcaggaaggacctgtatggcaacattgtgctcagtggaggttcaaccatgttcccgggcattgctgatcgtatgagcaaggagatcactgcccttgctccgagcagcatgaagattaaggttgttgcaccacctgagcggaagtacagtgtctggatcggagggtcgatcctagcctcactcagcactttccaacagatgtggatatcaaaggaggagtacgacgagtctggcccagcaattgttcataggaagtgcttctaagtttctcaagtgctgcttcactgtcatctagtcgtgtctggttcaattctctagaaatgtgttgcagatttgttgcatactatgtctattttcttcagagttcagaccatgagtcttctctggaataggacccccttgtatgctgtggcttcatgtgctgtgttgtatcacctggtttgagatgagttttcaaacttgcttggcttgattagttggagctgtaagctgatagttctataaattacttgggatatgcttctgct

SEQ ID NO: 34370 - protein, 139 aa, Panicum virgatum
  misc_feature: Ceres CLONE 1955996
  misc_feature (1)..(139): Pfam Name: Actin Pfam Description: Actin
  misc_feature: Functional homolog of the protein sequence given in SEQ ID NO 50712
  misc_feature: Useful for making plants with modulated biomass
  misc_feature: Functional homolog of the protein sequence given in SEQ ID NO 50711
  misc_feature: Useful for making plants with modulated flowering time
EKSYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWISKEEYDESGPAIVHRKCF

SEQ ID NO: 34371 - DNA, 501 bp, Panicum virgatum
  misc_feature: Ceres CLONE 1955997
  misc_feature: Encodes the peptide sequence at SEQ ID NO. 34372
atcacaaagcgaagtcagagaaggttagggtttactagttgcgaccgccgccgccaccgccaccatgggacactccaacgtgtggaactcgcacccgaagaactatggccctggatccagggtttgccgtgtgtgcgccaacccccacggcctgatccggaagtacgggctcatgtgctgcaggcagtgcttccgcagcaacgccaaggacatcggattcatcaagtaccgctaaaaacttgagaggtccgaagcatcacgagaatgggagcatggatgaggagcatcttctgcccgtcttttgctaagtactgtgataatcataacatgtaatgaattatttgggtttgaaatggaccaaatcgtattctggctggcactctagtgcaccctagttgagcatgttgaaccgctattatcagactaataaaatattgttactattgaggctgtattggagtaactcgtctgagaggttcatgccattttattgccgctgcg

SEQ ID NO: 34372 - protein, 56 aa, Panicum virgatum; identical to SEQ ID NO: 9888
  misc_feature: Ceres CLONE 1955997
  misc_feature (3)..(56): Pfam Name: Ribosomal_S14 Pfam Description: Ribosomal protein S14p/S29e
  misc_feature: Functional homolog of the protein sequence given in SEQ ID NO 50136
  misc_feature: Useful for making plants with modulated nitrogen use efficiency

SEQ ID NO: 34373 - DNA, 985 bp, Panicum virgatum
  misc_feature: Ceres CLONE 1956001
  misc_feature: Encodes the peptide sequence at SEQ ID NO. 34374
attgctatattctacggatcattagctgccataccattcggtacaatggtggttgtttttatcctgtgggccttcatctctttccctcttgctcttttggggaccgttgttggtagaaactggagtggcgccccaaacaatccgtgcagagtaaagactatccctcgtcctattcctgagaagaaatggtacctcacaccatctgtcattgcacttatgggaggactgcttcctttcggtagtatcttcattgagatgtactttgtcttcacatcgttttggaactataaggtgtactatgtttatgggttcatgttgctggtctttctgatcctcataattgtaaccatctgtgtaacaattgttggtacatatttcttgctaaacgctgagaactaccactggcagtggacttcattcttctctgctgcttccactgctgtttatgtttacctgtactccatatattattaccacatgaagaccaagatgtcaggcttctttcagacgagcttctacttcggctacacccaaatgttctgcttaggtttaggaacactatgtggtgccgtaggatatcttggatcaacattgttcgtgaggaggatctaccggaatataaagtgtgactaaatgaagaaatgtcaagccaatcctgaggagtgggggaggaaactgcataccagagccttgtttctttgaggaccattcattcatctatctgccaccaagaagcagggcgtgttttttgtggaatatgattttttgggacgagctgcaagcccttcacttgtcctctttgtttctctttgatctcgcttggggcgataaattttcatgttagttatatagcagcgattgtagttgttgagtaggagctctagtatatatcacaattgttatccttgaacccatgtgaacctttattgatgggtataaactgtaacatccacgttacctgatgtatgatgataaacacaattcc

SEQ ID NO: 34374 - protein, 210 aa, Panicum virgatum
  misc_feature: Ceres CLONE 1956001
  misc_feature (1)..(168): Pfam Name: EMP70 Pfam Description: Endomembrane protein 70
IAIFYGSLAAIPFGTMVVVFILWAFISFPLALLGTVVGRNWSGAPNNPCRVKTIPRPIPEKKWYLTPSVIALMGGLLPFGSIFIEMYFVFTSFWNYKVYYVYGFMLLVFLILIIVTICVTIVGTYFLLNAENYHWQWTSFFSAASTAVYVYLYSIYYYHMKTKMSGFFQTSFYFGYTQMFCLGLGTLCGAVGYLGSTLFVRRIYRNIKCD

SEQ ID NO: 34375 - DNA, 553 bp, Panicum virgatum
  misc_feature: Ceres CLONE 1956003
  misc_feature: Encodes the peptide sequence at SEQ ID NO. 34376
aagctcgattgccgcagcgctatataaccgtcactctccctctcgcttccgtcccactgctcgagcgagctccagctctcaagaaagcacgcgggatcatggcgcctctccttcgcccgctcgtcctcgcgctcctggtcgcgtcctgcgccgcgcagcaggcgccgccggcgcagcccccgcagatgccgaacgccccgccgcaggcgcctccggctccccaggcgcctccagcagggaacccaccgccggctccccaggcacctccggccggcaacccgcctcccgcacccaccacccctcctccggctccgaccacgccgcccccggctccgaccacccctcctccggcacccaccacgccgccccccgccccggtgactcccccgccagcccccaccacgccgccgccgtcgccgccggcctctcccccgcccgctcccaccaccccgccgccgtctcccccggcgaccccgccacccgctcccgccaccccgcccccgtccccgcccatggcgccgcctccggccacgcctcctccccccgccacccc

SEQ ID NO: 34376 - protein, 151 aa, Panicum virgatum
  misc_feature: Ceres CLONE 1956003
  misc_feature: Functional homolog of the protein sequence given in SEQ ID NO 51459
  misc_feature: Useful for making plants with altered cell wall content and/or composition
  misc_feature: Functional homolog of the protein sequence given in SEQ ID NO 50275
  misc_feature: Useful for making plants with altered carbohydrate content
MAPLLRPLVLALLVASCAAQQAPPAQPPQMPNAPPQAPPAPQAPPAGNPPPAPQAPPAGNPPPAPTTPPPAPTTPPPAPTTPPPAPTTPPPAPVTPPPAPTTPPPSPPASPPPAPTTPPPSPPATPPPAPATPPPSPPMAPPPATPPPPAT

SEQ ID NO: 34377 - DNA, 385 bp, Panicum virgatum
  misc_feature: Ceres CLONE 1956003-R
cggcagcgtccccgaagaaccccaagacccagagccccaccgccgcgacgtccccggcacccgcgctctcgcccattggcacgccgccgaccgaagactcggttgcaagcgcacgcgcggccggcttcggcacggtcgtggcgttggcgggcgcgggcctcgccctcctgctttgagtagtagatctcctcctcctcctccgatcctgtcgatgttgccatccctccccggctccccgtgcgtcgacgacgacgctgctcctccgtctccatttcatctctctttttttctttctttttctaccgtgttgttatttaattttaccggcatgctcggaccgaccgaatcaggaggaacgaagaggacgaaggggacgcatggggtt

SEQ ID NO: 34378 - DNA, 796 bp, Panicum virgatum
  misc_feature: Ceres CLONE 1956005
  misc_feature: Encodes the peptide sequence at SEQ ID NO. 34379
attctttccaaaccctagagccgccgccgctgccgccgcctgctgccccgccgctcctcgcctcccctgcagcttatcctcctcattcctcaaccagccgcagccatggcggacgtcgacgtcgatgcggaggtcgccgctgcaggacagcccaagaagaggacgttccgcaagtacagctaccgcggcgtggacctcgacgcgcttctcgacatgtccaccgacgacctcgtccagcttttccctgcccgcgcccgcagaaggttccagaggggtctgaagaggaagccgatggctctgatcaagaggttgcgcaaggcgaaaaaggaggcgcctgctggtgagaagcccgagcctgtcaggacccatctgcgcaacatgatcattgtgccagagatgataggctccataattggagtgtacaatgggaagaccttcaaccaggtcgagatcaagcctgagatgattgggcactaccttgctgaattctccatcagctacaagcccgtcaagcacggaaggcccggtattggtgccacccactcctccaggtttatcccactcaagtgagggatcccagggcatgctcatgtccaggccaaagttatctgggcctgctgttatcttttatcggataagactttgctccttagcacttagtgaggaaagtttgcccagcaatggattctagtttttcagtggaattttagaacctcagagctacttctgttttcaaattgaaactggagatcttgtgtctatggtgcaattcccctccccgttgtctttctgcgtc

SEQ ID NO: 34379 - protein, 154 aa, Panicum virgatum
  misc_feature: Ceres CLONE 1956005
  misc_feature (56)..(137): Pfam Name: Ribosomal_S19 Pfam Description: Ribosomal protein S19
MADVDVDAEVAAAGQPKKRTFRKYSYRGVDLDALLDMSTDDLVQLFPARARRRFQRGLKRKPMALIKRLRKAKKEAPAGEKPEPVRTHLRNMIIVPEMIGSIIGVYNGKTFNQVEIKPEMIGHYLAEFSISYKPVKHGRPGIGATHSSRFIPLK

SEQ ID NO: 34380 - DNA, 958 bp, Panicum virgatum
  misc_feature: Ceres CLONE 1956006
  misc_feature: Encodes the peptide sequence at SEQ ID NO. 34381
agaccctccttctcggtcccccctcgcgagccgcggaaatggcgttgccgaatcagcaggtcgtggattacccaagcttcaagctcgtcatcgtcggcgacggtggaactggtaaaacaacatttgtcaaaaggcatcttactggcgagtttgagaagaaatatgaacccaccattggtgttgaagttcaccctctagattttagcaccaactgtggcaaaatccgcttctattgctgggacactgctgggcaagaaaagtttggtggtctcagagatggctactatatccatggtcagtgtgccatcatcatgtttgatgtcacttcaagactgacatacaagaatgtaccaacatggcacagggacttgtgcagggtttgtgagaacattcccatcgtcctctgtggtaacaaggttgatgtgaagaacaggcaggtcaaagccaagcaagttacattccacaggaagaagaacctgcagtactatgaaatttctgcaaagagcaattacaatttcgagaagcccttcctttaccttgcaaggaagctggcaggggaccagaaccttcactttgtcgaggctgttgctctgaaaccaccggaagtgcagcttgatatggccatgcagcaacagcatgaagctgagcttgcggctgctgcggcacaacccctgcctgacgacgatgatgacttgatcgagtagataatatcatggcccttgttgatgcgagaggaaggacttcactataaaaggccgtagtggctcatccttaggaacctggatgttttcttgttatgtgtctgatgagttgagaacgagttatgacatttctggatttgttggtgactgaacccagctcctttcgagcaatacagtgcttgtcatatgcttgcgcgtgatttgtgccttgctgtttatactatgataatagtttaattgctcttctgagctgtgcc

SEQ ID NO: 34381 - protein, 221 aa, Panicum virgatum; identical to SEQ ID NO: 18822
  misc_feature: Ceres CLONE 1956006
  misc_feature (15)..(173): Pfam Name: Ras Pfam Description: Ras family
  misc_feature (15)..(128): Pfam Name: Miro Pfam Description: Miro-like protein
  misc_feature: SWISSPROT Homolog: EC 2.7.11.1 Non-specific serine/threonine protein kinase

SEQ ID NO: 34382 - DNA, 770 bp, Panicum virgatum
  misc_feature: Ceres CLONE 1956008
  misc_feature: Encodes the peptide sequence at SEQ ID NO. 34383
acccgctccccgcccagcaaaaccctagccgccgccgcagcggcatcccaggtaaggaagaaggagcgttccccgccgccgccgccatgaagcggaacccccgcgtcacgagctcccgccggaagtgccgcaaggcgcacttcacggccccgtcctccgtccgccgcgtgctcatgtccgcggcgctgtcgacggagctccgccacaagtacaatgtgcgctccatcccgatccgcaaggacgacgaggtgcaggttgtgcgcggcaccttcaagggccgtgagggcaaggtggtgcaggtgtaccgccgccgctgggtcatccacgtcgagcggatcacccgcgagaaggtgaacggctccaccgtcaacgtgggcatccacccctccaaggttgtcgtcaccaagctgaagctcgacaaggaccgcaaggccctcctcgaccgcaaggcacgcggccgcgccgccgacaaggccaagggcaagttcaccgccgacgacgtcgccgctgctgctggcggtgccgccgccaccggtgcctccctccaggagatcgactaggcgctgcgcggcggggatctgatggcggtcgtgccgcctttcccttcctatcgctcgctctagttttgctaccaatgattatgtgctaggagtttatgttacttgaaaactgctgctttaatatccttgaaatgccttggtgagagttttggaacctaatgttgatctgtgtctgagatttgaaatatgaagtactcgttatatggtttc

SEQ ID NO: 34383 - protein, 157 aa, Panicum virgatum
  misc_feature: Ceres CLONE 1956008
  misc_feature (51)..(82): Pfam Name: KOW Pfam Description: KOW motif
  misc_feature: Functional homolog of the protein sequence given in SEQ ID NO 51460
  misc_feature: Useful for making plants with modulated biomass
MKRNPRVTSSRRKCRKAHFTAPSSVRRVLMSAALSTELRHKYNVRSIPIRKDDEVQVVRGTFKGREGKVVQVYRRRWVIHVERITREKVNGSTVNVGIHPSKVVVTKLKLDKDRKALLDRKARGRAADKAKGKFTADDVAAAAGGAAATGASLQEID

SEQ ID NO: 34384 - DNA, 1001 bp, Panicum virgatum
  misc_feature: Ceres CLONE 1956018
  misc_feature: Encodes the peptide sequence at SEQ ID NO. 34385
ccgaccaacgtcggagtcttctcccctctccctccctccccttcccttgtcttgcgttgcccgcaatcgaaagcagatcaaaccctagatctcgtctcgccgccccgatccgaatcccatggattcgtcgtcgtcgtcgtcctccagcctgagccagcagcccgagttcgactacctcttcaagctgcttcttatcggcgactccggcgtcggcaagagcagtctcctcctacgcttcaccgccgactccttcgaggacctctcccccaccataggtgttgacttcaaggtgaagatggttaacattggtggcaagaaactcaagcttgccatctgggacacagctggacaggagagatttaggaccttaaccagctcatactacagaggggcacagggaatcattatggtgtatgatgtcactcgacgagaaacatttaccaatctttctgatatatgggcaaaggaaattgacctgtattcaaccaaccaggattgtataaagatgcttgttggaaacaaagtagacaaggaaagtgaaagggctgtcacaaaaaaagaaggaatcgaatttgctcgggaatacggatgtttatttctggaatgcagtgcgaaaacaaaagtaaatgtagaacagtgctttgaggaactcgtcctaaagatattagacacgccaagcctcctagctgatgcttcgtcaggggccaagaagaacattttcaaacagaagccaccggaagctgatgcagcggcaagcagctgctgttaacttgcgtgctaatccaggtcggatccctcctgggggtgatgatatctttgttgcataaagtgataagctctgttgtgttgatttattttgcttatggtcctgtatattgccatgctaaaattagaccccacatgcataacactacgttggcagcagatatataatgtattaagttaaatctacctgacaatacgaattgtttacaactgtgatctggagtacatcgtagttt

SEQ ID NO: 34385 - protein, 216 aa, Panicum virgatum
  misc_feature: Ceres CLONE 1956018
  misc_feature (22)..(184): Pfam Name: Ras Pfam Description: Ras family
  misc_feature (22)..(137): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 51457
  misc_feature: Useful for making plants with altered lignin content
MDSSSSSSSSLSQQPEFDYLFKLLLIGDSGVGKSSLLLRFTADSFEDLSPTIGVDFKVKMVNIGGKKLKLAIWDTAGQERFRTLTSSYYRGAQGIIMVYDVTRRETFTNLSDIWAKEIDLYSTNQDCIKMLVGNKVDKESERAVTKKEGIEFAREYGCLFLECSAKTKVNVEQCFEELVLKILDTPSLLADASSGAKKNIFKQKPPEADAAASSCC

SEQ ID NO: 34386 - DNA, 750 bp, Panicum virgatum
  misc_feature: Ceres CLONE 1956021
  misc_feature: Encodes the peptide sequence at SEQ ID NO. 34387
acacaaaaatttccgctacgtctcccccattaacttttggcatcaccacttctgacgcagttgacgacacatttaaccgcaacaatgggtcgccttcaggaatacgaggtcatcgggcgccacctgcccaccgaggccaacccttcgcccgccctctaccgcatgaccatcttcgcccccaacgagacggtcgccaagtcccgcttctggtacttcctccgcggcctgaagaaggtcaagaaggccacgggcgagatcgtcggcgtcaaggccatccacgagaagcacccccagaaggtcaagaactttggcgtctggatccgctacgactcgcgctcgggaacgcacaacatgtacaaggagtaccgtgagctctcccggaccgatgcggctgaggcgctatactccgacatggccgcccgccaccgcgcccgattcaggtccatccacatcctccgcatcgtcgagctcgagaagaccgaggacgtcaagcgcccctacatcggccagctcctgaccaaggacctcagcttccccctcccccaccgcgtcggcaaggtcagcaccagcaagatcttctccgccaagcgaccttccacgttcgcttagatttgacattttttttcgggacaacctcttgaaatgaaaggaaaaggggtttgcggggcgagtagggaatctttacggctttttgcgggtgttactacggtttatggaaatatcaactgcatcccctggcctgttctaaac

SEQ ID NO: 34387 - protein, 174 aa, Panicum virgatum
  misc_feature: Ceres CLONE 1956021
  misc_feature (3)..(174): Pfam Name: Ribosomal_L18ae Pfam Description: Ribosomal L18ae protein family
MGRLQEYEVIGRHLPTEANPSPALYRMTIFAPNETVAKSRFWYFLRGLKKVKKATGEIVGVKAIHEKHPQKVKNFGVWIRYDSRSGTHNMYKEYRELSRTDAAEALYSDMAARHRARFRSIHILRIVELEKTEDVKRPYIGQLLTKDLSFPLPHRVGKVSTSKIFSAKRPSTFA

SEQ ID NO: 34388 - DNA, 794 bp, Panicum virgatum
  misc_feature: Ceres CLONE 1956029
  misc_feature: Encodes the peptide sequence at SEQ ID NO. 34389
gtcatcgtccttcagttcttccaacctctgaatctctctgcatctgtgtgatcgaggaagaaaggaggagccaacaaacatggtgcacgggaagctggaggttctccttgtctccgccaagggccttgaggacaccgatttcctcaataacatggacccctacgtgatccttacatgccgcacccaggagcagaaaagcagcgttgcaaatggtacttgccttttatcattcacgagaatacccccgtctctccattgtgtatctgctactgctagagggcatcacttgatgtatatgcagtgatgcggaagtgaactcgatgccaatctgatcgccaatcttacgctcgctcattcaggagaaggaagtgaacctgaatggaacgaaaccttcatcttcacggtctctgacgataccccgcagcttaatctcaagatcatggacagcgacgtcaccaacgatgatttcgttggtgaagcaagcatccccctggaggctgtgtttcaggaaggcagccttcccccgacagttcacccagtcgtcaaggaggagaaatactgcggagagatcaagcttgcactcaccttcactccagcagtggaaactcgccgcccggacaacgaggagggtacttacagcagctggaattgatctgcccgatgtgtgcactgagcaataacataatttactgaagaattactgctgttatgcaacactattttgctttgtcatgaactgaatatttgcatgtaacttccagcattgtgataactattcagaattgttgctttgc

SEQ ID NO: 34389 - protein, 70 aa, Panicum virgatum
  misc_feature: Ceres CLONE 1956029
  misc_feature: Functional homolog of the protein sequence given in SEQ ID NO 50618
  misc_feature: Useful for making plants with modulated nitrogen use efficiency
MDSDVTNDDFVGEASIPLEAVFQEGSLPPTVHPVVKEEKYCGEIKLALTFTPAVETRRPDNEEGTYSSWN

SEQ ID NO: 34390 - DNA, 840 bp, Panicum virgatum
  misc_feature: Ceres CLONE 1956043
  misc_feature: Encodes the peptide sequence at SEQ ID NO. 34391
actctgcggcggcggcggctgctgctgctgctgcatctgcttccccacttctccgccggatcgctgcaagattctcgggcatgtcggactctgaggagcatcacttcgagtccaaggccgacgccggcgcctccaagacctacccgcagcaggccggcaccatccgcaagaacggatacatcgtcatcaagaaccgcccctgcaaggttgttgaggtctccacttccaagactgggaagcatggtcatgccaagtgccactttgtcggcattgacattttcaatggaaagaagctagaggatattgttccttcatctcacaattgcgacgttccacatgtttcccgcactgagtatcagctgattgatatttctgaagacggatacgttagccttttgacggagagtggcaacactaaggatgacctgaagcttcccactgatgaaaatctgcaagcccagatcaagagtggatatgatgatggaaaggacattatcctgactgtgatgtccgccatgggtgaggaacagatctgtgctctgaaggaaattgggggaaagaactaagctgctgcgttactcctgttgttcgcctgcgatgcttgcggtctgttgctgagtgtggagaagcttagttgagttacatacatagacataggcatttgagttgatgtgtggttttattttttgaaaaaaatgtgtagttttatttcatccccggttaagctctagaattcttttgaactgagtggatggtgtaactctggtttacttatcaatgggaattgcgatatagtttatagattggttggattattcaattcaattcagatttgccccc

SEQ ID NO: 34391 - protein, 161 aa, Panicum virgatum
  misc_feature: Ceres CLONE 1956043
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADAGASKTYPQQAGTIRKNGYIVIKNRPCKVVEVSTSKTGKHGHAKCHFVGIDIFNGKKLEDIVPSSHNCDVPHVSRTEYQLIDISEDGYVSLLTESGNTKDDLKLPTDENLQAQIKSGYDDGKDIILTVMSAMGEEQICALKEIGGKN

SEQ ID NO: 34392 - DNA, 602 bp, Panicum virgatum
  misc_feature: Ceres CLONE 1956059
  misc_feature: Encodes the peptide sequence at SEQ ID NO. 34393
actgccgctgctgctgctggctcctctcctggtcatggccgccgaccccgaccctctccaggacttctgcgtcgccgacctcatgggctcgccgtcggtgcaaggccacccgtgcctgccgccctcggcgaggggcgaggacttcctcttctcgacctttatcgcctcggggggcgacccgctggcgaacccgaacggctccaacgtgacggagctcgacgtgtgcgagtggcccggcgtgaacacgctcagggtgtccatgaaccgcgtctacttcgcgccgggcgggaccaacccgccgcacatccgcccgcgcgccaccgatgtcgggatggtgacccgcggcgagctcctcgcgggcgtcgtcggtggcctcgactccgggaaccggcactactcgaaggcggtgcgcggcggcgagaccttcgtcatcccgcgcgggctcctgctcttccagttcttcgtcggcgaggaggcggcctccgtggtggtgtcggttcacgaccgtagccccggcctcgtcttcgggccgctgacgctgttcgggtcctcgccgccgatcccgacgccggtgctcgtcaaggcgctccgggtggacgccg

SEQ ID NO: 34393 - protein, 200 aa, Panicum virgatum
  misc_feature: Ceres CLONE 1956059
  misc_feature (53)..(199): Pfam Name: Cupin_1 Pfam Description: Cupin
  misc_feature: SWISSPROT Homolog: EC 1.2.3.4 Oxalate oxidase
LPLLLLAPLLVMAADPDPLQDFCVADLMGSPSVQGHPCLPPSARGEDFLFSTFIASGGDPLANPNGSNVTELDVCEWPGVNTLRVSMNRVYFAPGGTNPPHIRPRATDVGMVTRGELLAGVVGGLDSGNRHYSKAVRGGETFVIPRGLLLFQFFVGEEAASVVVSVHDRSPGLVFGPLTLFGSSPPIPTPVLVKALRVDA

SEQ ID NO: 34394 - DNA, 686 bp, Panicum virgatum
  misc_feature: Ceres CLONE 1956065
  misc_feature: Encodes the peptide sequence at SEQ ID NO. 34395
ctccacctcccgtgcccaacgcccaccttcccacctctgcggcgcagcagcagcagctgaagatggtgaagttcctgaagcccggcaaggccgtgatcctccttcagggtcggttcgccggccggaaggcggtgatcgtgcgcgtgttcgaggagggcacccgcgaccgcccctacgggcactgcctcgtcgccggcctcgccaagtaccccaagaaggtgatccgcaaggactctgccaagaagacggccaagaagtcccgggtcaagtgcttcatcaagctcgtaaacttcacccacatcatgcccacccgctacacacttgacgtcgactttaaggacgtcgcctcgggcgggcccgacgcgctctccacccgggacaagaaggtcgccgcctgcaaggccgcgaagtaccgcctcgaggagaggttcaagacaggcaagaacaggtggttctttaccaagctccgcttctagatgccgggcgtccagcatagtacctgctttagttgtcaatttcatgtgtcagacacccttatctctgttttggtattgccattaagacttcgtgcttatggatcttggagagtatgacatgtcgatgatgtgttaaatgatgtcaatcatagatcttgtccaaattttgttcagaatcattgcttggaatgttctgttctcaaaatttgc

SEQ ID NO: 34395 - protein, 137 aa, Panicum virgatum
  misc_feature: Ceres CLONE 1956065
  misc_feature (52)..(137): Pfam Name: Ribosomal_L27e Pfam Description: Ribosomal L27e protein family
  misc_feature (7)..(40): Pfam Name: KOW Pfam Description: KOW motif
MVKFLKPGKAVILLQGRFAGRKAVIVRVFEEGTRDRPYGHCLVAGLAKYPKKVIRKDSAKKTAKKSRVKCFIKLVNFTHIMPTRYTLDVDFKDVASGGPDALSTRDKKVAACKAAKYRLEERFKTGKNRWFFTKLRF

SEQ ID NO: 34396 - DNA, 990 bp, Panicum virgatum
  misc_feature: Ceres CLONE 1956081
  misc_feature: Encodes the peptide sequence at SEQ ID NO. 34397
acggctaatcacaatcagattgcttgcatccaaatcaggattttgatggcggcgggggtgctctccaaccgcgtcgatcgggaggacctcgccgccggggatcacatctactcatggcgggccgcctacctctacgcccaccacgggatctatgttggggacgggatggtcatccatttcaccagagcagccggccacgagattggcacggggaccttcctggattccttcctgttcagctcctcctcgccggcggcggcaaccacctgccagcgatgtggccacctgccacaaggacgtgagggagtcgtcatgtcctgcctcgactgcttcttgcacggcggcggcggcagcggcggcctctacctcttccactacgccgtctcgccggccttcttcctcgccaaggcgcgcggagggacctgcactctggccgcctccgaccccggccatgtcgtcgtccaccgcgcccgctacctcctggacaaggggggattcggcgcctactccctcttcaagaacaactgcgaggacttcgccatctactgcaagacggggctgctcgtccagaccgcgttcagcgttggccgcagcggccagctcgcatccctcacggccgccttcagcgcggtggcctcgtcgccgctgcgtttcctcaccaccagcgccggcggcctcgcccttgtcaccaccggcatgtactgcgtcggccgatacgtctcggatatcggcgttcgccgggatgtgatcaaggtccctgtccagacccttgttgtgcaggcaactcctactgctatggaggcagaggtcgcagcagcagcaggagcagtcggtgttggagcttcctcgcctgcttgctgagagaccataccacatgtattgggagttccaagctgacgacatctgttgtatcgatttgcactcacttatgcagcagacttcttattatgtctgtctgtctttctgttacacagctgaatctaagaatgg

SEQ ID NO: 34397 - protein, 271 aa, Panicum virgatum
  misc_feature: Ceres CLONE 1956081
  misc_feature (107)..(178): Pfam Name: NC Pfam Description: NC domain
MAAGVLSNRVDREDLAAGDHIYSWRAAYLYAHHGIYVGDGMVIHFTRAAGHEIGTGTFLDSFLFSSSSPAAATTCQRCGHLPQGREGVVMSCLDCFLHGGGGSGGLYLFHYAVSPAFFLAKARGGTCTLAASDPGHVVVHRARYLLDKGGFGAYSLFKNNCEDFAIYCKTGLLVQTAFSVGRSGQLASLTAAFSAVASSPLRFLTTSAGGLALVTTGMYCVGRYVSDIGVRRDVIKVPVQTLVVQATPTAMEAEVAAAAGAVGVGASSPAC

SEQ ID NO: 34398 - DNA, 824 bp, Panicum virgatum
  misc_feature: Ceres CLONE 1956088
  misc_feature: Encodes the peptide sequence at SEQ ID NO. 34399
acgtctcttcctcactaccagtggagtcgatagcgcaccgcaacctgaggcgatggcgtccaccggctggccgtcgcagtcgccgtcgctgcggcagcggacgctgtcgcggccacccacacgcgcattcaccatgccccgccaggacgtcttgtcaggcgaggtcgacggcgccgcgggcgcgcccgaaagcgagctcgtgccctcctcgctcgcgccgatcgtccccatgctccgcgccgccgacgagctcgaggaggagaatccacgcgtcgcctatctctgtcgatttgctgcattcgagaaggctcacaatatggatccaaactcaagtggacgtggagttcggcaattcaaaacatacatgttgcataagctagaaaaggtatgctggtggttagatgatgccaaagctttaactaagtagtatcaactggggaagcaggggattattttgacactgctatcatgataaacttgacaagttatacaaattggataattggtcgggttgttcaacctgttcaaattattccacctagtacgttacctgcagagagtgtttgattgaactacaaagattttttttcccttttcttcgcaaatcccaactgggtaagtgttacagtatcttcagaggagtaagaacaggctattgcaatgtttgcgccagagcagagtacacaattcttggtattccacaccaggcatttacttgttcgtgttgaaaccaattatattacttatccagtagtttatgggagagtttcatgatcggacaagttttgtattaattgcatcttcttaaaagaatatatattttg

SEQ ID NO: 34399 - protein, 124 aa, Panicum virgatum
  misc_feature: Ceres CLONE 1956088
  misc_feature: Functional homolog of the protein sequence given in SEQ ID NO 51461
  misc_feature: Useful for making plants with altered cell wall content and/or composition
MASTGWPSQSPSLRQRTLSRPPTRAFTMPRQDVLSGEVDGAAGAPESELVPSSLAPIVPMLRAADELEEENPRVAYLCRFAAFEKAHNMDPNSSGRGVRQFKTYMLHKLEKVCWWLDDAKALTK

SEQ ID NO: 34400 - DNA, 914 bp, Panicum virgatum
  misc_feature: Ceres CLONE 1956105
  misc_feature: Encodes the peptide sequence at SEQ ID NO. 34401
atcacaaccgacctccgatccacttctgctcaccagacactgctaagctagctagctgctttacacttcactcactagtcactagcagcttgatcattccacgatcagtgagtgttatcatatatcagtcgtagctgcaatattatatatagaattttatatatggctcgcctctccgccgttgtcgccgtcgtcctggtggctgcgctggtggcggccgagaccgcttcggctgcggttagctgcagccaggtgacgtcggccgtggcgccgtgcctggggtacgccatgggcagctcggcgtcgccctcgtcggcgtgctgcaacggggtgaggtcgctcaacagccgggcgtcgtcgacggcggacaggcaggcggcgtgcgcctgcctcaagaacatggcggggaggctgggtggcaacatgggcaacgccgccgccagcatcccaagcaagtgcagcgtcaacgtcggcgtgccaatcagcccaaacgtcgactgcgccaagtaacaaactctaatcatcactggacctggactagtacttattagcgtacttgtcgttaaccatatgcactaattacctgctcttcatatatattgtgcaggattaactgataagatgctaaggatggatgctcagctctttccttctctttgggtatgatgtcggccaacagagcagagagcagtcgtttaatttactacctcttccttttacatttgtacaacaccacgcaccacctgtgtacgtcgtcgtgtatgtgtatgtaacaacaataatcctctctctgcttatgggtttgctgggtctctgttttcatgtactactaccatgatgctgctgctactgcttgttataggcaggtcaggcagctctccgctcaatcaataaactttttttttgtaatacct

SEQ ID NO: 34401 - protein, 115 aa, Panicum virgatum
  misc_feature: Ceres CLONE 1956105
  misc_feature (28)..(113): Pfam Name: Tryp_alpha_amyl Pfam Description: Protease inhibitor/seed storage/LTP family
MARLSAVVAVVLVAALVAAETASAAVSCSQVTSAVAPCLGYAMGSSASPSSACCNGVRSLNSRASSTADRQAACACLKNMAGRLGGNMGNAAASIPSKCSVNVGVPISPNVDCAK

SEQ ID NO: 34402 - DNA, 920 bp, Panicum virgatum
  misc_feature: Ceres CLONE 1956116
  misc_feature: Encodes the peptide sequence at SEQ ID NO. 34403
aaaagaacccgcgggcagggaagaggagaggagggtcctgaaaggaagaaaccaaacgcccaaacccaagctcaagaacagaacaccaccgttccctcgccggggcgtccatccgcaacgatctgcagccatggcgatggcttacaagatggcgacggaggggatgaacgtgaaggaggagtgccagcgctggttcatggagatgaagtggaagaaggtgcaccgcttcgtggtgtacaagatcgacgagcggtcgcgcgccgtgctggtggacaaggtgggcggccccggcgaggggtacgaggagctcgtcgccgcgctgcccggcgacgactgccgctacgccgtcttcgacttcgacttcgtcaccgtcgacaactgccagaagagcaagatcttcttcatcgcctggtcgccggccgcgtcgaggatccgagccaagatcctgtacgcgacgtcgaagcaaggcctgcggcggctgctggacggggtccactacgaggtgcaggccaccgacccctccgagatgggcttcgacgtcatcagaggccgcgcgcaatgaagccgctcctggcctccctcccctacgtgcgtgtgcttgactgcttgtgcttgtgcccgtctcctgtcaccactactcactgctgcgagcgtgtgtctgatctatcgcccggatgctaattggcgttggtgtgtgctcccgtagcgtcgatgatgccatctgacgagagggttcgtgtgtgtgtgatctagtagagttttggtgtgtttgctttggctctttggtgtgttgatgatgatgtgtaatgggtggagtagacgaagctgagggagtggcagcggattaatgaaacgtccatctccgcgacgtagaattccactgaacaattgctcctgtacaatacgataaggtgcttcgg

SEQ ID NO: 34403 - protein, 143 aa, Panicum virgatum
  misc_feature: Ceres CLONE 1956116
  misc_feature (16)..(143): Pfam Name: Cofilin_ADF Pfam Description: Cofilin/tropomyosin-type actin-binding protein
  misc_feature: Functional homolog of the protein sequence given in SEQ ID NO 50159
  misc_feature: Useful for making plants with modulated time to senescence
MAMAYKMATEGMNVKEECQRWFMEMKWKKVHRFVVYKIDERSRAVLVDKVGGPGEGYEELVAALPGDDCRYAVFDFDFVTVDNCQKSKIFFIAWSPAASRIRAKILYATSKQGLRRLLDGVHYEVQATDPSEMGFDVIRGRAQ

SEQ ID NO: 34404 - DNA, 984 bp, Panicum virgatum
  misc_feature: Ceres CLONE 1956124
  misc_feature: Encodes the peptide sequence at SEQ ID NO. 34405
attagcacgctctcggcagctgagtttacctacccagcaggcagcactcagcagctgcagcggctcccgcccgttgacttgcttttccatcgcctctccacgactagaggagatgtctgaggtggtggcgatggcggggcaggcgtacatgaggcaactgctggcccacccgctgcgcaccaaggccatcacctccggcgtcctggccggctgcagcgacgccgtcgcccagaagatctccggcgtccccaagctccaactcaggaggctcctcctcatcgcgctatacggatttgcatacgcgggaccgtttggacatttcctccacaagctcatggataggtttttcaagggcaagaaaggaaaagaaacgacagccaagaaggtcttagtagaacagctgaccgcatctccatggaacaacatgatgtttatgatgtattatggtctggtcgttgaagggagaccattcggacaagtgaagagcaaggtgaagaaggactatgcatctgttcagctgacatcttggaagttctggccaattgtaagttggatcaaccatgagtacatgccactccaactccgagttcttttccatagcttcgtcgcatcctgctgggcggtgtttttaaacctcaaggcagcaagatccatcgcaaatactcctactaagaaggcataaacaaaggcagctatcgacggaataaatgccatgatctgaactgccgcctgaaagcaaaaccaacatgtgtatcaactgggcggctaggcctgaattttcttttacagagggagaggaacaatggaattgaattatattgtttgctgcgactagtttgcgcgcattggtctcctgccttttcatttcgtaaattgttgtttgctcttcccatcctatcaacgacgtccgtagtatgtatctatttttaagtagaatcaaagttggtttacaggcaaaaaaaatatatggactcttgtttctct

SEQ ID NO: 34405 - protein, 189 aa, Panicum virgatum
  misc_feature: Ceres CLONE 1956124
  misc_feature (114)..(182): Pfam Name: Mpv17_PMP22 Pfam Description: Mpv17 / PMP22 family
MSEVVAMAGQAYMRQLLAHPLRTKAITSGVLAGCSDAVAQKISGVPKLQLRRLLLIALYGFAYAGPFGHFLHKLMDRFFKGKKGKETTAKKVLVEQLTASPWNNMMFMMYYGLVVEGRPFGQVKSKVKKDYASVQLTSWKFWPIVSWINHEYMPLQLRVLFHSFVASCWAVFLNLKAARSIANTPTKKA

SEQ ID NO: 34406 - DNA, 553 bp, Panicum virgatum
  misc_feature: Ceres CLONE 1956133
  misc_feature: Encodes the peptide sequence at SEQ ID NO. 34407
gattaatccttgctttgcttgctgctgcttgtatatatcctcgtccggcttgcttctactctcctcttcctcctctgattagcgccttagatccattgctgggataacacaagctgaggtgacccgtgaggtaatgtcgtcggcccagatcgcgccgccgccggagcatgtgtgctacgtgcactgcaatttctgcaacaaagttctcggggaccgtgtccccagcaataccatgctgaacatcctgactgtccgttgtgggttttgcactaccctgctgtcgatgaacttgataggactgatccaatcacttcctgtccataatccctccccggtggtgcaggacaatttcgaggatcacaatattctccatatcgtctttactgaaaactactctgagtatgctccttcgtcttccaaattccagatgccagtgatgttctcaacaaaaggagatcaggatcatatgctgcacgtgcgtgctctagatactcctccacgatgttccctcagcatacaatagatttattaaggaagagatacggaggattaa

SEQ ID NO: 34407 - protein, 129 aa, Panicum virgatum
  misc_feature: Ceres CLONE 1956133
  misc_feature (4)..(118): Pfam Name: YABBY Pfam Description: YABBY protein
MSSAQIAPPPEHVCYVHCNFCNKVLGDRVPSNTMLNILTVRCGFCTTLLSMNLIGLIQSLPVHNPSPVVQDNFEDHNILHIVFTENYSEYAPSSSKFQMPVMFSTKGDQDHMLHVRALDTPPRCSLSIQ

SEQ ID NO: 34408 - DNA, 688 bp, Panicum virgatum
  misc_feature: Ceres CLONE 1956151
  misc_feature: Encodes the peptide sequence at SEQ ID NO. 34409
atcgcatcggcactcctctctgcaaagccagccatcggaggaggagaaggagagcttttgggctttttgggggtgggtggtgcgccatgggggaggtgaagcacctgtgcctggtgaggttcaaggaggccgtcgtggtggaggacgtcctcaaaggcatgaccgaccttgtcgcccagatggacatggtcaaatccttcgagtggggccaggacgtgctgaatcaggagatgctgacgcagggcttcacgcacgtcttctcgctcaccttcgcctccgccgacgacctcaccacctacatgggccacgacaagcacgccgcgttcgccgccacgttcatggccgcgctcgagaaggtggtcgtcatcgacttccccgtcgtcatcgccaagccaccgccatcggcatgatcgacctgccacagcatctgtcggccattgtacggtgccttttcaggtagcagatcatcgtctatttgcaacggtgatgtactgcgtgtctaagtacgtatgtactaagctccttattaccacttgttctgctatatgtcctgcactctaggacgtctattgtaggctgtagctgtaaggcaaagatatctacaccgtaccgtacgtgcagcactccgtgttcaaggccctattggttggttaactttggaataaatttcggtgatctttctggtagc

SEQ ID NO: 34409 - protein, 107 aa, Panicum virgatum
  misc_feature: Ceres CLONE 1956151
  misc_feature (4)..(98): Pfam Name: Dabb Pfam Description: Stress responsive A/B Barrel Domain
MGEVKHLCLVRFKEAVVVEDVLKGMTDLVAQMDMVKSFEWGQDVLNQEMLTQGFTHVFSLTFASADDLTTYMGHDKHAAFAATFMAALEKVVVIDFPVVIAKPPPSA

SEQ ID NO: 34410 - DNA, 768 bp, Panicum virgatum
  misc_feature: Ceres CLONE 1956153
  misc_feature: Encodes the peptide sequence at SEQ ID NO. 34411
gcgctgcgctaccgccggctacccccgaccaccgtcccctccgctccccaccccggcgccccgcagctagctcgtcagcctctcgccatggagacctgcccgtcggtgaagaacatcctcttgctggactccgagggaaagcgcgtcgccgtgaagtactacagcgatgactggcccacgctctccgcgaagctggcattcgagaagtcggtcttcgcgaaaacccagaaggcgaatgctggaacggaagctgagattgtaatgtttgatggtcaaattgtggtatataagttcatccaagacctgcacttttttgttactggaggagaagaggagaatgagcttattttagcatcagttcttcagggtttctctgatgctgttgaccgacttctcaaaaacatggtcgacaaaagaacagcacttgagaatttggacctgatcctattatgtcttgatgaaattgttgatggagggattgttcttgaaacagaagggagagagatagctgagaaggtgacaggtcatggattggagagtgcttcatccgcggagcagaccttagttaatgccctaacgcaagcaagagagcacttggccaagtctcttctcatgtgatgtgatgttgtgctttcaatttggggggtgaagatggtgtatcatcctatagctatgtttaaggatactataatacattcttttagcatttgagaatgaaattttctgaagtctattgatgtgtaaaatggcaacattctctggccgttc

SEQ ID NO: 34411 - protein, 176 aa, Panicum virgatum
  misc_feature: Ceres CLONE 1956153
  misc_feature (6)..(151): Pfam Name: Clat_adaptor_s Pfam Description: Clathrin adaptor complex small chain
METCPSVKNILLLDSEGKRVAVKYYSDDWPTLSAKLAFEKSVFAKTQKANAGTEAEIVMFDGQIVVYKFIQDLHFFVTGGEEENELILASVLQGFSDAVDRLLKNMVDKRTALENLDLILLCLDEIVDGGIVLETEGREIAEKVTGHGLESASSAEQTLVNALTQAREHLAKSLLM

SEQ ID NO: 34412 - DNA, 893 bp, Panicum virgatum
  misc_feature: Ceres CLONE 1956158
  misc_feature: Encodes the peptide sequence at SEQ ID NO. 34413
aacgcgcttcccatcggaatccatcgccatggcctcggcaccgacgccgccgcccctcctcccggtgaccaactccgcccccggatcgtaccctgccaccgccggcggctccgacgcgccgatcgcgcagccggccttccgtctcttcctgagccgggtctccgactcggctcggcgttcgctgtccgaccgccggccgtggggggagctcctcgaccgctcggcgttctccaagccggactccgtctccgacgccacctcccgcctgcgccgcaacctcgcctacttccgcgtcaactacgccgccgtggtcgccttcgcgctggggggctcgctcctggcgcaccccttctcgctcctcatcctcctgggcctcctcgccgcctggtgcttcctctacctcttccgcgcctccgaccagcccgtcgtcctcttcggccgcaccttctccgaccgcgagacgctgatggggctcgtcggcgcgtccttcgtcctgctcttcttcacctccgtcgcgtcgctcatcatctccgggctgctcgtcggcggggccctcgtcgcggcgcacggcgcgttccgcgtgcccgaggacctcttcctcgacgagcccaacgcggctgcagggaacagcgctgcccaaggtctgctgtccttcctcggggcacccggatctggcgtttgaggcggcggacggcaagatctgatctactggcttagtgttggtttcaatcgatgcatcggcttttgcaaagacttgcaaatctatcctgagattttactacacgattcgatttagtgctaagtatttgagtaatgtgagttcatgatgtcgagttatcaatacaaatggtgttatgaactgatgatatagtaatatgtttcacttgttctgt

SEQ ID NO: 34413 - protein, 217 aa, Panicum virgatum
  misc_feature: Ceres CLONE 1956158
  misc_feature (47)..(200): Pfam Name: PRA1 Pfam Description: PRA1 family protein
  misc_feature: The sequence is a functional homolog of SEQ ID NO 2244 in the 10/374,780 US patent application
  misc_feature: The sequence is a functional homolog of SEQ ID NO 82 in the 10/412,699 US patent application
  misc_feature: The sequence is a functional homolog of SEQ ID NO 922 in the 10/225,066 US patent application
MASAPTPPPLLPVTNSAPGSYPATAGGSDAPIAQPAFRLFLSRVSDSARRSLSDRRPWGELLDRSAFSKPDSVSDATSRLRRNLAYFRVNYAAVVAFALGGSLLAHPFSLLILLGLLAAWCFLYLFRASDQPVVLFGRTFSDRETLMGLVGASFVLLFFTSVASLIISGLLVGGALVAAHGAFRVPEDLFLDEPNAAAGNSAAQGLLSFLGAPGSGV

SEQ ID NO: 34414 - DNA, 1051 bp, Panicum virgatum
  misc_feature: Ceres CLONE 1956169
  misc_feature: Encodes the peptide sequence at SEQ ID NO. 34415
aaacaagtcgaagccacctcccaatttccccacgcccagccacgcggatcgcggtccccgtcaaattcgcctccggcgtccgctcgatccgacgccgccgagtcgatactgttggatcgtgtttccgcagtgatttggccgcgggatttggagggcgcgggtcgaggaaggagatcgaggcgtgccgcgagcagcagccatgagcgaggtgttcgagggctacgagaggcagtactgcgaggcctcggcctccctctcccgcaagtgcaccgccgcctctgccctcgatggagagaagaagaaacagaagctgtccgagatccagtccggcgtggaggaagctgaatcgctgattcggaagatggacctggaggcgaggagcctgcagccgagtgtgaaggctggtttgcttgcgaagttgagggagtataaatctgacctcaacaatgtcaagagcgagctcaagaggatatcagcgcccaatgctaggcaggctacccgggaggagctccttgaggctggcatggctgacactcttgcagtgtctactgatcagaggggacgattgatgatgacaactgaaagactgaatcagtccactgacagaattaaagagagccgaagaactatgttggagacagaagaacttggtgtatcaattcttcaggaccttcaccaacaacgacagtcgctactacatgctcataccactttgcatggtgttgatgataacattggcaagagcaagaagatcctggcagcaatgtcaaagaggatggacaggaacaagtggatcattgggggaatcatctcggctctggttctggccatcctcatcatactctacttcaagcttgctcattaagcctgcttccaggtaggttggctcgcatctctctgcccagtaattgtgtgttacgacttgtctgaatgctgtgtattgagtaacacgctgtctctccaagcatcatttgtttacccccaaacctctaaagcttcaagtggctcatattgtgcacagtgtcagacactccaattatgtaaactaccc

SEQ ID NO: 34415 - protein, 221 aa, Panicum virgatum
  misc_feature: Ceres CLONE 1956169
  misc_feature (41)..(196): Pfam Name: V-SNARE Pfam Description: Vesicle transport v-SNARE protein
MSEVFEGYERQYCEASASLSRKCTAASALDGEKKKQKLSEIQSGVEEAESLIRKMDLEARSLQPSVKAGLLAKLREYKSDLNNVKSELKRISAPNARQATREELLEAGMADTLAVSTDQRGRLMMTTERLNQSTDRIKESRRTMLETEELGVSILQDLHQQRQSLLHAHTTLHGVDDNIGKSKKILAAMSKRMDRNKWIIGGIISALVLAILIILYFKLAH

SEQ ID NO: 34416 - DNA, 786 bp, Panicum virgatum
  misc_feature: Ceres CLONE 1956172
  misc_feature: Encodes the peptide sequence at SEQ ID NO. 34417
acaccagatccccgacaagcggcaggcacaggcagcccgagctctctccttcctcctcactcggcactcctagcccactcgccatggcgccgacgcctcctccggccgcccagggcggggcgcacaccgtgttcgtgtatgggagcctgatggaggaacaggtggtgcgagccatcctcaagcgcgtcccgcccgccgccccggcgatcctccccaactaccaccggttcaacatcaaggagcgcatttatccggcaatactgcccgttgaaaacaagaaagttgctggaaaggttatcatgggtgttactgacgatgagctccaagtcctggatgcatttgaagatgtggagtatacaaggacaagagttgagatttcgttaactgattcttccgagacgatgctagctgacacttatgtatggagtgatgcagaggatccaaatctttacggtgaatgggatttcgaggagtggaagaaactgcatatgaaggacttcctagcaatgacgcttggtttcatgcatggactcgagcagcctgaatcaaagactcgggtcgagacctatcagtcatacatgcaacaacaggaacagcctgcatcacagaccaaggttgagggttgaggcctctgctcatctgccgtcgttggtaattctctgggaagaactgtattggcaccggggctgtattatctgtaataacaagtcgtctaaatgtggtgtgaataagacctttacaggatcatatgataataattatacatatatcaaataaatttcctcc

SEQ ID NO: 34417 - protein, 180 aa, Panicum virgatum
  misc_feature: Ceres CLONE 1956172
  misc_feature (16)..(115): Pfam Name: AIG2 Pfam Description: AIG2-like family
MAPTPPPAAQGGAHTVFVYGSLMEEQVVRAILKRVPPAAPAILPNYHRFNIKERIYPAILPVENKKVAGKVIMGVTDDELQVLDAFEDVEYTRTRVEISLTDSSETMLADTYVWSDAEDPNLYGEWDFEEWKKLHMKDFLAMTLGFMHGLEQPESKTRVETYQSYMQQQEQPASQTKVEG

SEQ ID NO: 34418 - DNA, 508 bp, Panicum virgatum
  misc_feature: Ceres CLONE 1956178
  misc_feature: Encodes the peptide sequence at SEQ ID NO. 34419
gagcagccgtcgccgccgccagagctcgagcgcactcgtttactcctactccggaatcgcccgagcaccggatcttcgccgccaccgtcgccatgggtaaggttcacggatctctggcccgtgcggggaaggtgcggggacagacgcccaaggtggcgaagcaggacaagaagaagaagccccgcggccgtgcctacaagcgcatgcagtacaaccgccgcttcgtcaccgccgtcgtcggcttcggcaagaagcgtggccccaactcctccgagaagtagatctagacctcctggcggcctggttcaaacaaatggcctgctttcccttttctcttttttgtttcctagtagtttgttcgagtaatcaagtctttggtgctgtactgatgataaattaagacctagcaatattctgtaccaatgatattggaatatcattaagtatcgtatgcatcgtttccgtgacgacaatgggcgccaatgaatggtgattacattgttcgatc

SEQ ID NO: 34419 - protein, 62 aa, Panicum virgatum; identical to SEQ ID NO: 10043
  misc_feature: Ceres CLONE 1956178
  misc_feature (3)..(61): Pfam Name: Ribosomal_S30 Pfam Description: Ribosomal protein S30

SEQ ID NO: 34420 - DNA, 711 bp, Panicum virgatum
  misc_feature: Ceres CLONE 1956180
  misc_feature: Encodes the peptide sequence at SEQ ID NO. 34421
cactcaccatcagttcctgatctcaaactaatggaagaaggcaactttttaaaggcatggggaggtatatcatcattgcagtttgttctccctgtgacatggtcgtatgggaaaaagtacggcattacttttaatcaactagccgcatggtggagtgaaaatccggctaagcttgcagggcaaaagaacaagggagctattctgccgggataccatgctgacattgtagtatggaaacctgaggcgcagttcgaacttgatgacagccattctgtgtaccataaacaccggaacatttctgcatatttagggaaagaattttctggtaaggtcctgtctacttttgtgagaggaaatcttgtatttgctgaagacaagcatgcaaaggccgcctgtggtgttacaatcctcgcgaagtaagatttcaggttcaaaggtggatgcggagctgctccagtactgcccttgctgatccatagcgtatatgctcgtatgcgctgtgtatctgtaggttacccctgtgtatagtataattgaagccatttatgccattgttgtagtgtagtagagaacccgcaactggattggctttaagtttgccccagttgccaattggtctgttggaccttctgtattataatttctttttcctattgatatggaaaaacaacttgtccaaatttattttctccatatatatgctctgttgac

SEQ ID NO: 34421 - protein, 139 aa, Panicum virgatum
  misc_feature: Ceres CLONE 1956180
  misc_feature: SWISSPROT Homolog: EC 3.5.2.5 Allantoinase
HSPSVPDLKLMEEGNFLKAWGGISSLQFVLPVTWSYGKKYGITFNQLAAWWSENPAKLAGQKNKGAILPGYHADIVVWKPEAQFELDDSHSVYHKHRNISAYLGKEFSGKVLSTFVRGNLVFAEDKHAKAACGVTILAK

SEQ ID NO: 34422 - DNA, 1134 bp, Panicum virgatum
  misc_feature: Ceres CLONE 1956182
  misc_feature: Encodes the peptide sequence at SEQ ID NO. 34423
attccgcaccaaccacgccagggcccgagctccgtgctagggtttcctctcccgccgccgccgccgccgccgccgcctccggtggaggaggagctgagcgagtagcgccgggaggggaccatggggacgccggagacgtcgcgcgagccgtgcccggaccggatcctggacgacgtgggcggcgcgttcgggatgggcgccgtcggcggctccgtcttccacttcctcaagggcgcctacaactcccccaacgggatgcgcctgtcgggcggcgcgcaggccgtgcgcatgaacgcgccgcgggtggggggcagcttcgccgtctggggcggcctcttctccaccttcgactgcgccatggtctacgcgaggcagaaggaggacccctggaactccatcgtcgccggcgccgccacgggcgggttcctctccatgcgccagggcgcgggggccgcggggcggtcggcgctcatgggcgggatcctcctggccctcatcgagggcgccggcctcatgctcaaccgcgtcctggtaaacccgccgctgcccgccgaggatcctaacctcwtgggccccggagggttcccgggcctcccgcaggcgccgccggtcgtggcgcctcctgaggccgcgagctccagcggtgcggctggctggttcgggggcctgttcggcaagaaggaggagaataaggacaactcgagcgggggcaagtcggagatcctggagagcttcgacacgccgagtaccccgataccatcgttcgagtacaagtgaggaaaaaggtttgctgatggaactgttgcttacctggtcttggaacgtggtgattggaattggggatgcagatcagcaatacaataaccgtgaggacaagtgattcacttgctcgataacttattcttgcctttgccgctctgatttgatggctcatatctatgcgcccttgcttgtgtatgtataagccttctgaacgtggcagattggctactttttgaaatgatgtagtagtagaagaacaagcagaagcagtagtgtaatgcctatatgatagcatttgtgttgtgtgcattttaatgcacttgataaaacccgtgttctatgcctcatcatgctggcctctgaagggacagt

SEQ ID NO: 34423 - protein, 218 aa, Panicum virgatum
  misc_feature: Ceres CLONE 1956182
  misc_feature (4)..(133): Pfam Name: Tim17 Pfam Description: Tim17/Tim22/Tim23 family
  misc_feature (150)..(150): Xaa is any aa, unknown, or other
MGTPETSREPCPDRILDDVGGAFGMGAVGGSVFHFLKGAYNSPNGMRLSGGAQAVRMNAPRVGGSFAVWGGLFSTFDCAMVYARQKEDPWNSIVAGAATGGFLSMRQGAGAAGRSALMGGILLALIEGAGLMLNRVLVNPPLPAEDPNLXGPGGFPGLPQAPPVVAPPEAASSSGAAGWFGGLFGKKEENKDNSSGGKSEILESFDTPSTPIPSFEYK

SEQ ID NO: 34424 - DNA, 840 bp, Panicum virgatum
  misc_feature: Ceres CLONE 1956185
  misc_feature: Encodes the peptide sequence at SEQ ID NO. 34425
tgttgcaatcgaggctagtggcagagcatttcagctctacagctcgggtatcttcactggaagatgcggaacagagctagaccacggtgtcacagccgtcggttacggcacagagaacggcaaggactactggatcgtgaagaactcgtggggcgccagctggggcgaggccggctacatccggatggagcgcaacgtgaaggcgtccagcggcaagtgcggtatcgccgtcgagccgtcgtaccctctgaagaagggcgcgaaccccccgaaccccggcccgacgccgccgtcccccgccccgccgcccgccgtgtgcgacaactactactcctgcccggacagcaccacctgctgctgcatctacgagtacggcaagtactgcttctcctggggctgctgcccgctcgagggcgccacctgctgcgacgatcactacagctgctgcccccatgactaccccatctgcaacgtcagggagggaacctgcctcatgggcaaggacagcccactgtcagtgaaggctctgaagcgcaccctggccaagccgcactgggctttctctggcaacgcagctgacggcatgaagagcagcgcttgaacaatctccagcaagatatcaggcggccaacatccacggtgatcggagctcctgcaaacgatcacccggtgcttaatcgaccaagaaaaagcgtggcgcggcggccgctgtttaagtgtgtttaagtgtatccgtataataggtgctcctgtacataagcctgaaaaaatgggtttcagttgtccgaactgctgccaaatttgcttttacatattatattatatatgtaagattcagct

SEQ ID NO: 34425 - protein, 199 aa, Panicum virgatum
  misc_feature: Ceres CLONE 1956185
  misc_feature (1)..(83): Pfam Name: Peptidase_C1 Pfam Description: Papain family cysteine protease
  misc_feature (118)..(165): Pfam Name: Granulin Pfam Description: Granulin
  misc_feature: SWISSPROT Homolog: EC 3.4.22.14 Actinidain
VAIEASGRAFQLYSSGIFTGRCGTELDHGVTAVGYGTENGKDYWIVKNSWGASWGEAGYIRMERNVKASSGKCGIAVEPSYPLKKGANPPNPGPTPPSPAPPPAVCDNYYSCPDSTTCCCIYEYGKYCFSWGCCPLEGATCCDDHYSCCPHDYPICNVREGTCLMGKDSPLSVKALKRTLAKPHWAFSGNAADGMKSSA

SEQ ID NO: 34426 - DNA, 768 bp, Panicum virgatum
  misc_feature: Ceres CLONE 1956190
  misc_feature: Encodes the peptide sequence at SEQ ID NO. 34427
tctgaagtttcggcggcggcgtaggcagcggcggcgtgctcgtgatctcaacaccaggcgctcgcttccggtcacccgtcgctccacgcagccatgtcgaggaggaagaccagggagcccaaggaggagaatgtcacccttggccccactgtccgtgagggagagtatgtctttggtgttgctcacgtctttgcatccttcaacgacaccttcattcatgttactgatttgtctgggagggaaactctggttcggatcactggtggcatgaaggtcaaggctgatcgtgatgaatcgtcaccttatgctgctatgcttgcagctcaagacgttgcagctcgttgcaaggagcttggtatcactgcgctgcacattaagcttcgtgccactggaggcaacaaaaccaagactcctgggcctggtgctcagtctgctcttagggctcttgctcgttctggcatgaaaattgggcgcattgaggatgttaccccagttcccactgacagcactcgcagaaagggtggtaggaggggaaggaggctgtaggcgtcttctcctggctatttgccatatcatggcgcaggccatgaagaaactagtcctctctgggtagtgttgctgttcctatgcttgtcaagagagctttaattttgctctatgttgaggatcatttaccgttagtcgaacctgtgatgttgcatggatgatgttttggttgaggaattgacttgtcatatttatgctaaaaaaaccatgtgttttcactct

SEQ ID NO: 34427 - protein, 150 aa, Panicum virgatum; identical to SEQ ID NO: 12807
  misc_feature: Ceres CLONE 1956190
  misc_feature (28)..(146): Pfam Name: Ribosomal_S11 Pfam Description: Ribosomal protein S11
  misc_feature: Functional homolog of the protein sequence given in SEQ ID NO 50135
  misc_feature: Useful for making plants with modulated biomass

SEQ ID NO: 34428 - DNA, 753 bp, Panicum virgatum
  misc_feature: Ceres CLONE 1956195
  misc_feature: Encodes the peptide sequence at SEQ ID NO. 34429
taccgaaatcagcaattattccccttcacaaccatcctgggatgacagtatttagcaagatactatttggttccatgcacctgaagtcatatgactgggctaagagtccgccagagagtcatgatactgcaattgagcactcagatggagctcgtttggccaaggtaaatactgatgctgttttcgatgcttcatctgagacagtagttctgtaccctgaaaatggagggaatttgcactgttttactgcgttgaccccctgtgctgtgctggatgtgatgggccccccttacaaccgtgctgatggaagggattgcgcgtactatgacgaatcaccgtacttgactggtggagatgaacagtattcttggcttaaagaggtttctaccacatttgagatgaaaggtatacagatgccgcggaagtttagcgtctcggcatgactagcatgacattgccgtgacacctgaagaggatgaagcaaatgccgctagcttgatgtacatatcttagctgcgaagacagacaacaatgggtagaaaacttgacatttgtttctcttatttcgtttgggtcgaaacaatctctctcttgtggtttgggatgactctgctcctcttgtgttactggagtatccaatagtgcaatttgaatttgggctttttggggcatgatcattttttttgtttccctgtagacagagatgtacgcaggtgttctttttgaagtgatcatggaccaaattcagtgggt

SEQ ID NO: 34429 - protein, 146 aa, Panicum virgatum
  misc_feature: Ceres CLONE 1956195
  misc_feature: SWISSPROT Homolog: EC 1.13.11.19 Cysteamine dioxygenase
PKSAIIPLHNHPGMTVFSKILFGSMHLKSYDWAKSPPESHDTAIEHSDGARLAKVNTDAVFDASSETVVLYPENGGNLHCFTALTPCAVLDVMGPPYNRADGRDCAYYDESPYLTGGDEQYSWLKEVSTTFEMKGIQMPRKFSVSA

SEQ ID NO: 34430 - DNA, 898 bp, Panicum virgatum
  misc_feature: Ceres CLONE 1956197
  misc_feature: Encodes the peptide sequence at SEQ ID NO. 34431
ctagaccaccgaacccagcgggctccgctccgagcaagccggcactcgcattcctcctcagattcgctggttctgttgggcggcggagtgcggaatggggggcggtggatccggatctttcctcaaggtcctggtcaataatctggatgttctcgccgggcctctagtttcacttgcatatcctctgtacgcctctgttagagcaattgaaacaaaatctgctgtagatgatcagcaatggctcacgtactgggtgttgtactcatttatcactctatttgagctcacctttgctccagtactggaatggcttcctttctggtcttatgcaaaattgtttttcaattgctggttggtattaccacagtttaatggcgctgcacatgtgtatgagcattttgtgaggccaatgattgtaaatcagcaagttgtaaacatctggtatattccaaagaagggtgaatcagagaggcctgatgatgtgatttcagctgcacagagatacattgagcaaaatggatcaaaagcatttgagaatcttgttaacaagtttaagagttcaaacccaagacggtcaatactggaggaggtagaggttgaaaggagagccaggattcaacgagaatctgaagcaagggaagttaaccccttcttcaatccagattactgatactaggaagcctatttgctttcagttggcaggaatctataggatcagttcgagggaagatgtatggacattaggactggcattttgcacctactgaatcaataataatgtgtagctggacgaccatgattgttgtaaatatgttctagcgttgaaactctttatcatgtaatggtcatgtcatgaatctttcgtgtcactgaaaattatgtatccagtattcatgcc

SEQ ID NO: 34431 - protein, 191 aa, Panicum virgatum
  misc_feature: Ceres CLONE 1956197
  misc_feature (10)..(107): Pfam Name: TB2_DP1_HVA22 Pfam Description: TB2/DP1, HVA22 family
MGGGGSGSFLKVLVNNLDVLAGPLVSLAYPLYASVRAIETKSAVDDQQWLTYWVLYSFITLFELTFAPVLEWLPFWSYAKLFFNCWLVLPQFNGAAHVYEHFVRPMIVNQQVVNIWYIPKKGESERPDDVISAAQRYIEQNGSKAFENLVNKFKSSNPRRSILEEVEVERRARIQRESEAREVNPFFNPDY

SEQ ID NO: 34432 - DNA, 1045 bp, Panicum virgatum
  misc_feature: Ceres CLONE 1956203
  misc_feature: Encodes the peptide sequence at SEQ ID NO. 34433
ctctttcctcccttccccaaaacaaaacccgagcttcctagggttccgccgccatgccgcagggagaccacatagagctgcaccagaagcgccatgggcggcgcctggactacgaggagcgcaagcgcaagcgcgaggcgcgcgaggtgcacaagcgctcgaaggatgcacggaagttgcttggtgctaaggggaagaggttcgccaagaagcgatatgctgagaaagcgcagatgaagaagaccctgaaaatgcatgatgaatcaacttcgcggcagaaggctgatgatgatgtccaagagggtgctcttcctccgtatctgcttgatcgtgatcagacacagcgtgccaaggttcttagcaacacgatcaagcaaaaaaggaaggaaaaggcaggaaaatgggatgttcccttgccaaaggtcagaccagtagctgaagaagagatgtttaaggttctgcgaactggcaagcgaaaaaccaagcagtggaagagaatggttactaaagccacctttgttggacctggatttacaaggaagcccccaaagtatgaaaggttcatccggccaactggtttgcgtttcaccaaagctcatgtgactcacccagaactgaaatgtactttcaacctggatataatttctgtcaagaaaaacccaaatggcccaatgtacacttctcttggtgttatgacaaggggaacaatcattgaggtgaatgtcagtgaacttggtttggttactcctgctggaaaagttgtttggggtaaatatgctcaggttacaaacaacccggagaatgatgggtgtatcaatgctgtcttgctagtttagggtcatactgaagttctgttatggtggtttatcttccggtttgtaccactttgatgatgtttttttgactaatgctgtggcattctagtaccctgttgtgcaccatgggcataacatgtatcctgtattgttgctgcacgacaaatgatgatgctattatagcctggtgtaaaatttgaggaatacagattagcaacgttttttctgtc

SEQ ID NO: 34433 - protein, 260 aa, Panicum virgatum; identical to SEQ ID NO: 10677
  misc_feature: Ceres CLONE 1956203
  misc_feature (1)..(237): Pfam Name: Ribosomal_S8e Pfam Description: Ribosomal protein S8e

SEQ ID NO: 34434 - DNA, 1010 bp, Panicum virgatum
  misc_feature: Ceres CLONE 1956207
  misc_feature: Encodes the peptide sequence at SEQ ID NO. 34435
accatcatcagcttcaattcattctagctccttccacacgcgtcgtagatgaacgcacgatcgagctcacaccgagaagcagctaccgaccaagacgaagacgaagacgaagcggcgctagggtgcatgggactttccttgtgttcccagcagagatctccggccaggccagaaattgcgaccaggggtattcgtgatcgcctgcaacccagcgctgctgctgctattcggaagggccgtggtgagggcgataagatcaatatgctgccgaccaccgtgacggccatccaaagcaaccaagagttgaagaacgtcttgaggcaggccaaggagccaaactccaacctggtggtgctggagttcacggcgccgtggtcggagccgtgcaagttcatgaggccggcgctggagaagatcgcctccgacttcaaggatcacgccgacttctacacgctcgacgtcgagcagttcaagacatttgctcggaacacccgggtggaggcgctgccgacgttcctgctggtgaggaaaactatcttggagcgcgtcatcggcgtcagcaaggacgagctgcagcgcagcatccaaaagcacatatcaggcattgccattgatcatttccatccataaattaaatccacgtcttcatcggttggactcacattcatgactcatcaacacgtatatacatgcttgttgcacaatgttttaatttcctgatcgaatggtgtgtgtgtgtctctctctctctctctatatatatatatatatatatatatatatatatatataacagactgatctgaccggtatgtccaggcagtctgaccggtctagatgttgtagccggtccgacaggagccgatcagtctgaccggtgggtctgaccggtctaagcagaatccgagtataactagtgattttcatagatttaagatctgtaataggatttcttgcggggcaagtccatcccatcctataaatataaagggccacggccaattgagggt

SEQ ID NO: 34435 - protein, 167 aa, Panicum virgatum
  misc_feature: Ceres CLONE 1956207
  misc_feature (51)..(156): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MGLSLCSQQRSPARPEIATRGIRDRLQPSAAAAIRKGRGEGDKINMLPTTVTAIQSNQELKNVLRQAKEPNSNLVVLEFTAPWSEPCKFMRPALEKIASDFKDHADFYTLDVEQFKTFARNTRVEALPTFLLVRKTILERVIGVSKDELQRSIQKHISGIAIDHFHP

SEQ ID NO: 34436 - DNA, 809 bp, Panicum virgatum
  misc_feature: Ceres CLONE 1956216
  misc_feature: Encodes the peptide sequence at SEQ ID NO. 34437
acagcactgcagaaccatctcacctccctcgccgtcgcctcccatatcttccaatggcgtcagagaagaagcagtcgaacccgatgcgggagatcaaggtccagaagctcgtgctcaacatctccgtcggcgagagcggtgatcgcctcacccgtgccgccaaggtgctcgagcagctgagtgggcagtcaccggtgttctccaaggcgaggtacactgtgaggtcgtttggaattaggcgtaatgagaagattgcgtgctacgtgacagtgaggggagagaaggcgatgcagctgctggagagtggcctgaaggtcaaggagtacgagctgctgaggaggaacttcagtgagaccggctgcttcgggtttggtatccaggagcacattgatcttggcatcaagtatgacccatctaccggtatctacggcatggacttctacgttgttcttgagcgtgctgggtaccgtgtcgcccgccggcgcaggtgcaagtcccgtgttggtatccagcacagggtcaccaaggaggatgccatgaagtggttccaggtcaagtacgagggtgtgatcctcaacaaggcccaagccaacaccgcctaagcatcacaagagcttagccccgctttagagctcgcgttacttaagtttctctggtggttggatttttactagaaagaaacaaaatgctgtcagttttgcctgtactgcagttggaccctttttctgggtgccctgtactttcatcttaattctcgcttgtgttttacccacattggcagaaatagtagataactggcttattctctc

SEQ ID NO: 34437 - protein, 182 aa, Panicum virgatum
  misc_feature: Ceres CLONE 1956216
  misc_feature (66)..(165): Pfam Name: Ribosomal_L5_C Pfam Description: ribosomal L5P family C-terminus
  misc_feature (9)..(62): Pfam Name: Ribosomal_L5 Pfam Description: Ribosomal protein L5
MASEKKQSNPMREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQANTA

SEQ ID NO: 34438 - DNA, 792 bp, Panicum virgatum
  misc_feature: Ceres CLONE 1956217
  misc_feature: Encodes the peptide sequence at SEQ ID NO. 34439
agggtttccctcttttaatcccctgccgccgccacccgccactctcggcacccgaccgtcccatctcctcgctccgccgccgccgccgcccaagggtccattcgccgcgtcaccgatggcttccgagaagaagcaggcgaacccaatgcgggagatcaaggtgcagaagctggtgctcaacatctccgtcggagagagcggggatcgtctcacccgtgcctccaaggtcttggagcaactgagtggccagtcaccagtgttctctaaggctaggtacactgtccgttcctttggtatcaggcgtaatgagaagattgcctgctatgttactgtaaggggtgagaaggcaatgcaacttctggagagtggactgaaggtcaaggaatatgaactgctaaggaggaacttcagtgagacagggtgctttggttttggtatccaggagcacattgatcttggcatcaagtatgatccttccactggtatttatggaatggacttctacgtcgtccttgagcgcgctggttaccgcgtcgcccgccgccgcaggtgcaagtcccgagttgggatccagcacagggtgaccaaggaggacgccatgaagtggttccaggtgaagtacgaaggtgtcatcctcaacaaggcccaggctaacacttcttagaacccacggtgtgtagtcccagccgttagacatgttatcgtggcagatgattttacctgtatggaagttctcggtctactttgtgcaatgtcggatcatattatttaccaagactaggttctcaaatc

SEQ ID NO: 34439 - protein, 182 aa, Panicum virgatum
  misc_feature: Ceres CLONE 1956217
  misc_feature (66)..(165): Pfam Name: Ribosomal_L5_C Pfam Description: ribosomal L5P family C-terminus
  misc_feature (9)..(62): Pfam Name: Ribosomal_L5 Pfam Description: Ribosomal protein L5
MASEKKQANPMREIKVQKLVLNISVGESGDRLTRASKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQANTS

SEQ ID NO: 34440 - DNA, 797 bp, Panicum virgatum
  misc_feature: Ceres CLONE 1956220
  misc_feature: Encodes the peptide sequence at SEQ ID NO. 34441
aaaaaaaaaaaagatcgctgactcgcaggccgcctctcctctgcctcctcctttcccctccacctcctctccggtgtacggctccgacgagatggccgccccgctccggcggagcctcccttccctcggccgcgcgctcctctcgccggcgccggtgcggatggtctccgcggaggcctccgacgccctggtcgagatcaaaccgggggagatcgggatggtctccggcatccccgaggagcacctccgccgtaaggttgtaatttattcacctgctaggactgcatcccagcaaggttcaggcaaagtcgggaggtggaaaattaactttttgtcaacccaaaagtgggagaacccgttgatggggtggacatctactggggatccatatgctaatgttggtgaagcaggacttacgttcgacagtgcggagtcagcaaaggcatttgctgaaaaacatggatggaattatgtggttcggaaacgccatacacctcttttgaagcccaaggcttacgcagagaacttcaagtggagaggttccccgaagccggagcaagcgtcagctctagacctctagtctgtgagcctgacattcagatgatgttgttttcctcctggactgcttttgctttcatcagtatccgttgtgaagtaagagcgagaacatgcctcgattaaacttgtaataagcatgcgctgcaatcaaacaaaatacatatcattccaaaatgtttgttcaaggatgcccctgtatttcaatcccctgtggttgcctggttggtcatattgggtag

SEQ ID NO: 34441 - protein, 162 aa, Panicum virgatum
  misc_feature: Ceres CLONE 1956220
  misc_feature (54)..(156): Pfam Name: ETC_C1_NDUFA4 Pfam Description: ETC complex I subunit conserved region
MAAPLRRSLPSLGRALLSPAPVRMVSAEASDALVEIKPGEIGMVSGIPEEHLRRKVVIYSPARTASQQGSGKVGRWKINFLSTQKWENPLMGWTSTGDPYANVGEAGLTFDSAESAKAFAEKHGWNYVVRKRHTPLLKPKAYAENFKWRGSPKPEQASALDL

SEQ ID NO: 34442 - DNA, 949 bp, Panicum virgatum
  misc_feature: Ceres CLONE 1956223
  misc_feature: Encodes the peptide sequence at SEQ ID NO. 34443
cactgtctcctccctttcccctcccaaggccaggcttgccctcccctctccgcgtcgcctcccgtccaggaatccgccatgaagggggccaaatccaagggcgccgccaaggccgatgccaagttggcggtgaagagtaagggggcggagaagccggccaagggcaggaagggaaaggccggcaaggaccccaacaagcccaagagagcgcccagcgcctttttcgtcttcatggaggaattccgcaaggagttcaaggagaagaaccctaaaaacaagtctgttgctgcggtggggaaagctgccggtgacaggtggaaatccctgaccgatgcggacaaggctccttatgtagccaaggctaataaactcaagcttgagtacaacaaggctattgctgcctacaacaagggcgagagcactgctgccaagaaggctcctgccaaggaggaagaggaggaggaagaagaggagtctgacaagtcaaagtctgaggtaaacgaggaggaaggtgacgatgagggtgaagaggaagaagatgatgatgaagcacatgctgagctgcttgaggttactgtggattgctttttagcagcaaaagcatgggcggagcgaaagcttggcccagggaatgcaaacattgaacacattcttggtatgcttcgattcttaccgggttatgaagaagcagtaagggcaagacaggaagccataaaggcagaatgatgcctcgagttcttgtcagatatttggttataattatagcaagttcatgttgctgatggcagttccaacttccaaccatatccattgggtctgtggaccgaatggatgctccttcagactgagaagtgaagcggcagattagctctgcgggatttcaaagttccatgaattatgtcgctttaactcattgagtttaagaattatattatatgaacttggtagc

SEQ ID NO: 34443 - protein, 215 aa, Panicum virgatum
  misc_feature: Ceres CLONE 1956223
  misc_feature (41)..(110): Pfam Name: HMG_box Pfam Description: HMG (high mobility group) box
  misc_feature: Functional homolog of the protein sequence given in SEQ ID NO 50396
  misc_feature: Useful for making plants with altered alkaloid content
  misc_feature: Functional homolog of the protein sequence given in SEQ ID NO 51462
  misc_feature: Useful for making plants with altered terpenoid content
  misc_feature: Functional homolog of the protein sequence given in SEQ ID NO 50397
  misc_feature: Useful for making plants with altered lignin content
  misc_feature: Functional homolog of the protein sequence given in SEQ ID NO 50398
  misc_feature: Useful for making plants with modulated nitrogen use efficiency
MKGAKSKGAAKADAKLAVKSKGAEKPAKGRKGKAGKDPNKPKRAPSAFFVFMEEFRKEFKEKNPKNKSVAAVGKAAGDRWKSLTDADKAPYVAKANKLKLEYNKAIAAYNKGESTAAKKAPAKEEEEEEEEESDKSKSEVNEEEGDDEGEEEEDDDEAHAELLEVTVDCFLAAKAWAERKLGPGNANIEHILGMLRFLPGYEEAVRARQEAIKAE

SEQ ID NO: 34444 - DNA, 814 bp, Panicum virgatum
  misc_feature: Ceres CLONE 1956225
  misc_feature: Encodes the peptide sequence at SEQ ID NO. 34445
aaaacacaaggaattgaagagaggaaaagatccatcgagcttaccataccctctctcccctctcccgctagccatggcctcttacgctgtagctcccgttcaaagtgagcttcagatgaccctatacaacaaggaggtgtactctggacgggacatcaacggagtgaagattacgggtggacatccactgggtacaacctgggtcttctcttggcttgtaactgatgggccaggttccgatgcaaatatcgttggccatctgcagggcacaggtgttcaagtagccagtagtcccaattatgtgtggcactactcccttggattagtgttcggggataaaaggttcaaggggtctacactacaaatatctgggacttcccaaataaatggtgagtggagcatagttggagggacaggagaacttgctatggcaaatggtactgtcaaacgcacagaaatttcatataagggagatacgaggatttcagaactcaaaatacatgcagtttacactccaaagaaccagacaattgtttctggtaatgctgaatgtaaagtagagaaggcgtgaggttttatgcagtcccttagactggtcttcaaggaagccaaacaagatctgctgaggaaatatctacgcccttcagttgttttgttgcctaataatttcccgactatgtactcgggatcacggacaaagtttgttgtcaccttgtactttgctgcacttcatcagttgtttgtttcctgataacttctcgactctgtattcgggactacagaccaatagtttgctctaccaatgtttgttttc

SEQ ID NO: 34445 - protein, 165 aa, Panicum virgatum
  misc_feature: Ceres CLONE 1956225
  misc_feature (1)..(146): Pfam Name: Dirigent Pfam Description: Dirigent-like protein
MASYAVAPVQSELQMTLYNKEVYSGRDINGVKITGGHPLGTTWVFSWLVTDGPGSDANIVGHLQGTGVQVASSPNYVWHYSLGLVFGDKRFKGSTLQISGTSQINGEWSIVGGTGELAMANGTVKRTEISYKGDTRISELKIHAVYTPKNQTIVSGNAECKVEKA

SEQ ID NO: 34446 - DNA, 528 bp, Panicum virgatum
  misc_feature: Ceres CLONE 1956227-R
  misc_feature: Encodes the peptide sequence at SEQ ID NO. 34447
gagggcaagaagggcaagaagagggccacgaagagcgtcgagtcgtacaatatgtacatctccaagctgctcaagcaggcgcaccgggacttgggtatgtcatccagggccatgtccatcatgaattcgttcatcaatgccatgttagagaagttggccgcggtggctccctagttcgcccgatacaccaggaagcccaccatcacctcccgggagatccagccttccgtctgcctcctcttccccggggagctgagcccagcccgccgtctccgagggcaccaaggccgtccccatgttcgcatggtgttacttaggtttgccgcctctcgtggtgccagttctagtttggttgggtgctcctgctagccccggctccctcggtttaatttatttggtggaagtggtggtatcctctgctgtgtcgaatggaaatggatggtcttgtgtgtaggggtatgaaccgggcacttaatcgggaacatcaacgggtccggttcggttccattaacttttgttcatgtgttc

SEQ ID NO: 34447 - protein, 57 aa, Panicum virgatum
  misc_feature: Ceres CLONE 1956227-R
  misc_feature: Functional homolog of the protein sequence given in SEQ ID NO 50160
  misc_feature: Useful for biocontainment applications
  misc_feature: Useful for making plants with modulated flowering time
EGKKGKKRATKSVESYNMYISKLLKQAHRDLGMSSRAMSIMNSFINAMLEKLAAVAP

SEQ ID NO: 34448 - DNA, 1021 bp, Panicum virgatum
  misc_feature: Ceres CLONE 1956243
  misc_feature: Encodes the peptide sequence at SEQ ID NO. 34449
ctagggtttatcaccgtctcacagccctccgtaacgagctcgccgccgccgccgtcttcgcccgctacagcgcggacgaaccctaggcgccgaacaacatggcgaggggtttgaagaaacatctgaagaggctcaatgctccaaagcattggatgcttgacaagcttggtggagcatttgcacccaagccttcatctggtccccacaaagccagggagtgcttacctttgatccttatcctcaggaacaggttgaagtatgctctgacctatcgtgaagttatttcaatcttgatgcagcgccaagttatggttgatggcaaggtcaggactgacaagacatatccatctggattcatggatgttgtgtcaattccaaagactggagagaatttccgccttctctacgacaccaagggacgcttccgtctccacagtatcagggatgatgaggctaagttcaagctttgcaaggtgaggtctgtgcagtttgggcagaagggcatcccttttctgaacacctatgatgggcgcactatccgctacccagaccctctcatcaaggccaatgacaccatcaagattgacctggagaccaacaagattgtagacttcatcaagtttgatgttgggaatgttgtgatggtgactggcggaaggaacactgggcgtgttggggtgataaagagcagggaaaggcacaagggcagctttgagaccatccatgttgaggattcactcggccaccagtttgccacccgcatgggcaatgtgttcaccattggcaaggacaagaagccgtgggtatctcttcccaagggcaagggcatcaagctcagtatcattgaggaggcgcgcaaggctgctgctgaggcttgatttctttcatgttaggctactgaaaaccgttgctgtaagcatttctatcagaagatgtagaccgctgggcgcaagtgctatcatggagctgttctgaacagtgaagtcttgtgctattttgaacactgaagtagttggtctac

SEQ ID NO: 34449 - protein, 259 aa, Panicum virgatum
  misc_feature: Ceres CLONE 1956243
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
  misc_feature (177)..(211): Pfam Name: KOW Pfam Description: KOW motif
MARGLKKHLKRLNAPKHWMLDKLGGAFAPKPSSGPHKARECLPLILILRNRLKYALTYREVISILMQRQVMVDGKVRTDKTYPSGFMDVVSIPKTGENFRLLYDTKGRFRLHSIRDDEAKFKLCKVRSVQFGQKGIPFLNTYDGRTIRYPDPLIKANDTIKIDLETNKIVDFIKFDVGNVVMVTGGRNTGRVGVIKSRERHKGSFETIHVEDSLGHQFATRMGNVFTIGKDKKPWVSLPKGKGIKLSIIEEARKAAAEA

SEQ ID NO: 34450 - DNA, 931 bp, Panicum virgatum
  misc_feature: Ceres CLONE 1956261
  misc_feature: Encodes the peptide sequence at SEQ ID NO. 34451
gactctggtgatggtgttagccacactgtgcccatttatgaaggatatgcacttcctcatgccattcttcgtttggatctggctggtcgtgacctcaccgactccctcatgaaaattctcactgagaggggttactccttcacaacctctgctgagcgagaaattgtaagggacattaaggagaagcttgcatatattgcccttgactatgaacaagagttggaaactgccaagaacagctcctcagttgaaaagagctatgagctacctgatggtcaagtaatcaccattggtgcagagagattcaggtgccctgaggtcctcttccagccgtccatgattggtatggaggctgctggaatccatgagacgacctacaattcaatcatgaagtgcgatgtggatatcaggaaggacctgtatggcaacattgtgctcagtggaggttcaaccatgttcccgggcattgctgatcgtatgagcaaggagatcactgcccttgctccgagcagcatgaagattaaggttgttgcaccacctgagcggaagtacagtgtctggatcggagggtcgatcctagcctcactcagcactttccaacagatgtggatatcaaaggaggagtacgacgagtctggcccagcaattgttcataggaagtgcttctaagtttctcaagtgctgcttcactgtcatctagtcgtgtctggttcaattctctagaaatgtgttgcagatttgttgcatactatgtctattttcttcagagttcagaccatgagtcttctctggaataggacccccttgtatgctgtggcttcatgtgctgtgttgtatcacctggtttgagatgagttttcaaacttgcttggcttgattagttggagctgtaagctgatagttctataaattacttgggatatgcttctgt

SEQ ID NO: 34451 - protein, 222 aa, Panicum virgatum
  misc_feature: Ceres CLONE 1956261
  misc_feature (1)..(222): Pfam Name: Actin Pfam Description: Actin
  misc_feature: Functional homolog of the protein sequence given in SEQ ID NO 50712
  misc_feature: Useful for making plants with modulated biomass
  misc_feature: Functional homolog of the protein sequence given in SEQ ID NO 50711
  misc_feature: Useful for making plants with modulated flowering time
DSGDGVSHTVPIYEGYALPHAILRLDLAGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWISKEEYDESGPAIVHRKCF

SEQ ID NO: 34452 - DNA, 959 bp, Panicum virgatum
  misc_feature: Ceres CLONE 1956264
  misc_feature: Encodes the peptide sequence at SEQ ID NO. 34453
gctcgctccgtcgcccgcccgaagcaaagcaagagagttgagttgagttgagtcaccggttgcagccatgagtaagttgcaatccgaggttctcaaggatgccatctcccagattgttggggatgccaaagagaagaataggaagttcaccgagaccgttgagcttcagattggtctgaagaactatgacccgcagaaggacaagcgtttcagtggctctgttaagctccctcacatcccccgcccaaagatgaaggtgtgcatgcttggtgatgcccagcacgttgaggaggctgaaaagattggacttgactacatggatgtcgaggcgctcaagaagatgaacaagaacaagaagcttgtcaagaagcttgccaagaagtaccatgctttcttagcatcagaggccatcatcaagcagattccccgtctccttggtcctggtctcaacaaggcaggcaagttccctacactggttacccaccaggagtctcttgaatccaaagtgaacgagacaaaagctacagtcaagttccagttgaagaaagttctttgcatgggtgttgctgtgggtaacctgtccatggaggagaagcagatccagcagaacatccagatgagcgtcaacttccttgtgtcccttctgaagaaaaactggcagaatgtgagtgatgagtttctaattaagtctgtaatagtactgttcctgttccagataataatttagaacgcaagtggaagtaccaggttataacatgatgtgatttttattttccaggtgagatgcctgtacatcaagagcaccatggggaagccatacagggtgttctaagtcttgccgcgatccttgtgaagttgataaaaatactaggccacaccagctgggctggtctcgaaacttagatttgtacccatcagttttgtgcctatcaatgagaatgttgaagtatttggtcctc

SEQ ID NO: 34453 - protein, 219 aa, Panicum virgatum
  misc_feature: Ceres CLONE 1956264
  misc_feature (8)..(208): Pfam Name: Ribosomal_L1 Pfam Description: Ribosomal protein L1p/L10e family
MSKLQSEVLKDAISQIVGDAKEKNRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVSDEFLIKSVIVLFLFQIII

SEQ ID NO: 34454 - DNA, 873 bp, Panicum virgatum
  misc_feature: Ceres CLONE 1956271
  misc_feature: Encodes the peptide sequence at SEQ ID NO. 34455
cttcgcccgccgccgcctcccccgtcctcctcgccgccgtagactaggttaggctagggtttcgacgagctcgcggaaatggtggccttcaggttccatcaataccaggtggtggggcgtgcgcttccgacgcctggcgatgagcaccccaagatctaccgcatgaagctctgggccaccaacgacgttcgcgccgagagcaggttctggtacttcctgaggaacctcaagaaggttaagaagagcaacggccagatcctcgccatcatcgagatcttcgagcgtaacccaactacgatcaagaactacggcatctggctccgmtaccagagcagaaccggctaccacaacatgtacaaggagtaccgtgacaccwccctgaacggtgcagtggagcagatgtacaatgagatggcttcacgccaccgcgtgagggccccctgcatccagatcatcaagaccgcgacggtccacttcaagctgtgcaagagggacaacaccaagcagttccacaactccaagatcaagttcccccttgtgtcccgcaagatcaggcccccaaccaggaagctgaagaccacgttcaaggcatcaaggccgaacctgttcatgtgattcagctgtgcctgtgttgtgggtcagtgtttgggagcataagagtccgtaagttttatgttttaagttttgacttgcttagacctcagtggttgatgattcatcttgttttgaaacgtgcttggtgaaccatttgagtatccaattatgagtagttggaaagatttcaatagtactggtgatatgttcgcagacggtctgtattatttccatgattttttttctttctgttgattatcacggcaccgattgtgtacg

SEQ ID NO: 34455 - protein, 178 aa, Panicum virgatum
  misc_feature: Ceres CLONE 1956271
  misc_feature (5)..(178): Pfam Name: Ribosomal_L18ae Pfam Description: Ribosomal L18ae protein family
  misc_feature (100)..(100): Xaa is any aa, unknown, or other
MVAFRFHQYQVVGRALPTPGDEHPKIYRMKLWATNDVRAESRFWYFLRNLKKVKKSNGQILAIIEIFERNPTTIKNYGIWLRYQSRTGYHNMYKEYRDTXLNGAVEQMYNEMASRHRVRAPCIQIIKTATVHFKLCKRDNTKQFHNSKIKFPLVSRKIRPPTRKLKTTFKASRPNLFM

SEQ ID NO: 34456 - DNA, 609 bp, Panicum virgatum
  misc_feature: Ceres CLONE 1956272
  misc_feature: Encodes the peptide sequence at SEQ ID NO. 34457
ctttatcacatggcaaagttcattcagatgctaatttggacaacggaaccatcaaggaggatgacaaagcagtattacttgaaggaggccagtcaaaatcaccatctacaaagttcaggaacttgtctaccaaagccaatttgatacggtttataacaatggacgagtcttttctgcttgaaaaccgtgctgtgctgagagccatggctgaatttagcattgttctggtctatttttatatttgtgaccggacaaacatatttccagaaagcaagaagagctacaaccgtgatctgtttctgtttctgtacattcttcttatcatagcgtcagcgcttacttcacttaagaagcaccatgaaaaatcagcatttactgggaagtccatactctatcttaaccgccaccaaactgaggaatggaaagggtggatgcaggtcttatttctgatgtaccactattttgctgcctcagaaatatacaatgcaattcgtgtgttcattgcttgctatgtctggatgactggatttgggaacttctcatattactatatcaagaaagattttagtattgcaagatttgctccgatgatactgttgaggcttacga

SEQ ID NO: 34457 - protein, 202 aa, Panicum virgatum
  misc_feature: Ceres CLONE 1956272
  misc_feature (77)..(202): Pfam Name: Cas1p Pfam Description: Cas1p-like protein
LSHGKVHSDANLDNGTIKEDDKAVLLEGGQSKSPSTKFRNLSTKANLIRFITMDESFLLENRAVLRAMAEFSIVLVYFYICDRTNIFPESKKSYNRDLFLFLYILLIIASALTSLKKHHEKSAFTGKSILYLNRHQTEEWKGWMQVLFLMYHYFAASEIYNAIRVFIACYVWMTGFGNFSYYYIKKDFSIARFAPMILLRLT

SEQ ID NO: 34458 - DNA, 803 bp, Panicum virgatum
  misc_feature: Ceres CLONE 1956285
  misc_feature: Encodes the peptide sequence at SEQ ID NO. 34459
ttagaggagaaaccctaccccgcgcagccgccgccgccgcttcgtcgaactccggcgcgtgcccgagcctcgccagtcgctgccgccatgtctctgatcgcgggggaggacttccagcacatcctgcgtctgctcaacaccaacgtggatggcaagcagaagatcatgttcgcgctcacctccatcaagggtgtcggccgccgcttctccaacatcgtctgcaagaaggccgacatcgacatgaacaagcgggctggtgaactgaccccagatgagcttgagcgcctcatgactgtggttgccaacccccgccagttcaaggtccctgactggttcctcaacaggaagaaggattacaaggatggtaggttctcccaggtcgtttctaacgctctcgacatgaagctcagggatgaccttgagagactgaagaagatcaggaatcaccgtggtctgcgtcactactggggccttcgtgtccgtggccagcacaccaagaccaccggaaggcgtggaaagactgttggtgtgtcgaagaagagataagccccatgtcgatgcgccttgtattggcttggcctagtttgtgtcgagtacgcggacctttgtgctgtgttttgctgaaggatatgtttatctctaggattgatggtgagctgtttgggttcatgaatacttgtagcgactcctttggcgcctatgttcgttcgaagcacggattgaatttcagtgttctgtgaaaaacaatgaagttttgcctgtttggaaaaagcatcctatgtcctttcgtgggtcttttcggc

SEQ ID NO: 34459 - protein, 152 aa, Panicum virgatum; identical to SEQ ID NO: 15321
  misc_feature: Ceres CLONE 1956285
  misc_feature (14)..(142): Pfam Name: Ribosomal_S13 Pfam Description: Ribosomal protein S13/S18

SEQ ID NO: 34460 - DNA, 714 bp, Panicum virgatum
  misc_feature: Ceres CLONE 1956291
  misc_feature: Encodes the peptide sequence at SEQ ID NO. 34461
atcacgcaacagcagcgaagcagccaaccaacctggccagcccggccatggatttccgaaagaaaggcagccgcgggcgaatcaccggagaaatgccagccgggttccagccacaacccttcgtctccaaggctcgcccccctaccaaccctgcccccgccttactgtatataacagccgccgaagtcgatcccttctcctccatccgcaaacgcaagcttcacgcacagcctctctccccgcagcttctccgccgggcttcacctgcgaacccgcctcgatcgatcagcgttccacgcggagcaggcagatggccgccacgatgaagctccggatcctcgccatcgccgtcgccgccgcgtcgtgcctggtcgcgaccgccgccgcggccgagggcccggcgcccgccccgacgtccggcgcgccgtccatggccgcgccggccgttgctgccgcgtccctgaccgcgctcgtcttcggctacctcttctaagaagtgccgtggacggcgttgcctgtagtgccaaatcgttttcctgctcagagatttcttcttctcgttgctgtctttgctcttgttggtgtggatgatgggtatgtaattaagtgttcttttttttatatgaatcttgtaatctcagtacaaggacatagtaaatagagagagctgcagtttggttctttttttacacaatggtgacaaaagctgaccgg

SEQ ID NO: 34461 - protein, 60 aa, Panicum virgatum
  misc_feature: Ceres CLONE 1956291
  misc_feature: Functional homolog of the protein sequence given in SEQ ID NO 50452
  misc_feature: Useful for making plants with altered carbohydrate content
  misc_feature: Functional homolog of the protein sequence given in SEQ ID NO 50546
  misc_feature: Useful for making plants with altered cell wall content and/or composition
MAATMKLRILAIAVAAASCLVATAAAAEGPAPAPTSGAPSMAAPAVAAASLTALVFGYLF

SEQ ID NO: 34462 - DNA, 917 bp, Panicum virgatum
  misc_feature: Ceres CLONE 1956292
  misc_feature: Encodes the peptide sequence at SEQ ID NO. 34463
agccagaaccctagcctcgctgccatggccgcctccatgctccgctccggccaccgactcttcctccgccgccagcgcctctctgcagcattctccaccgcctcggccgaggagctcatcgacgtccgcaagcttcccaccgactacgacccctccacctttgacccatcctccccgtcccggccgcctccgtccgaccgcgtgtggcgcctcgtcgaggacgtctcctccctcacccttgcggagtccgccgctctctcctctctccttctccgccgccttgacataccctcggcaccccccatcgccatcctcaactccgctgcggggcttggcggcggcggcacggccggcgcggctggagagaaggctgcggcggcagccgagaagacggtcttcgagctgcggctggaggcgttcgacgcggcgagcaagatcaaggtgatcaaggaaatccggacgttcactgacctggggctgaaggaggccaaggagctggtggagaaggcgcctgcggtgatcaaggacggcgtatccaaggaggatgctgaggcgatcgtcgagcggatgaaggctgttggagccaaggtcgtcatggactgatcggagcatgccattcacgggtgagatcctgcaaatttatgctccatttcaggtcaactttaaagtgcaaggatgcgagtgtcacagtgaaattgtggacttggagtgtgtttagtcgaatgtgttgtgatctttgaatgtgtcattgtatcgtatctataactcagtcatcgtgtagtgggattgggacataagttgtgagctagttggacaaaaacaaattagtgcattgctatttgctatgatgattttgtgaacttgcagctgtcgagttgaaataacctagtaacttagtggttaacattttgctcttc

SEQ ID NO: 34463 - protein, 192 aa, Panicum virgatum
  misc_feature: Ceres CLONE 1956292
  misc_feature (125)..(192): Pfam Name: Ribosomal_L12 Pfam Description: Ribosomal protein L7/L12 C-terminal domain
MAASMLRSGHRLFLRRQRLSAAFSTASAEELIDVRKLPTDYDPSTFDPSSPSRPPPSDRVWRLVEDVSSLTLAESAALSSLLLRRLDIPSAPPIAILNSAAGLGGGGTAGAAGEKAAAAAEKTVFELRLEAFDAASKIKVIKEIRTFTDLGLKEAKELVEKAPAVIKDGVSKEDAEAIVERMKAVGAKVVMD

SEQ ID NO: 34464 - DNA, 911 bp, Panicum virgatum
  misc_feature: Ceres CLONE 1956299
  misc_feature: Encodes the peptide sequence at SEQ ID NO. 34465
agttccctctccctctcgctctccccgcgccgccgccgccgcccagtcccacctctccgtgcccaggatgtggggaagcaccgacggcggcactccggaggtcaccctcgagacctccatgggcgccatcacagtcgagatgtactacaagcacgcgcccaagacctgccggaacttcgtcgagctcgcgcgccgcggctactacgacaacgtcatcttccaccgcatcatcaaggatttcattgtgcaaggtggggatcctacgggaaccggcagaggtggtgagtccatctacggagcaaagtttgaggatgagataaagtcagagttgaagcacactggggctggaattctgtccatggcgaacgctggtccaaatacaaatgggagccagttcttcataactctcgcgccttgtcagtcacttgatggaaagcatacaatattcgggagggtatgcagaggaatagaaattgttaagcgccttggaagtgtgcagactgacaaaaatgataggcccatccatgaagtgaaagtccttcgagccatcattaaagattgaatcatcacgtgcagttctagtttggcgaggcgaaatgtgtttgtgttagcttaggtttaatggtcctgcaagcggtgccactctggaaaagattgagaagctgcatggttcccggcttgtacgacggccaagtgacgaatctcatctgcctgacctgaaaagctaccttatcagtagatgattatgttgcgggcacattgtattagcatggagttaaagcggcgacatacatggcttcctgatctctactatgctgtgttgtgttgtgtttgtctcacgaatatcaataatattgcctactagaatatgcggttttctttttctttttttaaaaaaagttgctgactgg

SEQ ID NO: 34465 - protein, 164 aa, Panicum virgatum
  misc_feature: Ceres CLONE 1956299
  misc_feature (11)..(163): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MWGSTDGGTPEVTLETSMGAITVEMYYKHAPKTCRNFVELARRGYYDNVIFHRIIKDFIVQGGDPTGTGRGGESIYGAKFEDEIKSELKHTGAGILSMANAGPNTNGSQFFITLAPCQSLDGKHTIFGRVCRGIEIVKRLGSVQTDKNDRPIHEVKVLRAIIKD

SEQ ID NO: 34466 - DNA, 683 bp, Panicum virgatum
  misc_feature: Ceres CLONE 1956300
  misc_feature: Encodes the peptide sequence at SEQ ID NO. 34467
atcgatattccggctcctgcgactgagaaaagccagctgccaaccgtagtagtaaagctcagcttcatcctttctggttcgagtgagtgtggagatggcaccgtctcgccgcatggccgcgcccatcctcttcctcgtgctcctcctcgtcgccacagagatggggacgatgaaggtggcggaggcgaggcactgcctgtcgcagagccacaggttcaagggcgtgtgcgtgagcagcaacaactgcgccaacgtgtgcaggacggagaacttccccgacggcgagtgcaagtcccagggcctcgagcgcaagtgcttctgcaagagagtctgctagcaagtgcacgccgctcggttatgtcctgccattacgtcgtttgtgattgttcgttcttgctgctgcagtacgtcgtgtctagtttcgttcgtcatccgctcggttacgtccgggcgtgtgtgtgtttgtttcccccctttggtttcttgcctcgttcctgccttcctggaataaaaactgcctgcgcgcgggaacatctcgatgttgttctgaattcgtagctggcagcatgttggtcctagttttagtttcgttaggttgactacttagtttctcgcggatcctgtttgttcttgaagctgtaaggccctgaaatttcagtaataaggttgtaatgtgtcattgg

SEQ ID NO: 34467 - protein, 80 aa, Panicum virgatum
  misc_feature: Ceres CLONE 1956300
  misc_feature (32)..(80): Pfam Name: Gamma-thionin Pfam Description: Gamma-thionin family
MAPSRRMAAPILFLVLLLVATEMGTMKVAEARHCLSQSHRFKGVCVSSNNCANVCRTENFPDGECKSQGLERKCFCKRVC

SEQ ID NO: 34468 - DNA, 357 bp, Panicum virgatum
  misc_feature: Ceres CLONE 1956314-R
  misc_feature: Encodes the peptide sequence at SEQ ID NO. 34469
atcctgcaatttggtaagatagaggacgatgcgttcacgatggactaccgtcagcctctgtcagccttccaggcgtttgccatttgcctcaccagctttggcacgaagctggcttgtgaataagtgactcgggttgtttaccttgttatatgggtgggtgggggtcaaaatgtagctggtagtttgaactagttgccctgagctgggagaaaaaggcgacaagaaagagtgggcacatgttgcccctaacttgacggttttcttgtgatcgcctaatgatttgagttatatcgatgtgcgtctatgttgtttatgagatgatgacttatttttatataaatgttgccccccttttgg

SEQ ID NO: 34469 - protein, 40 aa, Panicum virgatum
  misc_feature: Ceres CLONE 1956314-R
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 462 in the 10/666,642 US patent application
  misc_feature: The sequence is a functional homolog of SEQ ID NO 458 in the 10/666,642 US patent application
ILQFGKIEDDAFTMDYRQPLSAFQAFAICLTSFGTKLACE

SEQ ID NO: 34470 - DNA, 652 bp, Panicum virgatum
  misc_feature: Ceres CLONE 1956314
gcaaaaaaaaaaaacactttttccccgcaccctcccgctcgcgccaatctccttccccatctccgtctagaatcttcgagaaccttcggggggcggagatcggcgcccccggccgcccggcgatggtctcctggcggcgcagcgcgtcctggctgtcgtctgcctcccgctcctcgctcggcggcgccgtcggcggggtggcgaaggtcacgccggaggtggatccggcggcccaggaggtggtggaggaggaggaggaggtcgacgaggagcggtggtcgcgcctgctcccggagctgctcacggagatcgtgcggcgcgtccacgccggcgccgagcggtggccactgcggcgggacgtggtggtctgcgcctgcgtatgccggcggtggcgggacgccgcgttctcggtggtgcgaccgccgctcgagggtgggaggatcaccttcccgtcgtcgctcaagcagcctggacccagggatgcaccgatgcactgctttatcaggagggacaaaaagaactcaaccttttctctccacctcagcttaacgcaggccctaacggataaagggaagtttcttttggctgctcgaaggttcacacaaggagcacatacagaatatatcatctcttatgactatgatgatctttc

SEQ ID NO: 34471 - DNA, 828 bp, Panicum virgatum
  misc_feature: Ceres CLONE 1956318
  misc_feature: Encodes the peptide sequence at SEQ ID NO. 34472
aatccgccttccccaatctctcgccctccttcccccgtgcgccgcagctagaaagctagggtttcgcctgcgatccgatccgtcgagtccacactccccacccgatcgatggcggccgagggcgagaagaagatgatcacgctcaagagcttcgacggcgaggagttcgaggtggaggaggcggtcgccatggagtcgcagaccatccgtcacatgatcgaggacgactgcgccgacaacggcatcccgctccccaacgtcaactccaagatcctctccaaggtcatcgagtactgcaataagcacgtccacgccgcagccgccgcggccgccgcgtccaaggcaggctccgacgacgcgggggctgccgccgccaacagcaacgccgcctccggcgaagacctcaagaactgggacgccgacttcgtcaaggtcgatcaggccacgctgttcgacctcatcttggctgcaaactatctcaacatcaaggggctgctggacctgacctgccagactgttgctgacatgatcaagggtaagactcctgaggagatccgcaagaccttcaacatcaagaacgacttcacccctgaggaggaagaggagatccgcagagagaaccagtgggccttcgagtagagaggtgcttgagctcctgatgcctaggctttgtcgtacctatgcaatgcctgcttttatgtgtcgtcgtaatggttgtaagtattttgggagtcgctgcggtgttgggtaaaactggtcggttattctaaacaaatttatctctagtatatcatgacaagactaagtggctgctgccctaagaggttt

SEQ ID NO: 34472 - protein, 176 aa, Panicum virgatum
  misc_feature: Ceres CLONE 1956318
  misc_feature (99)..(176): Pfam Name: Skp1 Pfam Description: Skp1 family, dimerisation domain
  misc_feature (8)..(68): Pfam Name: Skp1_POZ Pfam Description: Skp1 family, tetramerisation domain
MAAEGEKKMITLKSFDGEEFEVEEAVAMESQTIRHMIEDDCADNGIPLPNVNSKILSKVIEYCNKHVHAAAAAAAASKAGSDDAGAAAANSNAASGEDLKNWDADFVKVDQATLFDLILAANYLNIKGLLDLTCQTVADMIKGKTPEEIRKTFNIKNDFTPEEEEEIRRENQWAFE

SEQ ID NO: 34473 - DNA, 702 bp, Panicum virgatum
  misc_feature: Ceres CLONE 1956330
  misc_feature: Encodes the peptide sequence at SEQ ID NO. 34474
actctgagacactcgcaccctcccgcgcacgcgcccggcgcacaccgtaccatggccgcggcggcttccgcttcactgctccgcctcgccaccccgatccgctcgccgcgccccggcctcccttgccacgccgccgcgcggccgcggggcgcgcgcctggcgccagcgcgggcgtacaaggtgacgatcgagcacggcggcgagtcccgcgtggtggaggtggaggaggacgagaccatcctgtcccgcgcgctggacgagggcctggacgtgccgcacgactgcaagctcgacgtgtgcatgacgtgcccggcgcggctggtcgccggggaggtggaccagagcgacggcatgctcagcgacgacgtcgtggcgcagggctacgcgctgctctgcgccgcgtacccgcgctccgtctgcaccatccgcgtcatccccgaggacgagctgctccaggtccagctcgccaccgccgacgactgatggcgccccgccggcggcgagcaggccgaccgggcaacagcctccggcagcgtgtaataataatgatccgagacttgtacacctctgtcgattagctctagggacacaaactttttctgagaatggttagtgcagtatgcctctttgctaaatttcttgtcagttctgtgtgagaagtaagaattttgatggaaataggaaaatccatcatttggctat

SEQ ID NO: 34474 - protein, 143 aa, Panicum virgatum
  misc_feature: Ceres CLONE 1956330
  misc_feature (46)..(121): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase
MAAAASASLLRLATPIRSPRPGLPCHAAARPRGARLAPARAYKVTIEHGGESRVVEVEEDETILSRALDEGLDVPHDCKLDVCMTCPARLVAGEVDQSDGMLSDDVVAQGYALLCAAYPRSVCTIRVIPEDELLQVQLATADD

SEQ ID NO: 34475 - DNA, 731 bp, Panicum virgatum
  misc_feature: Ceres CLONE 1956333
  misc_feature: Encodes the peptide sequence at SEQ ID NO. 34476
ctgatctactaccatcccctcgcgaaaaccctagcagctcggcgccgcctccccgctctccaaccccccctcaggtccccccccctttcgcggttggccgggccctcgcagcgcgggagatggcggatcaggagaccccggttgcagtggaggcaccgacccctgttcttggggagccgatggacttgatgactgctctgcagctcgtcatgaagaagtctggtgcccatgatggcctcgtaaagggtcttcgtgaggctgccaaggccattgagaaacatgctgctcagctctgcgtgcttgctgaggactgtgaccagcctgattatgtcaagctggtgaaggctctctgtgctgagcacaatgttcacctggttactgtgcctagtgctaaaactcttggcgagtgggcagggctttgcaagattgactctgaggggaaggcaaggaaggttgtaggctgctcatgtgtggttgtcaaggactacggcgaagaatcagagggccttaacatagtgcaggagtacgtcaagtcgcactagatacagtgttgtttccaaatctacattttaggcctgagtttggaattgtgctttgtttctgggcttgctaggagattagatagaacaattttcaagtgcaagcgaagattgatgtgaacgatctggatatctcaactcttgttttaagtgatggttatctgcttttaatacaaatctccaagagctggt

SEQ ID NO: 34476 - protein, 140 aa, Panicum virgatum
  misc_feature: Ceres CLONE 1956333
  misc_feature (25)..(120): Pfam Name: Ribosomal_L7Ae Pfam Description: Ribosomal protein L7Ae/L30e/S12e/Gadd45 family
MADQETPVAVEAPTPVLGEPMDLMTALQLVMKKSGAHDGLVKGLREAAKAIEKHAAQLCVLAEDCDQPDYVKLVKALCAEHNVHLVTVPSAKTLGEWAGLCKIDSEGKARKVVGCSCVVVKDYGEESEGLNIVQEYVKSH

SEQ ID NO: 34477 - DNA, 872 bp, Panicum virgatum
  misc_feature: Ceres CLONE 1956335
  misc_feature: Encodes the peptide sequence at SEQ ID NO. 34478
aaaaaacaagagagagaaggcgtctctctctctctctcctctctcgccgtccccagcctctcgtcttcgctgcctgcgaacgcctttgcttctccgcgtgaaatttttcggtcgaattttttttccggcctccgctctgatcagatcggcgcgggagttcgtcatggcatcgaagcgtatcctgaaggagctgaaggacctgcagaaagatccccccacatcatgcagtgcaggccctgctggtgaggacatgtttcattggcaagcaacaattatgggaccgcctgacagtccctatgctggtggtgtgttcttagtgaacattcatttcccgccagactaccccttcaaaccaccaaaggtgtctttcaagacaaaggtcttccatccaaatatcaacagcaatgggagtatatgccttgacattcttaaagagcagtggagccctgctttgacaatttctaaggtcttgctctccatctgctccctgctgactgaccccaacccggatgaccctcttgtccccgagattgctcacatgtacaagacggaccggtcgaagtatgagtcgacagcccgcagctggacacagaagtacgcgatgggctgacaaagcacctctgcagctcaatctgcgacggctctcgtgccgtctcaagaaattgtccgtgggccattatttccttcggtttgtcgctggttgtgtgtatccccgatccatctaggatcgtattgtagtcgatgtccacctaccacccttgccatccatagtgagatggtcggacatgctttggctatgcacctatgcttgctgggaaaccttccttcgggtcggtgctattcggtaaatgttaatcgaagacatttatttc

SEQ ID NO: 34478 - protein, 148 aa, Panicum virgatum; identical to SEQ ID NO: 12470
  misc_feature: Ceres CLONE 1956335
  misc_feature (5)..(142): Pfam Name: UQ_con Pfam Description: Ubiquitin-conjugating enzyme
  misc_feature: SWISSPROT Homolog: EC 6.3.2.19 Ubiquitin--protein ligase
  misc_feature: Functional homolog of the protein sequence given in SEQ ID NO 50118
  misc_feature: Useful for biocontainment applications

SEQ ID NO: 34479 - DNA, 1256 bp, Panicum virgatum
  misc_feature: Ceres CLONE 1956338
  misc_feature: Encodes the peptide sequence at SEQ ID NO. 34480
atccacaagagaagaagaaacaagcaagtagcaatactctcttctcttgtaacatagcgcagcaaaggttactcacttacatggcaacttccatgggttggctcgtcttgctctgccttgtttctcccctcctccttgccagtgccgtccacggccacccatggggcggcttgttccctcagttctacgaccattcatgccccaaggcgaaggagattgtgcagtccattgtagcacaggctgtggccaaggagaccaggatggcggcatccttggtcagattgcatttccatgactgctttgtcaaaggctgtgatgcatccgtgctgttggacaacagcagcagcatagtcagtgagaaagggtctaaccccaaccggaactctctcagggggtttgaggtggtcgaccagatcaaggccgctctcgaggctgcctgcccaggcactgtctcctgcgccgacatcctcgcccttgcagcccgtgactcaactgtcctggttggtggcccatactgggatgtgccacttggccggagggattcgctcggtgcaagcatccagggttccaacaacgatatcccagcccccaacaacaccctcccaaccatcattaccaagttcaagcgccaaggcctcaacgttgtggatgtcgtcgctctctctggtggccacaccataggtatgtctcggtgcaccagcttccggcagaggctgtacaaccaaacgggcaatggcatggctgacagcacactggatgtatcgtacgcggcacagttgaggcaggggtgcccccgctctggtggtgacaataacctcttccccttggacttcgtcaccccagccaagtttgacaatttttactacaagaacctcctggctggcaagggcctcctcagctctgatgaggttctgttgaccaagagcgccgagacagcagcactcgtgaaggcatatgctgctgatgtcaatctcttcttccagcactttgcacagtctatggtgaacatgggcaacatctcaccactaaccgggtcacagggtgagatccggaagaactgcaggaggctcaacagcgaccactgaggttgctttatgtgctgaaattgtatctgatgttggtgatataatttgttcaaataagcaagcatggctatgattttatcagatgtttgatcttatgtttttatttaaacacattgtaaaatgtgtatctattaataagtcaatatataagatgagttgatttggttgtct

SEQ ID NO: 34480 - protein, 334 aa, Panicum virgatum
  misc_feature: Ceres CLONE 1956338
  misc_feature (47)..(295): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51032
  misc_feature: Useful for making plants with altered carbohydrate content
  misc_feature: Functional homolog of the protein sequence given in SEQ ID NO 51033
  misc_feature: Useful for making plants with altered cell wall content and/or composition
  misc_feature: Functional homolog of the protein sequence given in SEQ ID NO 51034
  misc_feature: Useful for making plants with modulated nitrogen use efficiency
  misc_feature: Functional homolog of the protein sequence given in SEQ ID NO 51417
  misc_feature: Useful for making plants with modulated oxidative stress sensitivity
  misc_feature: Functional homolog of the protein sequence given in SEQ ID NO 51035
  misc_feature: Useful for making plants with modulated light quality response
MATSMGWLVLLCLVSPLLLASAVHGHPWGGLFPQFYDHSCPKAKEIVQSIVAQAVAKETRMAASLVRLHFHDCFVKGCDASVLLDNSSSIVSEKGSNPNRNSLRGFEVVDQIKAALEAACPGTVSCADILALAARDSTVLVGGPYWDVPLGRRDSLGASIQGSNNDIPAPNNTLPTIITKFKRQGLNVVDVVALSGGHTIGMSRCTSFRQRLYNQTGNGMADSTLDVSYAAQLRQGCPRSGGDNNLFPLDFVTPAKFDNFYYKNLLAGKGLLSSDEVLLTKSAETAALVKAYAADVNLFFQHFAQSMVNMGNISPLTGSQGEIRKNCRRLNSDH

SEQ ID NO: 34481 - DNA, 1360 bp, Panicum virgatum
  misc_feature: Ceres CLONE 1956346
  misc_feature: Encodes the peptide sequence at SEQ ID NO. 34482
aattcgaaatcgaatcgagtcggtcgggcgtgcgtgcgtgcgcgagcgattcgcctgcacaacccccccccccccccccccccgctcctcctcctcaccccaccccgccgccgccagctcgccccctagggttccgccgcgatgtctctccggccgagcgagcgggagcagatgcggaagggcaactacaagcagtcggtggacgcggacgagagccgccgccgccgcgagagtcagatggtgggcatccgcaaggccaagcgcgaggagagcctccaaaagaggcgccacgtcgggttccccgcctccgctgccggcgccgtgccggcgggacactcctcggcgctccagcagaagctcgagggattgccggcgttggtgcaggcggtgctctccaacgaccccaacgtgcagctggaggccaccacgcagttcaggaagctgctctccatcgagcgtagtcctccaattgaagaggttatcagcacaggagtggtgcctcggtttattgagttcctcacacgtgaggaccatccccaactccagtttgaggctgcttgggcactcaccaacattgcatctggcacatcagagaacaccaaggtggtggttgagagtggtgctgtgcccatctttgtcaagctcctcaactcccacagcgaggatgtccgcgagcaggctgtatgggctctagggaatgttgctggtgactccccaaaatgccgtgatctcgtgcttggccacggtgggttattccctttgctgcagcagcttaatgagcatgccaaactctcaatgctcaggaatgccacatggactctatccaacttctgccgtgggaagccacaaccaaacttcgatcaggtcaaaccagctctgtcagcactgcagcgtctcatccactctcaggatgaggaggtcctaactgatgcctgctgggctctctcatacctctctgatggaactaatgacaagatccaagctgtgatcgaatctggcgtgttcccacgccttgtagaacttctaatgcacccttcggcctcagtgctcattccagctctgcgcaccgtgggcaacattgtaactggggatgatttgcagactcagtgtgtcatcgatcaccaagcgcttccatgccttttaaacctcttgactaccaaccacaagaaaagcatcaagaaagaagcatgctggaccatctcaaacatcacagctggtaacaaggaacagattcaggctgtgatcaatgcgaacataattgcacctctggtgcatcttctgcaaactgctgaatttgacatcaagaaagaggctgcctgggcaatttcaaatgccacttctgtggcacacatgatcagat

SEQ ID NO: 34482 - protein, 406 aa, Panicum virgatum
  misc_feature: Ceres CLONE 1956346
  misc_feature (106)..(147): Pfam Name: Arm Pfam Description: Armadillo/beta-catenin-like repeat
  misc_feature (149)..(189): Pfam Name: Arm Pfam Description: Armadillo/beta-catenin-like repeat
  misc_feature (191)..(232): Pfam Name: Arm Pfam Description: Armadillo/beta-catenin-like repeat
  misc_feature (234)..(273): Pfam Name: Arm Pfam Description: Armadillo/beta-catenin-like repeat
  misc_feature (275)..(315): Pfam Name: Arm Pfam Description: Armadillo/beta-catenin-like repeat
  misc_feature (317)..(358): Pfam Name: Arm Pfam Description: Armadillo/beta-catenin-like repeat
  misc_feature (360)..(400): Pfam Name: Arm Pfam Description: Armadillo/beta-catenin-like repeat
  misc_feature (4)..(97): Pfam Name: IBB Pfam Description: Importin beta binding domain
MSLRPSEREQMRKGNYKQSVDADESRRRRESQMVGIRKAKREESLQKRRHVGFPASAAGAVPAGHSSALQQKLEGLPALVQAVLSNDPNVQLEATTQFRKLLSIERSPPIEEVISTGVVPRFIEFLTREDHPQLQFEAAWALTNIASGTSENTKVVVESGAVPIFVKLLNSHSEDVREQAVWALGNVAGDSPKCRDLVLGHGGLFPLLQQLNEHAKLSMLRNATWTLSNFCRGKPQPNFDQVKPALSALQRLIHSQDEEVLTDACWALSYLSDGTNDKIQAVIESGVFPRLVELLMHPSASVLIPALRTVGNIVTGDDLQTQCVIDHQALPCLLNLLTTNHKKSIKKEACWTISNITAGNKEQIQAVINANIIAPLVHLLQTAEFDIKKEAAWAISNATSVAHMIR

SEQ ID NO: 34483 - DNA, 623 bp, Panicum virgatum
  misc_feature: Ceres CLONE 1956346-R
acactgagatatatgagaaggcagtcaagatgcttgaatcctactggttggaggaggaagatgatgccatgccctcaggtgaaaatcctcagaatggcttcaacttcgggaaccagccttctgttccatcgggtggattcaactttggctgaagatccccatttggaatggcgactgccattgtaccttggctggggctagtcggaggtgcggtttggggtagtcgtgttgtccaagtcatggtatggtcccattggtctggtctcagggagtcgtcgaagtcagtcccagtcaacagggtcagtccgcgggctgcatcaccagtggtgcagcttggtcagtggtcagtcttcaaggtcagccggttggatcatttgggctctggctcccaccaccacctgtggtggggagcatggagagtcgcaggtgttgtcgggagtcgggttttgcctcctatatagcatgaatgagttatattgttttacctgtttgaggtagaaagaaccttgaaagatagggaatgtgtcaagttttttctcaaagcgttcctgtgctgtataacttgttgcatgagtattggcacaacttataaaacatgaatgtcaactgggttttgggagtcc

SEQ ID NO: 34484 - DNA, 563 bp, Panicum virgatum
  misc_feature: Ceres CLONE 1956360
  misc_feature: Encodes the peptide sequence at SEQ ID NO. 34485
tgtacctggtaagtattatgaggaactggatactgtctggacagaaggacggcaaggatttgaaggattgcagaaaggatgtgaagaagagcaaaaataaaaaagggagtgacaaaaagagtcggacaaaaagttcaaggaagagcaagtatgactcagattcagaacaggaacgtgacacggaaacaaaaaaaaaaaagaagaacagttcttgccatgattctgaagatgattcagtgactgattatgatgagaagaaggaagagaagcacagcaagaaaactcctcttgtctcagatgatgatgattctgaaactgatcggaagaaggcaaaacgtggaaagaactctcgtcatgattttgagtctgatacagatagtgaatatggcaaaaacaaaacagaacgagcaaagaacactcgtgatgagagaaagaaagtaccagttaaaagatctcgtcatgattctgagtctgatactgataatgagtatggaaagaagaaaacacaacatgcaaagaataatcgtgatgatagaaacaagatacctatgaagaagtctcgt

SEQ ID NO: 34485 - protein, 186 aa, Panicum virgatum
  misc_feature: Ceres CLONE 1956360
  misc_feature: SWISSPROT Homolog: EC 5.2.1.8 Peptidylprolyl isomerase
YLVSIMRNWILSGQKDGKDLKDCRKDVKKSKNKKGSDKKSRTKSSRKSKYDSDSEQERDTETKKKKKNSSCHDSEDDSVTDYDEKKEEKHSKKTPLVSDDDDSETDRKKAKRGKNSRHDFESDTDSEYGKNKTERAKNTRDERKKVPVKRSRHDSESDTDNEYGKKKTQHAKNNRDDRNKIPMKKS

SEQ ID NO: 34486 - DNA, 405 bp, Panicum virgatum
  misc_feature: Ceres CLONE 1956360-R
gtgattcagatgcaggtgtctaagcaaagaagaaacttgaaaagttgtatcatcacaaccctacggaggataagcaagcttcaaaaatcaaagaaaaggcggataactatggaaagtccattgataagcgcaagcgccatgatcccgattcagaatgtgatggttattcccgttataggaaaagccaattgaattcttcagtggcaaaaaaggttgtgccagagaaaagaagagttgctagctcaagcgagagctcggattacagcagcagcctcagcagcagtgagtttgatatgagtgcagatagttatgaggaacagaaaaggagtcatattgtgagtcgaagagatgatctgaatattcagtggcagaaagaggaggtgagatgggtgcttgtttggcttc

SEQ ID NO: 34487 - DNA, 628 bp, Panicum virgatum
  misc_feature: Ceres CLONE 1956379-R
  misc_feature: Encodes the peptide sequence at SEQ ID NO. 34488
tccgccaggctggactaattgtcacctggatcactgatcccatgcacgggaacacgatcaaggctccttgtggcctaaagactcgtcccttcgactccatcttggctgaggtacgagccttttttgatgtgcacgaacaagagggaagtcacccaggaggtgttcaccttgagatgactgggcaaaatgtaactgaatgcattggtggatcacgcaccgtaacttttgatgacctgagcgaccgctaccacactcattgtgacccaaggttgaacgcatcccagtctcttgagctttcattcatcatcgctgagaggctgaggaataggaggatccggtcatcatctatgctcagcaacatcttatccttgccacattttagtttctgaatgggtagaaaatgccaataagagagatgtgtgtattccatttgttggaggttgctcttatgtaaaactatatgcctatgagctatctacgctccgaggtggatttgtttgatttttttatcttttgcatgggtaaatactatgtaatgatacatatgactgcactcgctgacgctaagttttctatttgtaccatgtatatgagaataatcatgcaatatagttgagttggctttgtg

SEQ ID NO: 34488 - protein, 128 aa, Panicum virgatum
  misc_feature: Ceres CLONE 1956379-R
  misc_feature (1)..(103): Pfam Name: DAHP_synth_2 Pfam Description: Class-II DAHP synthetase family
  misc_feature: SWISSPROT Homolog: EC 2.5.1.54 3-deoxy-7-phosphoheptulonate synthase
RQAGLIVTWITDPMHGNTIKAPCGLKTRPFDSILAEVRAFFDVHEQEGSHPGGVHLEMTGQNVTECIGGSRTVTFDDLSDRYHTHCDPRLNASQSLELSFIIAERLRNRRIRSSSMLSNILSLPHFSF

SEQ ID NO: 34489 - DNA, 279 bp, Panicum virgatum
  misc_feature: Ceres CLONE 1956379
ttgccccggccggctccggccgcatataattatccccacccggctcccctccgacggaggagacacagcgcccgccacacgcacgcatcgcctctcctccactacccaaattcttgacattctgttcgcactggcgctcgccacgaacgccgccgccgcggcagccgccttgtccggcgcggccgctcctcagtcccgtctattcgcgccggcgttcctcccagtgacgcgcagctgcgcagtcgccgctgtgcacaccgtgtaggctttcacatgcca

SEQ ID NO: 34490 - DNA, 645 bp, Panicum virgatum
  misc_feature: Ceres CLONE 1956384
  misc_feature: Encodes the peptide sequence at SEQ ID NO. 34491
aagcttcagattagagctgctagcttattaggaagttcatcaccgacatacagtacagtagtagcttaccttgtctcgtcagtccgatccatccatccatggcggcgaagctcgtctacctcttaaccgtcgtgttcttatccatggcgcttctagtgtctctccgcggacagtgcgaagctgctgcgacaagctgccggcgtcgtgtcggcgccggaggaggagctgctgcagcagcgggcagcaggagctccggcggccaggcggggaagaagcagcggcagcggcagcggccgcaggtggaggggatgttcgtgttcgggagctcggtggtggacaacggcaacaacaacttcctcaacggctccggcgtgcgcgccgactacctcccctacggcgtggacttcccgctgggcccctccgggcgcttctccaacggccgcaacgtcatcgacgcgctcggcgagctcctccgcctcccggggctcgtcccacccttcgccgacccgcgcacccgcggccgcgccgccctgcacggcgtcaacttcgcctccggcggctccggcatcctcgaccacaccggccagctcaccggcgaggtggtgagcctgcggcagcagatcagcaacttcgaggcggtgaccc

SEQ ID NO: 34491 - protein, 182 aa, Panicum virgatum
  misc_feature: Ceres CLONE 1956384
  misc_feature: SWISSPROT Homolog: EC 3.2.1.51 Alpha-L-fucosidase
MAAKLVYLLTVVFLSMALLVSLRGQCEAAATSCRRRVGAGGGAAAAAGSRSSGGQAGKKQRQRQRPQVEGMFVFGSSVVDNGNNNFLNGSGVRADYLPYGVDFPLGPSGRFSNGRNVIDALGELLRLPGLVPPFADPRTRGRAALHGVNFASGGSGILDHTGQLTGEVVSLRQQISNFEAVT

SEQ ID NO: 34492 - DNA, 526 bp, Panicum virgatum
  misc_feature: Ceres CLONE 1956384-R
ctgcgagatgtcccggagctcgtcgggcgtgctgtgcaagaagcaagggcccgtgtgcagggaccggacggagtacgtgttcttcgacgggctgcacccgacggacgccgtgaacgccaggatcgcgcgcaagggctacggctccagctcgccggagcacgcctaccccatcaacgtcaagaagctagccatgctgtaggcctaccggataataattaatccttctcttagtaattaattaaattgtgatgagtggattaatctaagccgtgcgtgcatctagctaggttaaataagaattttgtaagtcttatcgctagttcaatggataaaatctagtagccgaacatcatccgagccgccgggtcaatgcgctatatacgggctgaatcgaaagttttggttttatgcccaaggcccgtagtgttttttggattgtacaacggtttggtatgttgtaaggactggtgtttgtaaagaattggccataaagttcatctactatgggcatctttggtttggtacc

SEQ ID NO: 34493 - DNA, 698 bp, Panicum virgatum
  misc_feature: Ceres CLONE 1956399
  misc_feature: Encodes the peptide sequence at SEQ ID NO. 34494
atcccaccgcgacgcgccccctctctctatctccccagagctcgaaaccctaggcgcgcgcggcggcggcgaggaggctggcgatggatccggacgcggtggccaaggccttcgtggggcactactaccagacgttcgacaacaaccgcgccgcgctggtggggctgtaccaggacacctccatgctcacctttgagggcgagaagttccagggcacggccgccatcgccggcaagctcggatcgctccccttccagcattgcgagcaccagatcgtcaccgtcgactgccagccgtccggcccgcaggggggcatgctcgtcttcgtctccggctccatccgcaccggccccgaggagcaccccatcaagttctcccaggcgttccatttgatgccggctggaggtaccttcttcgtgcagaatgacatgttccgcctgaactatggttaaagaaagccaaaaactcttgtgtggagcggagcggttaagggtttcatgttgatttgatgaatatgaatgatgctgctactcttgtctgtttgttggctgttgctttattgcaagaaaattgctagacttggtatgcttgttggataatttatcttattttggatcaaaaaaacgccgccgccgccgccgtctgtctcggtttcctttcgcccccacctcaggccccaaaccccccccccccccaaa

SEQ ID NO: 34494 - protein, 122 aa, Panicum virgatum
  misc_feature: Ceres CLONE 1956399
  misc_feature (6)..(119): Pfam Name: NTF2 Pfam Description: Nuclear transport factor 2 (NTF2) domain
MDPDAVAKAFVGHYYQTFDNNRAALVGLYQDTSMLTFEGEKFQGTAAIAGKLGSLPFQHCEHQIVTVDCQPSGPQGGMLVFVSGSIRTGPEEHPIKFSQAFHLMPAGGTFFVQNDMFRLNYG

SEQ ID NO: 34495 - DNA, 665 bp, Panicum virgatum
  misc_feature: Ceres CLONE 1956399-R
  misc_feature: Encodes the peptide sequence at SEQ ID NO. 34496
acctgggattgtagatggcttgaagctgaagggtttgcctaaaggaagagggttacttctgcttgctgaaatgagctctgctggcaaccttgctcagggagattacactgctgcagctgtaaagattgctgagcagcatcctgactttgtgatcgggtttatatcagtaaatcctgcatcttggtcagtagcaccttcaaacccagcacttatccatgcgacccctggagttcagctggtcgctggaggagatgctcttgggcaacaatacaacactcctcaagctgtcataaacgtcagaggcagtgacatcattatagtcggacgcgggattatcaaagcgggcgatcctgctaagatggcattggagtatcgcctccaggggtggcaatcctaccgcaccagcttgttgtgagcctgtttaaacacccgagtataagggtgcaatccaactgatgtgtaagaagagcacggtcccgtcgtcgctgcgctccatgcccagtaaatggacacacattgtctgctagtgctagttgctacaataataatttccgtaatgttggttccgttcttgttgcttgggtttggtgttgtgatgcctttgctgggtcagacagtatcagaatgtgcactctagctgtgaaactcctgatcaattccgcgcc

SEQ ID NO: 34496 - protein, 137 aa, Panicum virgatum
  misc_feature: Ceres CLONE 1956399-R
  misc_feature (1)..(124): Pfam Name: OMPdecase Pfam Description: Orotidine 5'-phosphate decarboxylase / HUMPS family
  misc_feature: SWISSPROT Homolog: EC 4.1.1.23 Orotidine-5'-phosphate decarboxylase
PGIVDGLKLKGLPKGRGLLLLAEMSSAGNLAQGDYTAAAVKIAEQHPDFVIGFISVNPASWSVAPSNPALIHATPGVQLVAGGDALGQQYNTPQAVINVRGSDIIIVGRGIIKAGDPAKMALEYRLQGWQSYRTSLL

SEQ ID NO: 34497 - DNA, 1403 bp, Panicum virgatum
  misc_feature: Ceres CLONE 1956405
  misc_feature: Encodes the peptide sequence at SEQ ID NO. 34498
gcgagatgcaccaccaataagtgagaactaggtcaagtacagagttggaatgagtagtgcaatcaaggctactagtcctattatccagaagattggcagcccaatggagaccattgctaccacaggcgctgaagattgcccctttgaaccatccctttgggatgatttctttgtcacctacgccccttctatctcccagagatctgagaagtggatgagagagagggcggctcacctcaagaaagaagtacgccatatgtttgatgcccacaatggcctgagtgtgaccaacgcattgatacttgtggatgtgctcgaacgcctcggcatagacaaccacttcaaagaggagatttgtgcggtgttatgccgtgtccacagcgatgagcaagagtttgataactccaaagaactacatattgtggccctcaggtttcgtctgcttaggcaacatggcttttttgtatccacagatgtgttcaacaagttcaaagatggcacgggtaatttcagcacaggtctgaccggggacccaagagggctgctgagcctgtacaatggggctcacatggcagtgccaggtgaggatgtccttgatgatgccatcaccttcaccaggtcccatctaaaggcaatgaaaggcaaccttgggtatccaattgcgggccaggttgcccgtgccctagacatcgcacttcctcgctacatgcctcaacttgagaccatacactacatcattgaatacgagcaagaagacgtgcacaacgcgaccatacttgagcttgcaaggctggactataacctcagaaggtccgcccacctcaaggagcttcggaccttttgctcatggtggaaggatatctatgaggatgtgaagctaccctattctcgggaccgatccgtggagatgtacttttgggcctttggagcgttccaaagggagcacaactctcgtgcgagaatactatattccaagatgaccgcattcataagcctgatggatgacacctatgatgcccacgctacctttgaggagtgtgagtttttcaatgaggctatacaaagatgggatgagagcgcggcttctattctacctgagtatctgcgagtgttttacatcaaaatattaagcacttttaaagaattcgagaatattctcgacccaagtgaaaagtatcgtgtgggttacgtccaaacagcatttaaattgttgtcaaaatattaccttgaggaggccaaatggtgcaatgagaaatacataccgagcttcaaagatcagatagaagtttcctccatgtcatcatccattccagtactagcccttgcggcactgatggctgcgggtgatgaagcaaccaatgaggcagtcgagtgggcaagcggtatacctgacgcggttcacg

SEQ ID NO: 34498 - protein, 451 aa, Panicum virgatum
  misc_feature: Ceres CLONE 1956405
  misc_feature (37)..(236): Pfam Name: Terpene_synth Pfam Description: Terpene synthase, N-terminal domain
  misc_feature (241)..(451): Pfam Name: Terpene_synth_C Pfam Description: Terpene synthase family, metal binding domain
  misc_feature: SWISSPROT Homolog: EC 4.2.3.13 (+)-delta-cadinene synthase
MSSAIKATSPIIQKIGSPMETIATTGAEDCPFEPSLWDDFFVTYAPSISQRSEKWMRERAAHLKKEVRHMFDAHNGLSVTNALILVDVLERLGIDNHFKEEICAVLCRVHSDEQEFDNSKELHIVALRFRLLRQHGFFVSTDVFNKFKDGTGNFSTGLTGDPRGLLSLYNGAHMAVPGEDVLDDAITFTRSHLKAMKGNLGYPIAGQVARALDIALPRYMPQLETIHYIIEYEQEDVHNATILELARLDYNLRRSAHLKELRTFCSWWKDIYEDVKLPYSRDRSVEMYFWAFGAFQREHNSRARILYSKMTAFISLMDDTYDAHATFEECEFFNEAIQRWDESAASILPEYLRVFYIKILSTFKEFENILDPSEKYRVGYVQTAFKLLSKYYLEEAKWCNEKYIPSFKDQIEVSSMSSSIPVLALAALMAAGDEATNEAVEWASGIPDAVH

SEQ ID NO: 34499 - DNA, 634 bp, Panicum virgatum
  misc_feature: Ceres CLONE 1956405-R
cagcagtgaagttggccgtaatcaacctagccaggtcaaatgagatcgtatattgcagaggaaacgatgcctacaccttcaccggcgacctcgagggtctggtgacgtccctcttcctcaagcccgtccccatttaaatgttctctcttaagatggtttaatttgcttggttgtgtgctttgtcatgtttcacgttcacgtgtgtgtcgggtgtggaaggtcgtacatgtgggacgacacggtgcttgtcgtgagtatccccctggaggctggaccaaaaatggggacaccttaacagccttatgtattgtattgttttcttttggatgcatgaagaaatcatggaatggctgccaccagtgtttaagcagcaaaaacatcccacactgtgttttaatcgcgacaaatgtcgatatcataattaagaagcttcagtgtaagaagcttctgaccctcagatgttgtactttggagacggcagctctacatttcttcacttcacatggatactccttcaatatacagattacctttgaatcggtcattgaacttttatttgtatgggtccagcagtaagctattacttgtaataattgtaacaagtctttcgtctttattgagagatggttgaagc

SEQ ID NO: 34500 - DNA, 1208 bp, Panicum virgatum
  misc_feature: Ceres CLONE 1956407
  misc_feature: Encodes the peptide sequence at SEQ ID NO. 34501
gtctacgcccagcttcgggcggccgccctcctctccccagcccacgccctgtgctgcgccgtgacagcactcgatcccgacggccacggttctcccctacgcgcgcccgctgcggcggccgccgtccccgccgcggatctcccccacgcgcgcgactcccgactgcggcggctgccgtcccctccgcggatcccccatgcgcggcgcacgcgactccggacgcgccgccgcgactaccgccatccccgccgctcccgaaagcccgcgcgcgactcgcgcggcggcctggatcggcggcgggcacgggagcagcggcgcaaggcgaggggttgctgcgtcagcgtggagccgcggtggcgcgcccttccccgccgccaccctaccccgctgcagcggcgctgagccacccttcccctccctcgcctcccctccttttccccaccctgccttcggcgcgacaggtcgctgcgtcagcgtcgagcagcagtgccctgctaactgtcccacctcacctacctcgtcacgctctacctatccaacgactccctaggcggggctgaatggatatgctgaaaggaagattatgaagaggccatgtctggtttaacccaacttcacccaaatgacttaacaaatgcaccattggctgcaaatgcagattgttatcccactctccttccacttctgcttgttcctctggaaaatgtaaaattaatcaatgtgaccaacattatgattgatgcaaaagctggagacgtaagactaaagaaatgaatctatacactgaaattgacaaaagtttccacacttatgaaataacgcgcctcagacacgttcttgagattgagtctaggacttacatatgctgttgaatcaaaagttaccatctcttttaatccacatctgatgtgtatgtggtgtctggagagacttcgattgatatacataaacaccctctgtctacttataagggagaacaatttgtcaaactgctacatggtaacactgctcctcgaatgagccatgattcacgatcacactactgtgtcatgactgactactatgatatcaatttctcatagggacatcatcatctctgttatatataatcatgtgaatggaccatctggtcatgctgatcagaatcttaatctgatgatactactgcctgataacatggcactgcaatacaaccacctggttccatc

SEQ ID NO: 34501 - protein, 48 aa, Panicum virgatum
  misc_feature: Ceres CLONE 1956407
  misc_feature: SWISSPROT Homolog: EC 1.2.1.38 N-acetyl-gamma-glutamyl-phosphate reductase
MISISHRDIIISVIYNHVNGPSGHADQNLNLMILLPDNMALQYNHLVP

SEQ ID NO: 34502 - DNA, 663 bp, Panicum virgatum
  misc_feature: Ceres CLONE 1956407-R
cagaggaaggatgaccagcttcatccggtccaacatctcatctcagctacagaagcagaggtgtccttgtttacaaatggctggtgaagacaagactgcaactacaaacacctaaacatcatacatcaggatattctggtttttctgccttcatactctagagagttgaggcgacaaagcccgaggcggcgttgaggcgacacggccggggcggagctgaggcggcaacggaggctgggtgaagaggacgaggccatcaaggggggaggagagctggccggagcgggcgccgccgacctggtgggaggctgcggcggtgacagcgaggacggcggggttcgtgtcgacgaggagcagctcattgatggggaaccctagtgagagcgcgatgagcacctccgtctctgtctccccagcgcaaagcgcgatggggaacccaagctcttgtgcactacatccttcgtgacgcacgttttgctaataatttaggtgcataaacgatgcgttacaagacattgacaattaagagtttgattttgttggtagttgatggtcagttcataaaaattttttgccagtgccagtctaacttatattattgtagtgtgtttgaactgccaaaacagttagcattatatcatattgcataattatctgttaatt

SEQ ID NO: 34503 - DNA, 603 bp, Panicum virgatum
  misc_feature: Ceres CLONE 1956446-R
  misc_feature: Encodes the peptide sequence at SEQ ID NO. 34504
aaggtcttcttccagaatttttacctcttttgtatgaccaaactgttataaagcaagaattggtcaggacagttgatcttgggcctttcaagcatgttgtagatgatggtcttgaacttaggaaagctgcctttgaatgtgtggacacgttgctggacagttgtcttgatcaaatgaatccatcatcctttattgtacctttcctcctatctggcttaggtgatcattatgacgtaaaaatgccttgccatttgattctctcgaagctagcagacaagtgcccttctgctgttcttgcagttttggacaccatagtggaacccattgagaaaactattagtcacaaacccaagggtgatgcagtgaagcaggaggttgatcggaacgaagacatgattcgcagtgctcttcgagccatatcttctttgagccgcataagtggcagcgactacagtatgcgtttcaagaatctgatgaacaagattgtgtctactcctgcactcgccgagaagtacaattcggtgcgcagtgaatgaaatctggattatgtatatggtagaaattaggttaaacttaaagtggtacatgctttctcctttccgt

SEQ ID NO: 34504 - protein, 177 aa, Panicum virgatum
  misc_feature: Ceres CLONE 1956446-R
  misc_feature (1)..(164): Pfam Name: TIP120 Pfam Description: TATA-binding protein interacting (TIP20)
GLLPEFLPLLYDQTVIKQELVRTVDLGPFKHVVDDGLELRKAAFECVDTLLDSCLDQMNPSSFIVPFLLSGLGDHYDVKMPCHLILSKLADKCPSAVLAVLDTIVEPIEKTISHKPKGDAVKQEVDRNEDMIRSALRAISSLSRISGSDYSMRFKNLMNKIVSTPALAEKYNSVRSE

SEQ ID NO: 34505 - DNA, 658 bp, Panicum virgatum
  misc_feature: Ceres CLONE 1956446
tacaaaagatcatgagtacatgctcaccgcacttttatcccagttgggttctaaccaagcaagcgtcagaaaaaagtctgtttcttgtattgcatcgcttgctccaagtttatcagatgatttgttagcaaaggcaactttgcaagttgtccaattactgaaaaatagaagtgcaaaatctgatattacccggacaaatatccaaatgattggttctctaagtcgttctgtaggataccgttttggatcacatcttgctgaaactgttcctttgcttataagctattgtacaagtgcatccgaaaatgatgaagagctccgtgaatacagcttgcaggctctcgagagctttatgctcaggtgcccaagggatatatcaccatattgtgaggtcattttgaatcttgctttggaatatgtgagctatgatcctaatttcactgatagcatggaggaggatactgatgaggaaggccaggaggaggaggatgatgatgagagtgcgaatgagtacacagatgatgaggatgcgagttggaaagtccgtagggcatcagcaaagtgcctatctgcaatcatagtatctcgtcctgaaatgttatcgaagatgtatctagaggcttgccccaatttaattgaacgggttagggaaagagag

SEQ ID NO: 34506 - DNA, 1348 bp, Panicum virgatum
  misc_feature: Ceres CLONE 1956454
  misc_feature: Encodes the peptide sequence at SEQ ID NO. 34507
ctttctccgacctctccgtcgaccaaccgcccatcttttgctcacactcttctgcttccactcccctccctctctcggtcccaactcactacgcgtggtgtataatatatatatctacacgctcttgtagcggcgagctagctccgccacaatatctatctctatccataatccatctacctacctgcacaagatgggtaacaccgtcatgctgcgggcgttggtgctggcgctcgcggtggccgccgccgccgccgggaagcggagcacgtacatcgtccacatggccaagtcggcaatgccgccggagtacgcggaccacggcgagtggtacggcgcctcgctgcgctccgtgtccgcggccagcaagatgctctacgcctacgacacggtcctgcacggcttctcggcgcgcctcacgccggcggaggccgccggcctggcgcgcctcgagggcgtcctcgccgtgaacgccgaggcgcgctacgagctgcacaccacgcggacgcccgagttcctgggcatcgcgggcgccgacctgctcccgcagtccgggacggcggcggacgtcgtcgtcggggtgctcgacaccggggtgtggcccgagagccccagctacgacgacgccgggctcggggaggtgccctccttctggaagggccagtgcgcggcgggcgccgggttcaacgcctccgcctgcaaccggaagctcgtcggcgcgcgcttcttcaacaaagggtacgaggccgccatggggcccatggacacggaccgggagtcgcggtccccgcgcgacgacgacggccacggcacgcacacgtcctccacggccgccggcgccgccgtgaccgacgccagcctcttcgggttcgcggctggcacggcgcgcggcatggcgccccgggcgcgcgtcgccgtgtacaaggtgtgctggatcgggggctgcttcagctccgacatcctcgcgggcatggacgccgccgtcgccgacggctgcggcgttctctcgctctcgctcggcggcggcgccgcggactactcgcgcgacagcgtcgccatcggcgccttcgccgccatggagcagaacgtcctcgtctcctgctccgccgggaacgccgggcccggcacctccacgctctccaacgtcgcgccgtggatcaccaccgtcggcgcgggcacgctcgaccgcgacttcccagcgtacgtcgcgctcggcaacggcaacaactacacgggcgtctccctctactccgggaagcccctccccagcacgccgctccccatcgtctacgcggccaacgcctccaactccaccgccgggaacctctgcatgccgggtaccctcaca

SEQ ID NO: 34507 - protein, 384 aa, Panicum virgatum
  misc_feature: Ceres CLONE 1956454
  misc_feature (25)..(101): Pfam Name: Subtilisin_N Pfam Description: Subtilisin N-terminal Region
  misc_feature (111)..(382): Pfam Name: Peptidase_S8 Pfam Description: Subtilase family
  misc_feature: SWISSPROT Homolog: EC 3.4.21.25 Cucumisin
  misc_feature: Functional homolog of the protein sequence given in SEQ ID NO 51144
  misc_feature: Useful for making plants with modulated flowering time
MGNTVMLRALVLALAVAAAAAGKRSTYIVHMAKSAMPPEYADHGEWYGASLRSVSAASKMLYAYDTVLHGFSARLTPAEAAGLARLEGVLAVNAEARYELHTTRTPEFLGIAGADLLPQSGTAADVVVGVLDTGVWPESPSYDDAGLGEVPSFWKGQCAAGAGFNASACNRKLVGARFFNKGYEAAMGPMDTDRESRSPRDDDGHGTHTSSTAAGAAVTDASLFGFAAGTARGMAPRARVAVYKVCWIGGCFSSDILAGMDAAVADGCGVLSLSLGGGAADYSRDSVAIGAFAAMEQNVLVSCSAGNAGPGTSTLSNVAPWITTVGAGTLDRDFPAYVALGNGNNYTGVSLYSGKPLPSTPLPIVYAANASNSTAGNLCMPGTL

SEQ ID NO: 34508 - DNA, 646 bp, Panicum virgatum
  misc_feature: Ceres CLONE 1956454-R
  misc_feature: Encodes the peptide sequence at SEQ ID NO. 34509
tttcctttgcgcgttcaagtacagccccaacatgatcgccgtcgtggcgcggagccgggacctggggtgcgccgagaacaagacctactccgtgggcggcctcaactacccgtccttctccgtgcctttctccacggcggacggcgacggcggcgagtcctcggcggcgaccaccgtgacgcacacgcgcacgctcaccagcgtgggcggggccggcacgtacaaggtgtcgacgtcggtgtccggcgcggcgcggggcgtggccgtggtggtggagccggcggtgctggcgttcgcgtcggcgggggagaagaagagctacacggtgaggttcacgtccaggtcgcagccgtcgggcaccgccggcttcgggcggctcgtgtggtcggacggcaagcacagcgtggccagcccgatagcgttcacgtggmcctgacgggcacgagcacgatggggttttgattggcgcctgaaaaaacggttgcgtgggcaacggtagtccaagtgatggccgccgcgtacactgccacgaccggtccaagggctggagtgtaaaattggaaggtttggagtggggaggggggggggcgaaaattggaggtttgttacgtgttgcaaataagatcattaatcttggcaggtgtcc

SEQ ID NO: 34509 - protein, 144 aa, Panicum virgatum
  misc_feature: Ceres CLONE 1956454-R
  misc_feature: SWISSPROT Homolog: EC 3.4.21.25 Cucumisin
  misc_feature (144)..(144): Xaa is any aa, unknown, or other
FLCAFKYSPNMIAVVARSRDLGCAENKTYSVGGLNYPSFSVPFSTADGDGGESSAATTVTHTRTLTSVGGAGTYKVSTSVSGAARGVAVVVEPAVLAFASAGEKKSYTVRFTSRSQPSGTAGFGRLVWSDGKHSVASPIAFTWX

SEQ ID NO: 34510 - DNA, 677 bp, Panicum virgatum
  misc_feature: Ceres CLONE 1956470
  misc_feature: Encodes the peptide sequence at SEQ ID NO. 34511
attgagcctcgtgctcctgagtggtacttccaacagaagatagactacctgaaagacaaggttgccgcatcctttgttagggacaggagggcaatgaagagggaatatgaggaattcaaggtaagaatcaatgccttggttgcgaaagcccaaaaggttcccgaggaaggatggacaatgcaggatggaagcccctggcctggaaacaatgtacgcgatcatcctggaatgattcaggtattccttggccaaagcggtggtcatgatgtggaaggaaatgagctgcctcgcctcgtttatgtctcgagagaaaagaggccaggctataaccatcataagaaggctggtgccatgaatgcactggttcgtgtctctgctgtcttatcaaatgctccatacctattgaacttggactgtgatcactacatcaacaatagcaaggccataaaagaggctatgtgtttcatgatggatcctttggtggggaagaaagtgtgctacgtgcagttccctcagaggtttgatggtattgaccggcatgatcgatacgctaacaggaacgttgtcttctttgatatcaacatgaaaggtctggatggtattcaaggacccatctatgtgggtactggatgtgtctttagacggcaggcactgtatggttatgatgctccgaaaac

SEQ ID NO: 34511 - protein, 225 aa, Panicum virgatum
  misc_feature: Ceres CLONE 1956470
  misc_feature (1)..(225): Pfam Name: Cellulose_synt Pfam Description: Cellulose synthase
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Functional homolog of the protein sequence given in SEQ ID NO 50727
  misc_feature: Useful for making plants with altered cell wall content and/or composition
  misc_feature: Functional homolog of the protein sequence given in SEQ ID NO 50260
  misc_feature: Useful for making plants with modulated biomass
  misc_feature: Functional homolog of the protein sequence given in SEQ ID NO 50124
  misc_feature: Useful for making plants with altered carbohydrate content
  misc_feature: The sequence is a functional homolog of SEQ ID NO 6 in US patent 7285702
  misc_feature: The sequence is a functional homolog of SEQ ID NO 2 in US patent 7049481
IEPRAPEWYFQQKIDYLKDKVAASFVRDRRAMKREYEEFKVRINALVAKAQKVPEEGWTMQDGSPWPGNNVRDHPGMIQVFLGQSGGHDVEGNELPRLVYVSREKRPGYNHHKKAGAMNALVRVSAVLSNAPYLLNLDCDHYINNSKAIKEAMCFMMDPLVGKKVCYVQFPQRFDGIDRHDRYANRNVVFFDINMKGLDGIQGPIYVGTGCVFRRQALYGYDAPK

SEQ ID NO: 34512 - DNA, 645 bp, Panicum virgatum
  misc_feature: Ceres CLONE 1956470-R
  misc_feature: Encodes the peptide sequence at SEQ ID NO. 34513
ccttctgggtgatcgtccacctgtacccgttcttcaagggtctggtggggaggcagaaccggacgccgacgatcgtcatcgtctggtccatcctgctggcctccatcttctcgctcctgtgggtgcgcatcgacccgttcctcgccaagagtgacggccccctcctggaggagtgcggcctggactgcaactgaggaagaaagaggaagacccctcctggcgcaggcgaattacgccctgaattttttggaattctttcctgtagatagaaacacagatcctcccctccttccggcgctccttctgttccatggcggcgaggccgtgacatccctgtgcagctcttcttcaacattccccattcattcatccgaggaacccgcaccggattgatccgctggcggccgccggagcaggaggacggcggcgattgtttgttgcgtaaattaaagttaagttacatatatcatgcacattccattcccccagtcagttggtacattagcaaagaacagatgattggttacttaggggttgattctttgttagcggaaaatgtgatccgcctcctgtgttgtaagaacagtttacttaggtgtgtttttgcttctgtggaatcttatagaaacctcccccttttgctgc

SEQ ID NO: 34513 - protein, 63 aa, Panicum virgatum
  misc_feature: Ceres CLONE 1956470-R
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Functional homolog of the protein sequence given in SEQ ID NO 50363
  misc_feature: Useful for making plants with altered cell wall content and/or composition
  misc_feature: Useful for making plants with modulated biomass
  misc_feature: Functional homolog of the protein sequence given in SEQ ID NO 50124
  misc_feature: Useful for making plants with altered carbohydrate content
  misc_feature: The sequence is a functional homolog of SEQ ID NO 6 in US patent 7285702
  misc_feature: The sequence is a functional homolog of SEQ ID NO 2 in US patent 7049481
FWVIVHLYPFFKGLVGRQNRTPTIVIVWSILLASIFSLLWVRIDPFLAKSDGPLLEECGLDCN

SEQ ID NO: 34514 - DNA, 1438 bp, Panicum virgatum
  misc_feature: Ceres CLONE 1956484
  misc_feature: Encodes the peptide sequence at SEQ ID NO. 34515
gggaaaaggataggaaggaatcgcactcgcggtctcgcgctcgcaacaccaccacctccaccattcgacgcaaagcgaggttctccccctcccccctccaccctcacggcgtcgccgggcggcagatccggccaccggcgcgattcccgctgcatcgcaggtccggctccttctctttcccaactcgcctctggtagtcagtccctgcgctcgccttggcaactggtcgcagatccgagcagggcgtttggagcggcgtgcggagcagtgggagatccttccgccatcccttgcccaggctggcgtgttccgctcccggaagccatgcttagtgtgaggattgctcgtcccgttccgtggaaccaatctgtttcttcaccgtgtgtcggaggaccgcaaatccaaatctctctactgttacgggatcagatcagatgctccaatctatccgtgaaattagtcaagttactcaatgctcctgaagtcctgatatagcagaaaaccatgggagaagttagtgaaaataattcagacatgtctgttctacaaaaaattgctacgagtggtgtgccactgttgaaggactatggtctgagtggagttgtttgtgctgtgcttctggctatagttattcctttattgcttacctcaatgtttggcaaaaagacaaagaaaagggcagtgcaagctgatgtgggtggagaggcaggacttgccatgcgaaacagtagattttcatccttagttcaagtcccatgggagggtgccaccacaatggcagcactattcgagatggccagcaaaaagtactctctacggaggagtcttggcacaagaaagctaattaatagggaatttgtggagtctgctgatggtagaaagtttgagaaattgcatcttggtgaatatcaatgggatacctatgcagaagcttttaatcgtgcatgtaattttgcttctggacttatcaagatgggccacaaactagatagtcatgcagcaatcttttctgatacaagagctgagtggatcattgctgcccagggatgctttcgacaaaatttgacggttgtaacaatatatgcttctcttggtgaggatgcattggtgcattcactaaatgagacacaagtttcaactctgatatgtgattcgaagcaacttaagaagctacctgcaatcagctctaaattgcaaagtcttagacatattatctatattgaggatgaacctgttgaggccgagacactgaatcaaatgaatctttggacaacattgtctttcactgaagtagaggagctgggcaaaacatcacacattgatgctaggttaccttcaagctctgatactgcagttatcatgtatacaagtggaagtactggtcttcccaagggtgtaatgatcacgcatggcaacatggtggccacaactgcagcag

SEQ ID NO: 34515 - protein, 311 aa, Panicum virgatum
  misc_feature: Ceres CLONE 1956484
  misc_feature (57)..(307): SWISSPROT Homolog: EC 6.2.1.3 Long-chain-fatty-acid--CoA ligase
  misc_feature (281)..(304): SWISSPROT Homolog: EC 6.2.1.26 o-succinylbenzoate--CoA ligase
  misc_feature (279)..(306): SWISSPROT Homolog: EC 5.1.1.12 Ornithine racemase
MGEVSENNSDMSVLQKIATSGVPLLKDYGLSGVVCAVLLAIVIPLLLTSMFGKKTKKRAVQADVGGEAGLAMRNSRFSSLVQVPWEGATTMAALFEMASKKYSLRRSLGTRKLINREFVESADGRKFEKLHLGEYQWDTYAEAFNRACNFASGLIKMGHKLDSHAAIFSDTRAEWIIAAQGCFRQNLTVVTIYASLGEDALVHSLNETQVSTLICDSKQLKKLPAISSKLQSLRHIIYIEDEPVEAETLNQMNLWTTLSFTEVEELGKTSHIDARLPSSSDTAVIMYTSGSTGLPKGVMITHGNMVATTAA

SEQ ID NO: 34516 - DNA, 672 bp, Panicum virgatum
  misc_feature: Ceres CLONE 1956484-R
  misc_feature: Encodes the peptide sequence at SEQ ID NO. 34517
cttcagcatggagaatatgtgtctcttggcaaggttgaatcggctctaacaactagcaattatgtcgatagcatcatggtttatgctgatccatttcataattattgtgttgccctggttgttccggcacaccaggctctggagaagtgggcacaagattcagggataagttacaaagactttgaagagctttgccaaaatgatcaagcaattaaggaggttcagcaatccttatcaaaggccgcaaaagcagctaggcttgagaagttcgagataccagcaaagatcttgttgctgcccgaaccatggactccagagtctgggctagtgacagcagcacttaaactgaagagggaacagataaagagcaaattcaaagatgatctgaacaacctgtatcactgaagcagtgactgaaggctgtttggacctatgttttctgaaggtacttgaagcagcctggaacagtggaacctactgacctgaaatgaataagcgagctgtgtgtacatttgcttgctaatacgtagcttgttcttgtgtgagcaaagaatgctcaattttatgtctgttcacgaccgtaaatctagtgtttgtttctccttgtaatgctaactacattgcgaaccgcctctccagaggtttaaacgatgtatagtgtgtttcgggctt

SEQ ID NO: 34517 - protein, 134 aa, Panicum virgatum
  misc_feature: Ceres CLONE 1956484-R
  misc_feature: SWISSPROT Homolog: EC 6.2.1.3 Long-chain-fatty-acid--CoA ligase
LQHGEYVSLGKVESALTTSNYVDSIMVYADPFHNYCVALVVPAHQALEKWAQDSGISYKDFEELCQNDQAIKEVQQSLSKAAKAARLEKFEIPAKILLLPEPWTPESGLVTAALKLKREQIKSKFKDDLNNLYH

SEQ ID NO: 34518 - DNA, 1354 bp, Panicum virgatum
  misc_feature: Ceres CLONE 1956487
  misc_feature: Encodes the peptide sequence at SEQ ID NO. 34519
gtgtcactgtgaggctctctctgaccttcctgctcctcccctcgcatcccctcccgaatccgcctcgccctcggccaggtcgtcgccccggcgcccgccaccgccggccgagccctcttcgccaagatcgcaccgcgcgtccagcacagcgcctagcgccctccttcgcagcttcaggcgatgcctctggtggaaccggggcctcgtcgctgaccgcagccatggagcagagtagcgatgggatgccaaggccgcggaggaatgtcagctcaacaaatcactcgaccaactcggatgcggttgctgaaggcacgttgaatggaccaccttgcaagaagaatctacacagcttcaatgagtgcagtagttcaaagaatcttgaaaggaccaaatgcagatggtcaccagaggaagatgagctactcactaaattggtaaacaaacatgggaccaaaaactggcaaactattgcatgcgctttacctgaccggaatgcacatgcatgcttatcaagatggaaatacattctagacccagcaataaacaaagaggcttggtcgcaacaagaggagctaagattgattcgtgcacatcaaatatatggaaacaagtggtgcaaaatggccaaacatttcccagggaggacaaataatgcactcaaggaacactggaggggctctatgaaaagaaaactggattcatatttagcctcaggattgctcgaacaagttcccgaccttcatgaaaatctatcaattccacagagcagtcagtcagatattccaaaggacagcaaagtttcatctgatagaattcgattttcatcaaggtccaaatttaaacaaaatatcacagaactaagtggagatacttcagtaggagaaagttctgactccatctatgctaaatcatttgatgcccattcagccaaagtctctgaaaatataatagctaaaccgcagcagtgggcaacagcaaaaaagaaactggatttggtgtcaagcccattgaagctcaagagtgatgtaccacctgaaactgtcaaacaccatcatcaagaaattgaatcagaaaagacagagggcccaccatgcaagaaaaatggctactgcttcaagcatggaagtactttaaaaaattctgaaaggaccaaaggcagatggttagcagaggaaagttgttatcaacaacacatttaattaaccatgtcaacttgggtttgttcatgctcactgagaaaaagaaattgtattttcctgtaggaagatgaaattctcactaaaatggttaccaagcatgggctgaaaaactggcgaactattgcatctgctatacccagccgaaatgcactacg

SEQ ID NO: 34519 - protein, 325 aa, Panicum virgatum
  misc_feature: Ceres CLONE 1956487
  misc_feature (57)..(103): Pfam Name: Myb_DNA-binding Pfam Description: Myb-like DNA-binding domain
  misc_feature (109)..(154): Pfam Name: Myb_DNA-binding Pfam Description: Myb-like DNA-binding domain
MEQSSDGMPRPRRNVSSTNHSTNSDAVAEGTLNGPPCKKNLHSFNECSSSKNLERTKCRWSPEEDELLTKLVNKHGTKNWQTIACALPDRNAHACLSRWKYILDPAINKEAWSQQEELRLIRAHQIYGNKWCKMAKHFPGRTNNALKEHWRGSMKRKLDSYLASGLLEQVPDLHENLSIPQSSQSDIPKDSKVSSDRIRFSSRSKFKQNITELSGDTSVGESSDSIYAKSFDAHSAKVSENIIAKPQQWATAKKKLDLVSSPLKLKSDVPPETVKHHHQEIESEKTEGPPCKKNGYCFKHGSTLKNSERTKGRWLAEESCYQQHI

SEQ ID NO: 34520 - DNA, 628 bp, Panicum virgatum
  misc_feature: Ceres CLONE 1956487-R
cagcagaacgtgtggatgtggttataccaacagctggtagtaacactcccaatgatattccttcacaggcaaccccagatccatgctcaccagagatacatgaggcgaatgcatcagatcctctggacatgccctactgtgatgacttgataatcgattctcctccttatctgcatggcagtagcttcatatagaatgaagagtgttacttacacaatctgacaaagtgcaacttcaagtattgcgcttgctcggttgcattcttttgtttagcaagtgctgaggtacaaacttaatgccctcttcctgaaatccaacagctccacgtacaaggagctcgttgcgtgttggacggaacttttatcttggcaaaagttggaataattctgttttgttaaatgtcactgtctaggcttggagggcagttttgtaagttttgaaggcgagtttaatttgtttgtttatcctacttgctggtttgagggaatgtaggccatttacagaaaccaacttttactatttgtaggaaggccaaacatccaaacagtgcaagaggaaccagattcggattttaagctttaaagttttttctctaacaatgaatttgaaatttggaaactatttggac

SEQ ID NO: 34521 - DNA, 516 bp, Panicum virgatum
  misc_feature: Ceres CLONE 1956507-R
  misc_feature: Encodes the peptide sequence at SEQ ID NO. 34522
ccggaaaatcatagtgcagggacgatcttccaagtcaactaaggttggagacatcatgactgaagagaacaagctgatcaccgtgaagcctggaaccaaggtcctgcaagccatgcagctgatgacagagaaccgcatcagacacatcccggtgatcgaaggcacagggatgctggggatggtctccatcggcgacgtcgtccgtgcggtggtcaacgagcacagggaggagctgaaccggctcaacgcctacatccagggaggctactaggacgacgcccctacctcccagcgaagtccgcctttgatatccaataactcggaccagtgatgatgacgaaataggccgtgtgttcgcggacaatgttgttgaattgcgcaaggtgttttcccccgcgtgtactatatgtgtatattgccaaaaggcgggcgtgacagtgcgcctggtgctggggcgcagactatctgacggtggaaacaccggaaataaaaagcgtgccgccgtgtgcttgcttc

SEQ ID NO: 34522 - protein, 89 aa, Panicum virgatum
  misc_feature: Ceres CLONE 1956507-R
  misc_feature: SWISSPROT Homolog: EC 1.1.1.205 IMP dehydrogenase
RKIIVQGRSSKSTKVGDIMTEENKLITVKPGTKVLQAMQLMTENRIRHIPVIEGTGMLGMVSIGDVVRAVVNEHREELNRLNAYIQGGY

SEQ ID NO: 34523 - DNA, 634 bp, Panicum virgatum
  misc_feature: Ceres CLONE 1956507
ccctcgcagtgtaacaagtgtccttcctccgtcttcctcctctcgctctcatccactccccacgcctagcgccccccctcgccactgcggtgcggagcttcggcggctcggctcgagcaggtaaagcagccgaaaccccctccgctttgcttagattagacggatcgatcggcttgggcgatctcgaggcgtggcgacgctgcgcctcgtgtacgttctccagggaactgctgctttgctttggatcgggtaaagctggctgtacgttcacggagttctctctcttggcgacaagagtattcgtttttctccttttatttcccttgatttctgcacgatctggtctgcaactctcaaaggaatgcgagcaactctgctcctgggcttgggtacccaaaggaaacgagtttttaagcaaacaggaacagaacaaacactgctaaccaatggaagaaagggaaagaaagagtagttttgttccagggttttctcctgctgtcgctgccggatctgttgttctcgctccttccctcagttgttttcgctgtttttgtttggctgttagttgaggcagcatattggttgatccctatcatttggcatcttcatcgatacgcatacgcatagattgcta

SEQ ID NO: 34524 - DNA, 988 bp, Panicum virgatum
  misc_feature: Ceres CLONE 1956523
  misc_feature: Encodes the peptide sequence at SEQ ID NO. 34525
acacggccacaccctttcacacttccaacaccgctgccgcagcccgtcgccggcgagacccgtaccacccaccgaccctctcaccgatggcggcggccgcgagggccgcttcggcggcgcgctccccgctcctcgtccaccaccaccgccgccgcctcccccaggtgccgtccggcgggggaggctcgctccgggtgggcggggccggacgcgggcgggatgaggggcggaggcgggccagggtcggggttagggtcttcgcgcgctactcccaggcccaggacttctccacgcgcttccaagatagagttggtgagttgcctaaattggtggaggaccttctccagacgtcgattaccacagggccccgaggtgctttcaggatggcgcaagggatccaagctgtgcttggggttggtggggagtggctgaatgacctctcaaagactgctaacacatcagcaggaattccagctcagatgcagcttggtttgctttctcctctttaccttaggaggctttttgagcgcatgggtgcaacttatatcaagctaggccagttcgtagcatctgcaccaactttgtttmctgcagaatmtkttgaggaattccagaactgctttgaccgatcacccgctgtaccttgtgatgtgattcagtcaatattgcgtgaggagttgcaccgaccattggatagcatagatgaatacatccacccggtgcccatagcttctgcctcaatagcacagattcatggggctaggttgaacagctcacacaaggatgaggtgattaaaattctaaaacctggcattcaacatactttggttactcatctgaattttatctatgtcgttgcacgagttttggaattcatgaaccctgagctacagaggacattactggtaggcatcatcaaaggactataaaagaatcaatgcatgaagaagttgattttagaaaagaggctgctaatattcaagcttct

SEQ ID NO: 34525 - protein, 280 aa, Panicum virgatum
  misc_feature: Ceres CLONE 1956523
  misc_feature (196)..(278): Pfam Name: ABC1 Pfam Description: ABC1 family
  misc_feature (168)..(168): Xaa is any aa, unknown, or other
  misc_feature (171)..(171): Xaa is any aa, unknown, or other
  misc_feature (172)..(172): Xaa is any aa, unknown, or other
MAAAARAASAARSPLLVHHHRRRLPQVPSGGGGSLRVGGAGRGRDEGRRRARVGVRVFARYSQAQDFSTRFQDRVGELPKLVEDLLQTSITTGPRGAFRMAQGIQAVLGVGGEWLNDLSKTANTSAGIPAQMQLGLLSPLYLRRLFERMGATYIKLGQFVASAPTLFXAEXXEEFQNCFDRSPAVPCDVIQSILREELHRPLDSIDEYIHPVPIASASIAQIHGARLNSSHKDEVIKILKPGIQHTLVTHLNFIYVVARVLEFMNPELQRTLLVGIIKGL

SEQ ID NO: 34526 - DNA, 618 bp, Panicum virgatum
  misc_feature: Ceres CLONE 1956523-R
ttctgatactgtattttgatcgctacacaaggttgttggctcccagcatgaacatgcttcgagatgagagaatcaacatctcgaccaaccgacaacccagacgaacagatcggtttcaatgaggccacttcattaataattagcaatatagttgaagggtgataatagcaagcttatgtgaccaaacactgtatctgtatatagtagtgccagaccagcatagaaatcttgtacactagggttatgccatagtgactaggtaacatgtaaaatatgtttgttacgtcccagtagactttaactgccttgttcctggtcgagcggagtcaggttatgatgtggctgtactgtactgcaactgtcaaccgaggaagtgatgatgtatatgtttgtaaaagcccaacggtgcaggtgtatcatgtgctaaagggcaccgtgttttgttgcattttctcagggtcacaacgatatttggggattcaactaggattgtaccgcgtaaggtgactttctggtccctttactgctgtggcatgcgaaacagggttcagtgacattgactcggaaaatatcagctcaggttcgagcttcgaataagtaccagaattcacattttac

SEQ ID NO: 34527 - DNA, 1290 bp, Panicum virgatum
  misc_feature: Ceres CLONE 1956536
  misc_feature: Encodes the peptide sequence at SEQ ID NO. 34528
ctccttcactccgccacaatggccaccaccaccaccaccaccaccatcactaccgtcacggaaccggacaatgcggaaccgtccccgtcgtctccaccgcccaagaaggtcgcctacgagctcgccgcccggaacatctactacgccaagccggcgccggcgccgaggtcgctcgcgcggctcgtcgcccggccgtgcggcgcggccccggcgccgccggactacatcctccgcgacgtgtcactcacggcgaaggccggggagatcctggccgtcgtggggcccagcggcgccggcaagtccacgctgctcgacatcctcgccgcgcgcaccgcgctcacgcacgggaggctgctgctcaactccgcgccgctccggccgtcgtccttccgccggctctcggcgcacgtgccgcaggcggacgttgcgctcacgctgctcaccgtctccgagaccttcgccttcgccgcgtcgctgctgcgcccggagtcggcggcggccgcggtcgccgcgctcctcgccgacctccggctggcgcacgtcgcgcacacgcgggtctcccccgcgcgcctgtccggcggggagcggcggcgcgtgtccatcgggctcgccctcctgcgcgaccccggcgtgctcctcctggacgagccgacctccggcctcgactcctcgtcggcgcacgtggtggtcagctgcctccgctccgtcgcggccgcccggggcacgacggtggtgctcaccatccaccagccgagcgcgcgcctcctctccgcggtggactcgctcctcctcctctcgcgcggcgctgtcctgcaccacggctccctcgcctccctcgacgccgccctcctctcccacggcctcgtcgtcccggcgcagctcaaccctctcgagttcgccctggaggtcctcgaccagctcccccatccttcgccgtcgacccaagagctcctcacttcgccgccgtcggatcatcgcaaggcggcgacgtcgtcgactgctgcctcgccgtcgtcgaggctgcacgagctagtggtgctgtacaagcgggcgtggaaggtggtgttccgcagcaagcagctgctgctgaccaacttcctggaggcggtgctggtgggcacgctgctggggaccatctacatccacgccggctacggcgaggccggcgcgcacaagcggctgggcctgttcgccttcacgctgaccttcctgctgacctcgacgacggagacgctgccgacgttcttgtcggagcggccgatcgtgctggcggagacggcggcggggctg

SEQ ID NO: 34528 - protein, 423 aa, Panicum virgatum
  misc_feature: Ceres CLONE 1956536
  misc_feature (81)..(262): Pfam Name: ABC_tran Pfam Description: ABC transporter
  misc_feature: SWISSPROT Homolog: EC 3.6.3.36 Taurine-transporting ATPase
MATTTTTTTITTVTEPDNAEPSPSSPPPKKVAYELAARNIYYAKPAPAPRSLARLVARPCGAAPAPPDYILRDVSLTAKAGEILAVVGPSGAGKSTLLDILAARTALTHGRLLLNSAPLRPSSFRRLSAHVPQADVALTLLTVSETFAFAASLLRPESAAAAVAALLADLRLAHVAHTRVSPARLSGGERRRVSIGLALLRDPGVLLLDEPTSGLDSSSAHVVVSCLRSVAAARGTTVVLTIHQPSARLLSAVDSLLLLSRGAVLHHGSLASLDAALLSHGLVVPAQLNPLEFALEVLDQLPHPSPSTQELLTSPPSDHRKAATSSTAASPSSRLHELVVLYKRAWKVVFRSKQLLLTNFLEAVLVGTLLGTIYIHAGYGEAGAHKRLGLFAFTLTFLLTSTTETLPTFLSERPIVLAETAAG

SEQ ID NO: 34529 - DNA, 590 bp, Panicum virgatum
  misc_feature: Ceres CLONE 1956536-R
gggtgttcatgcactacgcgtcgccgtacaagtacgcgctggacgcgctgctggcgaacgagtactcgtgcgcggcggaccggtgcttcggcgtcgggggcggcggcgccggcgagtgctcggagacggggcgcgacgtgctggcggagaaggggctcacggcggcggagcggtggaccggcgtgcaggtgctgttcggcttcttcctcctctaccgggtgctctactgggtggtgctcagccggcgagcgtccagggccaagagatgagacctctggccggcgagctcggcaggatcggatcttggagaggatcggaagcgcacgtccgtacgtgcgtgtgaacgcgtgcatgcaaacaagctagcaggtacgtggaattgcctgtcgacttggagagagaaattagagagagaaagagagatggggccggggaagaagagggtgattattaactggtaattacgctgtcatatactgatgtacattttcaagatacgactcctttataagtgtgtgtgtgcgtgggtgtgaattgtgacatgatggagacggattggtgaataataatatataatgcgtcgttaactc

SEQ ID NO: 34530 - DNA, 1281 bp, Panicum virgatum
  misc_feature: Ceres CLONE 1956537
  misc_feature: Encodes the peptide sequence at SEQ ID NO. 34531
aacggaactggtaagccccccattaaccctctccgctatcctctaagcaagtggtgcttagcaggcggagctctgcaaggctgcagctccgcccagatccggccccgttccccccatttgccggcgcggttcctccgtgcgtgctctgcttgctcgctgctctggtctcggccgggcaaggcgggggctgccgctgctcgggttggtcggtgccgtccttcccttcgtctcgcggttgcgagggccgatctgcgcggggctcgctgcgggcttccttcttccttctagcagactgctagtatagtaccctcttgcttatgcttttttgtgtggcgttgctgcgcaggcaggggactggtggtaggctgaccccgcgaggagggagccatggctcagatcttgctccacggcacgctccacgccaccatcttcgaggcggagtcgctctccaacccgcaccgcgcatccggcggcgcccccaagttcatccgcaagcttgtggaggggatcgaggacaccgtgggtgtcggcaaaggcaccacgaagatatatgccaccattgatctagagaaagcccgggtcgggcgtacccggatgatctccaacgagcccgtcaatcctcgatggtacgagtcgttccacatctactgcgcccacctcgccgccgatgtcatcttcaccgtcaagatcgataaccccattggggcgtccctcattgggagggcttacctgcctgtcaaggacctcctggatggtgaggagatcgataagtggcttcaaatctgtgatgacaaccgtgagcctgttggtgacagcaagatccatgtcaagcttcagtactttgatgttgccatggaccgcaactgggcgagaggtgtccggagcaccaagtatcctggtgttccttacacctttttctcacagagacagggatgtaaggttactctataccaggatgctcatgtcccagacaactttattcccaagatccctcttgctgatggcaagaactatgagccacacagatgctgggaggatatctttgatgccataagcaatgctcaacacttgatttacatcaccggctggtctgtgtacaccgagatcaccttggttagggacaccaacaggccgaaacctggaggtgatgttactcttggggagttgctcaagaggaaggccagtgaaggtgtccgggtcctcatgctagtgtgggatgataggacttcagttggcttgctgaggagagatggcttgatggccacccatgatgaggagacg

SEQ ID NO: 34531 - protein, 297 aa, Panicum virgatum
  misc_feature: Ceres CLONE 1956537
  misc_feature (10)..(114): Pfam Name: C2 Pfam Description: C2 domain
  misc_feature: SWISSPROT Homolog: EC 3.1.4.4 Phospholipase D
MAQILLHGTLHATIFEAESLSNPHRASGGAPKFIRKLVEGIEDTVGVGKGTTKIYATIDLEKARVGRTRMISNEPVNPRWYESFHIYCAHLAADVIFTVKIDNPIGASLIGRAYLPVKDLLDGEEIDKWLQICDDNREPVGDSKIHVKLQYFDVAMDRNWARGVRSTKYPGVPYTFFSQRQGCKVTLYQDAHVPDNFIPKIPLADGKNYEPHRCWEDIFDAISNAQHLIYITGWSVYTEITLVRDTNRPKPGGDVTLGELLKRKASEGVRVLMLVWDDRTSVGLLRRDGLMATHDEE

SEQ ID NO: 34532 - DNA, 687 bp, Panicum virgatum
  misc_feature: Ceres CLONE 1956537-R
  misc_feature: Encodes the peptide sequence at SEQ ID NO. 34533
tccatggatggctccagggactttgagatcgccatgggtggataccagccgtaccacctggcaaccaggcagcctgcccgtggccagatccatggcttccggatggcgctgtggtacgagcacctgggcatgctggacgatgtgttccagcgcccggagagcgtggagtgcgtgcagaaggtgaacaagattgccgagaaatactgggatatgtactcgagcgatgacctggagcaggacctcccgggccacctcctcagctaccccattggcgttgactctgacggcaacgtcaccgagatgccagggatggagttcttccccgacacccgtgcccgcgtctttggcaccaagtcggattacctcccacccatcctcaccacatagaggggcagactgggagtgccgtgccttctctcttgtctggcctcagcttggtgtcttgttctttgtgtttcagacaccaaaggttcagataatagtgttattatagttattgagtgataataagtgcattgtgcatggttgggacgataggatgaagagttgtttattactaatactgcatacagattgtgttgtgtccctgtccggtgtagtttgtatggcttgctgcgttgcagtgccgtttgtatgatgagactccatcaatttcacatggttggttgttcagctgttttgctgctc

SEQ ID NO: 34533 - protein, 128 aa, Panicum virgatum
  misc_feature: Ceres CLONE 1956537-R
  misc_feature: SWISSPROT Homolog: EC 3.1.4.4 Phospholipase D
SMDGSRDFEIAMGGYQPYHLATRQPARGQIHGFRMALWYEHLGMLDDVFQRPESVECVQKVNKIAEKYWDMYSSDDLEQDLPGHLLSYPIGVDSDGNVTEMPGMEFFPDTRARVFGTKSDYLPPILTT

SEQ ID NO: 34534 - DNA, 578 bp, Panicum virgatum
  misc_feature: Ceres CLONE 1956539-R
  misc_feature: Encodes the peptide sequence at SEQ ID NO. 34535
cgagagaaagaaaagcctaagtcagagaacaagaagattttggatgcaaaacaattaattgacatgatcccaaggacgaaggaagagctttttgcctatgatataaactgggcaatatacgacaagcatgagttgcatgagagaatgaggccttggatttcaaaaaagatcattgaatttcttggtgaggaggaatcaactttggtggattacattgtatcctgcaccaaagatcatgtccaggcagaaaagatgctggagctcctacagtcaattttggatgtcgaggcagagatgtttgtcctcaagatgtggaggatgcttatatttgagatcaaaaaagtcgaatcaggattatcaggaagagccaaggcgtgaagctaagcctcttaccttgtatgaccttttctgatttacgttactcatcaactgtgatctcacctgtaagctcatactgtactacaagtgaaaaaaaaacatttttagtgagactgaattgatggttgctattttctcctcttctgttgtagaaatgtatacgagaaccaatgagatattctgcgaagttaaatttttgg

SEQ ID NO: 34535 - protein, 125 aa, Panicum virgatum
  misc_feature: Ceres CLONE 1956539-R
  misc_feature (46)..(117): Pfam Name: PWI Pfam Description: PWI domain
REKEKPKSENKKILDAKQLIDMIPRTKEELFAYDINWAIYDKHELHERMRPWISKKIIEFLGEEESTLVDYIVSCTKDHVQAEKMLELLQSILDVEAEMFVLKMWRMLIFEIKKVESGLSGRAKA

SEQ ID NO: 34536 - DNA, 457 bp, Panicum virgatum
  misc_feature: Ceres CLONE 1956539
aactcgaaccaaaccaacaaccaccacctctcctcggcggctcctccctctcccccaccatggcggccgtcgcgcctccgcccgacaacctggacccgccgccgtccaaccccgcctcctccgctcccgccgcggttaccccggcccccgccgccacctccaccccgccgaaccccgggacccccggccccgcggcgccaagcccaagtccaaaccctaacccatcccccgcccccgtatccacacctccggctgtcgtggcgccgccgatgccccccgcgccggtctccttcgccgccagcttccgcccgctcggcgcccctccgccgcaccaggtgccgcagtacggcgtggtgccgccgaacccgggatacccgatggcgcagccgatgcagccaccgggtgtccctggcgttatgcctccgggcgccatgcgccccgcggccatgtacgcgcc

SEQ ID NO: 34537 - DNA, 671 bp, Panicum virgatum
  misc_feature: Ceres CLONE 1956554-R
  misc_feature: Encodes the peptide sequence at SEQ ID NO. 34538
cggaggggaagaagaagagatcggatgagcagcaggggtctgatgggaacaccaagaagtccaagaatgaggcctcctcgcccacgtcgtcttctgtcaaggcatcgcaggtgccgaaagtgaagttaggagacaagatcactgcactgcaacagatcgtttcaccatttggaaagactgatacggcatcagttctgtacgaggcgataaattacatcaagtggctgcatgaacaagtgcagttgctgagtgatccgtacatgaagacaagtaatagcaaggactacaatgcatggggagggttggataggaaggagaagtcagaagctgagatggacctgcgaagtagaggcctatgcttggtacctgtctcatgcacgccccaagtgtacagggataacaatggcccggactactggacgcccccgtatagaagctgcttataccgatgaattgactagtaactattggtattcgattggttaccttaataatttgtggtgaatatacatatgttaaaggagacaaatcatgattagctgcatgagttaatttaaattaaaaccctgatgttcttaattagaggcttctgacattaatctcatcagcattattggtattgatgtattaattcttttgtactccaaggagagagagagatgttatcacct

SEQ ID NO: 34538 - protein, 149 aa, Panicum virgatum
  misc_feature: Ceres CLONE 1956554-R
  misc_feature: The sequence is a functional homolog of SEQ ID NO 2904 in the 10/374,780 US patent application
  misc_feature: The sequence is a functional homolog of SEQ ID NO 874 in the 10/225,066 US patent application
  misc_feature: Functional homolog of the protein sequence given in SEQ ID NO 51463
  misc_feature: Useful for making plants with modulated flowering time
EGKKKRSDEQQGSDGNTKKSKNEASSPTSSSVKASQVPKVKLGDKITALQQIVSPFGKTDTASVLYEAINYIKWLHEQVQLLSDPYMKTSNSKDYNAWGGLDRKEKSEAEMDLRSRGLCLVPVSCTPQVYRDNNGPDYWTPPYRSCLYR

SEQ ID NO: 34539 - DNA, 1315 bp, Panicum virgatum
  misc_feature: Ceres CLONE 1956554
acaagctctgctccgtcctctcccatcacctccgctccacgcacggccaaattccttctcccacacctctcctcgatcctcctatcgatctcccccaccactagctgatcgatcagaggcggagctcgatcagctcgtcagccatagcctgccgcacgagctgctggtagctagctgccgtgccccgcgcgcgcgcgcatgcggtgcatggcgcaggagggctccgaggcctccgtcgccagctcgccgccgccgcccccgccgtcggcctcctcgtcgtcgtccacgtcctccgccgcggccgcggcctcctggtggcgcgacaatatgaacccggcggcatacggcgcctggccgcccgcgcccgcggcggcgcgctggcccctgatggcgccggcgcccgcgcagcagcaccacggccggaccacgacgtcctccggcggcgccgacgacgacctctcggcctccaacgccaccatgacgtccttcaccaacacctccaccaccaaccactccggcctcagcatggactcctccgtccccggcgccgaggccgccgccgccgccgtcgctgccgagagccacctctggaaccaagtcctcatgggcgccggcggcgaggtcgggaggagcatgcaggccgtgcacgacgcccatgacgacagcgagaacttcctcgagctgctcactcgaggacgctcgcgccggagctcttcgccgagccgccggcctgcgactacctcaagaagatggagtacggcagcagccacggcggcggcggatggccggaccaccagttcacggcagcagcgctggagaagcacctgagctccgccggctacggcgccgcgctcgcgcaccagcaccagcaccagcaccaccaccacgcggcggaaggcgcgccggagcggctcacggcgaacctgtccgacctcgtgagcaactggtccattgcgcctcccaacccgtgcctcggcgacgcgcagcatcgtgccggcgccggcgcggcatgcgataacgccgccgtggccggcttgggccacggcggcgccaaggccggcttgttcctggactcgggcggcctctgcaagcacgagatgggcggccacggcgcgatgctgcaggaagcagcgggcggcgccggcggccagcaggagttcctccggcccgcggggtacagctccatgctcgggctcagcagcagcaggatgtacggctccggccccgccatggacgtaccgtggggcaacaatgccggcgcggcgaggagcctgtcggacctgatatccttcggcggagcgccgctgggaaagcc

SEQ ID NO: 34540 - DNA, 626 bp, Panicum virgatum
  misc_feature: Ceres CLONE 1956562
  misc_feature: Encodes the peptide sequence at SEQ ID NO. 34541
agcagcagcgcccacctttctcgcctcgcctcctccctctctcactttgtctctctccattctccaatcctgattgggcaataggcaaccggccaccatctccatgcgtcagcgctcctccggccatgccgcaccgccgccgagcccttaacccgacgttgcctccgccgcctcccgccgccgcgttccacctcgccgcagacgactcgcggctaccgctcctcgccgcggactacgcgctgctccagtccgccgccgccgccgccgcagcagcctcatccgtcgcggacgctcccgcggccccggcgtccgcggagtggagcgctgggagcgccttcaccgcctcctccaccgccacggcgccgggctccgcccggctgaccgccaccgaagaagcaggcgggagggacacgtgggtccgccgcgccagggaggggtactacctccagctctccctcgccatccgcctcacctcccaggccttcctcgccggcaaccccgccctgcccgagctcctcctcggctgcggccccggggatgccggcgacggtgcggatgatccggaggccgtctcctaccggctatgggtgaacgggtgcctgtcgtggggcgacaagatcgcgcac

SEQ ID NO: 34541 - protein, 166 aa, Panicum virgatum
  misc_feature: Ceres CLONE 1956562
  misc_feature: SWISSPROT Homolog: EC 2.7.11.1 Non-specific serine/threonine protein kinase
MPHRRRALNPTLPPPPPAAAFHLAADDSRLPLLAADYALLQSAAAAAAAASSVADAPAAPASAEWSAGSAFTASSTATAPGSARLTATEEAGGRDTWVRRAREGYYLQLSLAIRLTSQAFLAGNPALPELLLGCGPGDAGDGADDPEAVSYRLWVNGCLSWGDKIA

SEQ ID NO: 34542 - DNA, 708 bp, Panicum virgatum
  misc_feature: Ceres CLONE 1956562-R
  misc_feature: Encodes the peptide sequence at SEQ ID NO. 34543
acccccagaatggatggcaccagaatttytccgcggcgasccatccaaacgagaagtgtgatgtttacagcttcggtgtgatcttgtgggagctcctgacaatgcagcaaccgtggagtggcctaggtcctgcgcaggtagtgggagccgttgcatttcagaacagaaggcttccaattcctaaagataccagtccagaacttgctgctcttgtggaatcctgctgggatgatgatccaaggcagcggccttcattttcaagcattgtggatacgctgaagaagtcactcaaagctcttcttggaggctcatgaggacccttgcaagctgtcttggttgccatttgtctccacctctgttttgcgttcctcttctgcctctgtcaatgagatgatagctgaagcagcacaagtgcaatgctgcctcgagttcgataggtcactcctctttttcctcacctcatggcaaaccaataaaaatcggtgcttatgctctcccaccatcccatgtcgcactggggtagcctttgtacagcgattctagtgctaacagaagttccgcaggcctcaggttgggagggtggtctgaatatctgctatccctgaatgttctgaatgattgtattggttgtgcaataggactgaagagtctgttgctttaggggacaggaaaaacattttttatgccaaatagaatagctcacaggat

SEQ ID NO: 34543 - protein, 103 aa, Panicum virgatum
  misc_feature: Ceres CLONE 1956562-R
  misc_feature: SWISSPROT Homolog: EC 2.7.11.1 Non-specific serine/threonine protein kinase
  misc_feature: The sequence is a functional homolog of SEQ ID NO 48 in US patent 7317140
  misc_feature (13)..(13): Xaa is any aa, unknown, or other
PQNGWHQNFSAAXHPNEKCDVYSFGVILWELLTMQQPWSGLGPAQVVGAVAFQNRRLPIPKDTSPELAALVESCWDDDPRQRPSFSSIVDTLKKSLKALLGGS

SEQ ID NO: 34544 - DNA, 768 bp, Panicum virgatum
  misc_feature: Ceres CLONE 1956566
  misc_feature: Encodes the peptide sequence at SEQ ID NO. 34545
actttccttcccactccacctccgctcccatacctctccctccctccgccccgccatccaagaaagaactcgccactccgacccaccaatcatcgcaaatcggtcggcccgaagcgaccagcagcccgcgcgtgtcgtcggcacccatggcgtcctcctcgccgtcgtgccgtgccggcgacggcaagccggacgtggaccggatcaagggcccctggagccccgaggaggacgaggccctgcagcggctcgtggcgcgccacggcgcgcgcaactggtccctcatcagccgctccatcccgggccgctccggcaagtcctgccgcctccgctggtgcaaccagctctcgccgcaggtggagcaccgccccttcacgcccgaggaggacgacaccatcctccgcgcgcacgcgcgcttcggcaacaagtgggccaccatcgcgcgcctgctctccggccgcaccgacaacgccatcaagaaccactggaactccacgctcaagcgcaagtactacgccgccgccgccgccgccggccatgccgctgctgccgacgcggacgacgagcgcccgctcaagcggaccagcagcgacggccacccggggctctgcttcagccccggcagcccgtcggggtccgacctcagcgactccagccaccacagcctgccctccgtcatgccgtcggctgctcctgccgtgacatcgcagcagcagcagcagcagcagcagcagcacgtgtacaggccggtgccgcgcgcgggcggcg

SEQ ID NO: 34545 - protein, 207 aa, Panicum virgatum
  misc_feature: Ceres CLONE 1956566
  misc_feature (21)..(67): Pfam Name: Myb_DNA-binding Pfam Description: Myb-like DNA-binding domain
  misc_feature (73)..(118): Pfam Name: Myb_DNA-binding Pfam Description: Myb-like DNA-binding domain
  misc_feature: The sequence is a functional homolog of SEQ ID NO 128 in the 11/375,241 US patent application
  misc_feature: The sequence is a functional homolog of SEQ ID NO 166 in the 10/412,699 US patent application
  misc_feature: The sequence is a functional homolog of SEQ ID NO 2272 in the 10/374,780 US patent application
  misc_feature: The sequence is a functional homolog of SEQ ID NO 373 in the 11/479,226 US patent application
  misc_feature: The sequence is a functional homolog of SEQ ID NO 914 in the 11/435,388 US patent application
  misc_feature: The sequence is a functional homolog of SEQ ID NO 1054 in the 10/225,066 US patent application
  misc_feature: The sequence is a functional homolog of SEQ ID NO 144 in the 10/412,699 US patent application
  misc_feature: The sequence is a functional homolog of SEQ ID NO 2264 in the 10/374,780 US patent application
  misc_feature: The sequence is a functional homolog of SEQ ID NO 912 in the 11/435,388 US patent application
  misc_feature: The sequence is a functional homolog of SEQ ID NO 150 in the 10/412,699 US patent application
  misc_feature: The sequence is a functional homolog of SEQ ID NO 830 in the 11/435,388 US patent application
  misc_feature: The sequence is a functional homolog of SEQ ID NO 118 in the 10/412,699 US patent application
  misc_feature: The sequence is a functional homolog of SEQ ID NO 188 in the 10/225,068 US patent application
  misc_feature: The sequence is a functional homolog of SEQ ID NO 2256 in the 10/374,780 US patent application
  misc_feature: The sequence is a functional homolog of SEQ ID NO 284 in the 11/479,226 US patent application
  misc_feature: The sequence is a functional homolog of SEQ ID NO 772 in the 10/225,066 US patent application
  misc_feature: The sequence is a functional homolog of SEQ ID NO 910 in the 11/435,388 US patent application
  misc_feature: The sequence is a functional homolog of SEQ ID NO 126 in the 10/412,699 US patent application
  misc_feature: Functional homolog of the protein sequence given in SEQ ID NO 50733
  misc_feature: Useful for making plants with altered cell wall content and/or composition
MASSSPSCRAGDGKPDVDRIKGPWSPEEDEALQRLVARHGARNWSLISRSIPGRSGKSCRLRWCNQLSPQVEHRPFTPEEDDTILRAHARFGNKWATIARLLSGRTDNAIKNHWNSTLKRKYYAAAAAAGHAAAADADDERPLKRTSSDGHPGLCFSPGSPSGSDLSDSSHHSLPSVMPSAAPAVTSQQQQQQQQQHVYRPVPRAGG

SEQ ID NO: 34546 - DNA, 638 bp, Panicum virgatum
  misc_feature: Ceres CLONE 1956566-R
gacaacgatgaacggctaatcgatccgcggcggcggcggcggcgcgcttgcaagaaggaacggcgtcgccaggcaggccgaaacataggccgtgcggcggcggcggcgggaagtgaagagaagaggagccgagctctaccggcttcgttccaaagctgtcgtcgttcaaacgaaagatccttctcaaaatcccccctgtctagagttccctaaatctagccatttcttttcttcaatctttttccccttttgtccagttccatccagtcttgtagctctaatggaaggaagtctcgaagcgagcagagcagggcgcggagacgaagaaaactcggtcttttcgtctgcctgtaagcctggagactcccctgaaataaggtgcagagcaagaaggatgcttccttccttgccagctgcttgctgcttgttggtgggtaaccagagagtaccatcccagccggagtagtagtagtaggctagtagccatgcatgcatccaatggctgtgtttagctctcccaaagtttccaaattttccgtcacatcgaaatcacatcgaaaaattaaatatagcaaatgacgcatgcatggaacactaaatatgagtaaacaaaataatttattacacagtttggatgc

SEQ ID NO: 34547 - DNA, 1291 bp, Panicum virgatum
  misc_feature: Ceres CLONE 1956571
  misc_feature: Encodes the peptide sequence at SEQ ID NO. 34548
agtcctctcctcgactcctccatatcttcgtcgtcctccattgcctctcgtctcatctactcccgctccgtcagtatccccgtaaccccgcgcgcgccgtcgtgccacccaccaaaccacacctgagctgccggttttccttttcccttccctttccgcgtaaccgcgtggcgtgggagggcagttcggttccggaattgggagcgtttccggcccgttcttggtgccactggaagggagggcggcgccgggagatcgcattgcggcgggctcggtcgggtcgcggcggcatttcgctccggcgttcagtggcttcccgaggcgtttggcttttgtccttgcggcgggcgggcgggcggggctcgaggttggtggccggccaggcgcagcgcctccttttcgcggtcggcttttcggagcggccgctgctggtggcggggtggtggggatgcgccttgcctttccgccgcctcggcgtggcgtcattccgaagcgtttgccgggatttgtattggtttccgcctttctggtagttagataataaaatcgcatcttttggagggctcagctgacgcgaaggttccgggcaatgccgagcatccgagctccggcgtccaagcagacggccacgctacaggtggctgtcaagtgcaggccattgaccgacgacgagcagcggcgctcgcggcatatcatccaggtcattgatgataagactgtggttgtgctggaccccgatctgtcaaaggattacctggacctcatacagaaccggacgaaggagaggagatacacatttgatcacgtgtacccacccggatgctccaattcggatgtgtacaagaatatatcctctaccatttctggtgtagtccaaggccttaatgcaacagtctttgcttatggttctactggaagtggcaagacttacactatggttggaacccatagtgatcctggccttatggttcttagctttcgtacaatttttgagctgataaaaaaggacggcggtccagatacatttgaagtctcatgttcatatctggaagtgtataatgaggttatctatgatttgcttgagaaatcctctggacacctggagcttcgagaagatcctcagcatggcataatagttgctggattgagaagcattaaggttcattctgcagatagaattcttgagctgttgaacataggcaacagtaggcgcaagacagagagtacagaagcaaatgctacctcttcacggtcgcatgctgtcctcgagattactgtaaagcgaaagcag

SEQ ID NO: 34548 - protein, 233 aa, Panicum virgatum
  misc_feature: Ceres CLONE 1956571
  misc_feature (20)..(233): Pfam Name: Kinesin Pfam Description: Kinesin motor domain
MPSIRAPASKQTATLQVAVKCRPLTDDEQRRSRHIIQVIDDKTVVVLDPDLSKDYLDLIQNRTKERRYTFDHVYPPGCSNSDVYKNISSTISGVVQGLNATVFAYGSTGSGKTYTMVGTHSDPGLMVLSFRTIFELIKKDGGPDTFEVSCSYLEVYNEVIYDLLEKSSGHLELREDPQHGIIVAGLRSIKVHSADRILELLNIGNSRRKTESTEANATSSRSHAVLEITVKRK

SEQ ID NO: 34549 - DNA, 659 bp, Panicum virgatum
  misc_feature: Ceres CLONE 1956571-R
accatagtagggcaggagcacctcagttcttactacatgacctctggctgctcgccttattctggtgatagaaaacagtggtccagtggaaggtcaattccatttttttctacaccagaaaaacctaggaagatgagcggattttacccaggaacagaaagcgcacaataccagggcagcaaggaacattctggcagtcatgatttcagtctgcataggaaggattcgtggtccatggagaggaaatgaagggcctcgagatgctcctcgtgcacaaaacagctatcatggctacaatatggcctgcctgacgttcctaacctcggttgctgtgtgcatcatcttctgcctgctgccgacaccaacgtaatgggcttcctgagatctgaagagatgctagcagatttcagccaagttgttgcctttggccacggccacaagattgatgcctctagaccctgctgacattgctcactccaccctgtacagtaagatgctaggtctcatgatctcctcctctttttcttccttcctttgtagagtggttgctgagggtgaatctgaattttgaaccaagattctgtaaatcttccgcggctttaaaagcccttcttcagtaaatccaatgaaaaaggctttcagtgctggtcttcaaaggc

SEQ ID NO: 34550 - DNA, 508 bp, Panicum virgatum
  misc_feature: Ceres CLONE 1956582-R
  misc_feature: Encodes the peptide sequence at SEQ ID NO. 34551
gcaaacacagccaagcccgcaccatcgtttaagtctgatgtatatgcatttggggtgattgtcatggagatgttgacgcggaagagtgcaggagacatcatctcaggccaatctggtgctgttgatctaactgactgggttcagatgtgcaacagggaagggcggggaactgactgctttgaccgggacatcatgggcttggaagaatccccgaggataatggacgagctgctggcgatctcgcttaggtgtatcctacctgtaaatgagaggcctaacatgaagacggtttgcgatgacctgtgttccataacagtgtgagttttccctttggtttccttccccagtgtacatgtaaccgattttctgtctctgtttgtcccgattttttcggtgggttttccagagccttgtagccagggtttgtttgattggtaactgctagtgtaaagaggattcgatccacccattgattgattgatatcaaccattgccgtctttcttcacg

SEQ ID NO: 34551 - protein, 106 aa, Panicum virgatum
  misc_feature: Ceres CLONE 1956582-R
  misc_feature: SWISSPROT Homolog: EC 2.7.11.1 Non-specific serine/threonine protein kinase
ANTAKPAPSFKSDVYAFGVIVMEMLTRKSAGDIISGQSGAVDLTDWVQMCNREGRGTDCFDRDIMGLEESPRIMDELLAISLRCILPVNERPNMKTVCDDLCSITV

SEQ ID NO: 34552 - DNA, 437 bp, Panicum virgatum
  misc_feature: Ceres CLONE 1956582
aaatttggcctttctctcacacatctcactgccacatctctctccatctccaatggtggccgccaccaccagctccccttccccctcctctgcctcctacaaaccctaaccctaggtagttatcgccacttcctccccgcatctatggctgttgtcctcgcgttcattctcctgctgctttgcgggggcgccgccggaaacgaggtggcagcgctgctcgagttatttaagggcatacatggaccgggaccgggaccccgggcaggggtcccgggccccgcgggtgaccaacaaggaaggaggaggagtaggaggctgccccgcctcgtggtccgccttgttgtgctacgggggcgcggtcgtctgcgtggcgctcgacggcctcagcctctccagagagctcaagatggtgactatcgctggggtgcacgagctgc

SEQ ID NO: 34553 - DNA, 599 bp, Panicum virgatum
  misc_feature: Ceres CLONE 1956584-R
  misc_feature: Encodes the peptide sequence at SEQ ID NO. 34554
ccttcaaatcagcaatgttgcaagatttcgccatttgtgaacacgctgtgtgccagatacccatctgttaatttcctcaaggtagatgtgaatgagagccctgctgttgcacgtgccgaaaatgtgaggaccattcccacattcaaaatctacaaaaatggtatgagagtgaaagagatgatctgccccagccaacagctgctggaatactcagtgaggcattatgggatttaggccatgaagccgatgatttgatgtttccttcctcctccagcttctctggagcaagcgcaggcttagctggagcagaaccagtgagtactgaagttcatcttgatgagcgcaagcatgaaaagcaaagagcgactttccccgacattttccatcccgcgccccttacatttccacccatttctccatttgttcattacccaatttattcatttaatctgtctcgtcggtacatcattgttgcaaaattccttagaacaaaaacatcatctcctgattcatgtgaagaacgactgtaaatttttacttccatgtttaccagacaaccaaggaaagaaaggtatagattgcatttttgtactcactat

SEQ ID NO: 34554 - protein, 77 aa, Panicum virgatum
  misc_feature: Ceres CLONE 1956584-R
  misc_feature (1)..(74): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
PSNQQCCKISPFVNTLCARYPSVNFLKVDVNESPAVARAENVRTIPTFKIYKNGMRVKEMICPSQQLLEYSVRHYGI

SEQ ID NO: 34555 - DNA, 668 bp, Panicum virgatum
  misc_feature: Ceres CLONE 1956584
agccagccagccagccagatcactctcctcgcctccgcgcccttgccttgttacggcgtgcgtgcgtgcgtgttaccgccgccgccgcccccgcccccgcccagcctcgggagcgagggagaggaagcaaatctacccccaactccgcggctagccttcatcattccttgctccctccctcccctcccctccccttcacgagatccccatcccgttcctcctcctccccccttccgccgcactagcggtagcgggcgagccacccacccccgtctccggccaccccgccagccgccgcgagatccgcaatgtcccaccgcccgccggcgccaatgccgcccgacaccctctccgacgccttcgccgccgccgtcctcctctcctccaccgacaagcccgacacgctcccgccgggcaggctctccctctcccgcgccccgcccgcgctcgcctcgcgccgcagccactccggcgagatcccgctcccctccgacgcgcccccgcgcggcccgcgcccgggacaccgccgcaccggcagctccgggcccctcatcttcacctccgccgccagcgcctgctccagctccgccacctccccgctcaccaacgcgctcccggccggcaacatctgcccctccggccgcctcgccaagccgctgccctcctcc

SEQ ID NO: 34556 - DNA, 651 bp, Panicum virgatum
  misc_feature: Ceres CLONE 1956585-R
  misc_feature: Encodes the peptide sequence at SEQ ID NO. 34557
gcagaaagtcacatacatgttgtccccatgtgaactctagcgagcttcaagcggatgaaatatttatccaatcaatatgctggccggtatgacctcatagtggcattttgccctactggttgggcatttggcaaagggaagaaaaagacacctggcaaaaggttgcgacaaggatcaatcatcagatatgaagtgccgtatagtgaacacagcagcttcacggaactgcaagaatttgtcaagttcatatcaccggagcacataatccctagcgtgaacaatgacggtcctgagagtgcagatgctatgcttgcccagctgttaaacgactagtggaatttgttgctccaacatcttcggctgaatacaagtcgctgtccggagatcaaagcaaagggaagttaaacgtccaacgatttcggaactgaagggggaaacacgcgagggtttccctggctgattccaaggatttctgatgcggaaaccaggaggcacggacgcacggtggacggtgctgtatttctaaatgcctcggcgaagctactgcacttctcaccggggatagcttgggcattgtgactgtcacgcgagtaagctcgcaggggctgggtgtaatggactggtgaacccatcacgttgactttgatcttc

SEQ ID NO: 34557 - protein, 92 aa, Panicum virgatum
  misc_feature: Ceres CLONE 1956585-R
  misc_feature (1)..(75): Pfam Name: DRMBL Pfam Description: DNA repair metallo-beta-lactamase
  misc_feature: Functional homolog of the protein sequence given in SEQ ID NO 51464
  misc_feature: Useful for making plants with modulated low light sensitivity
  misc_feature: Useful for making plants with modulated nitrogen use efficiency
MKYLSNQYAGRYDLIVAFCPTGWAFGKGKKKTPGKRLRQGSIIRYEVPYSEHSSFTELQEFVKFISPEHIIPSVNNDGPESADAMLAQLLND

SEQ ID NO: 34558 - DNA, 1188 bp, Panicum virgatum
  misc_feature: Ceres CLONE 1956585
aaaaaatgaaaaatttcacttcccagttccccacctcgcctctcggcctttcccactcatccgcttgcaggaggcacagatgccggcgaatcgcaagctctcggcgaagctgtcgccgtcgccggcggccgtttccaccccgtgcccgaaatccacccctcccttcctcggcgactgtgacgacgacgacgacttccaatctccccgcggccgcccattgaagctctgcaatgccgccaccgcgcgccgcccccgtaagaagctcaagccgtcctcctcctcctcaggaaaggagaacagttacgtcgccggtggcgccgtttctgcggtgacggtcgccgcgagggccccgaagggtgctggaaccctagccgccggttcgaggattagcggcggcactcttgagacgaagaaactgatgcccggaggaagttgcggcctctcgaggtacggatctgatgtagccgaattaggctgtaacgggaagatagaattggatgaacacggatattgcaagggagtttcagttttaccagttccttggcgctcggtgcggtmtgtgatttaggagatggctgttgcggggaggcacaagtagtggactctagtgcctcagttcctgagacgcggtgtgccacgaacgaggtggcaagctctaagtttgatcctccaacaatggaaaagaagccgaggagctctgaagctcttgaggggtgttaccaatccagattggttgaaccggggattcttgaatcagatgcaaactgtgaatttgtaacttcaggctcctattgttcagaagggcttgattcagggatttttggctcagtcactgatgaacagaatatggacagagaagctagggtgacatctgaatgtggagctgggcttcataaagggaataacagtttggattctcttgtgtcaaagcttccaatatcgaatgcaaatcagggttctaggggtggtgactgcagcaaagcccaagagcctggtttgcaagcatgtaacttggattctcaagagaggaaagtagctgcaggacattgtgcaacccctgaaaatgagactatggagaataaatccagtggtcctgatgcttctaaggggcgttgcttctccaattcatctgaaccaaagcttgtagaaccacatatgatccatgaatttgaagctgatgattatgat

SEQ ID NO: 34559 - DNA, 683 bp, Panicum virgatum
  misc_feature: Ceres CLONE 1956598
  misc_feature: Encodes the peptide sequence at SEQ ID NO. 34560
acacaccaaggccagagagagagaggagacacccaccactccaatggatcactccacctccctgctccggctcatcttcctcgccctcggggccgcccttgtcctcctcgtgctccgctccgcgttccaccttccacgcggcatcgacacgccaacaacctcgctcttcgacgcggccgccgccgcgggcagcagctgcacccggttcgcgccgtgggggtgccggaagggcgaccggacgaagcccaagccgccgtcgcacgagacagacgtgccgcggcacccgctggacccgctgacagtcagcgagatcaaccgcgcgcgcgagatcctccgcgcgcacccaccgttcgcgtcgtcgccgtcgtccctgttcgtgcactcgctcgcgctagacgagccagagaaggccgtcgtcctgggatggcggaagggcgtcgacccgctgcccccgcgccgcgccgtggcggtcgtccggttccgcggcgaggccttcgtcctcgccgtcgacctcgccggtggcgccgtgactcctctgcctgtccccgcctccgggtacccaaccatgaccatggacgagcaggtgtccctctgcttcgcgccgttcgctgacccggcgttcaacgccaccatccgccggcgcggcgtccggctgtccgatgtggcgtgcctgcccatctccc

SEQ ID NO: 34560 - protein, 213 aa, Panicum virgatum
  misc_feature: Ceres CLONE 1956598
  misc_feature (80)..(168): Pfam Name: Cu_amine_oxidN2 Pfam Description: Copper amine oxidase, N2 domain
  misc_feature: SWISSPROT Homolog: EC 1.4.3.6 Amine oxidase (copper-containing)
MDHSTSLLRLIFLALGAALVLLVLRSAFHLPRGIDTPTTSLFDAAAAAGSSCTRFAPWGCRKGDRTKPKPPSHETDVPRHPLDPLTVSEINRAREILRAHPPFASSPSSLFVHSLALDEPEKAVVLGWRKGVDPLPPRRAVAVVRFRGEAFVLAVDLAGGAVTPLPVPASGYPTMTMDEQVSLCFAPFADPAFNATIRRRGVRLSDVACLPIS

SEQ ID NO: 34561 - DNA, 655 bp, Panicum virgatum
  misc_feature: Ceres CLONE 1956598-R
  misc_feature: Encodes the peptide sequence at SEQ ID NO. 34562
acagggacctggtgatgtggtacacgctggggttccatcacatcccgtgccaggaggacttccccatcatgcccaccgtgtcttctggcttcgacctcaagcccgtcaacttcttcgagagcaaccccatcctcaagcagcgaccgaccatggaggaggacctgccggtctgtgccgccgccaccactgcgtgagccccatagctggaaggcgaggtgatgctttagtgcatcatctatcagtggctctggagtagagcgtgttattatgtaccattgggcatatagggccgggccagggcaggactgatgattaattggagccatgtcctgtgtgctcttgctgctagtagctactccggatatatagtaagtatgtgatgataatgcagctgtgtgatctcatgatctgctgtactctatgtcaaaactaaatgaggacttccaattgctatgacatcactagatagcccttggattatagaagagcgatagatctacgcggccatgctgtcagacaaaaatatggctgttcagttagaagtctttattgatgtgggcatgacacgcatggatacgatcattcaacaaaaatatacggtgagcttgttcctatacacttttagcaattttaagaatggtaaagtttgttgggc

SEQ ID NO: 34562 - protein, 63 aa, Panicum virgatum
  misc_feature: Ceres CLONE 1956598-R
  misc_feature: SWISSPROT Homolog: EC 1.4.3.6 Amine oxidase (copper-containing)
RDLVMWYTLGFHHIPCQEDFPIMPTVSSGFDLKPVNFFESNPILKQRPTMEEDLPVCAAATTA

SEQ ID NO: 34563 - DNA, 1374 bp, Panicum virgatum
  misc_feature: Ceres CLONE 1956616
  misc_feature: Encodes the peptide sequence at SEQ ID NO. 34564
acccggcatccccattcttggagcccacctctctccaccccacccccattttcaattctgaaatgcgagctcaaagcagtgcggatgatgcagtgcagtgctgcagtttgattgtttcttggttttgggaattcggggaggctgggggaattggggattggatggcttggtaactatgagctcgtctcttgtgtgcttttgcacttgggaagagtgtgatccgcgcgtggaggttttgctctagcttagtgcttgctgtctggtcaccactgaatggctgcagcaatgggttcaatatctgcctatggttcttaccaaacaaataggcccagtgcactgaagcagacacctcacatgcaattccaacaatgttgtagaggtggagttaggtttgtaagcaatcattcccaatccgtgcgaagtaagacacggctgtccaaaagaagagccacaaataatggaattcgtccaaagactaccaggtctcaggcacctattgtatgttccactggaatgaccataatttttgttgcaactgaagtacacccatggtgcaaaactggtggcctcggtgatgttgtaggaggactgcccccagctctggctgccctgggacaccgggtcatgacgatagctcctcgctatgatcaatacaaggatgcatgggatacaaatgtccttgttgaggtaaatgttggtgacacagtagaaactgttcgcttcttccactgctacaaaagaggagttgatcgtatttttgttgatcaccctatgtttcttgaaaaggtatggggcaagactggtgcaaaattgtatggtcctactactggaactgactatagagataaccagttgaggttctgccttttgtgccttgctgctttggaggctccaagagttctcaatctcagcaattctgaatacttttctggaccttatggtgaagatgttgtcttcgtagcgaatgattggcacactgcagttctgccctgctatctgaagagcatgtataagccaaatggaatttatgcgaatgctaaggttgctttctgcattcacaacattgcctatcaaggtagatttgccagagcagacttcgaagttcttaatctacctgacagtttcttgccttcatttgattttattgatggacatgttaatcctgtactagggagaaagattgactggatgaaggcagggattgttgagagtgatctggttctaacagttagtccacattatgtcaaggaactcacttctggcccagacaaaggtgttgagttggatggtgtccttcgcacaaagcccctcgaaactggaattgtaaatggcatggatgtttatgaatgggatccttcaacagataagtacatc

SEQ ID NO: 34564 - protein, 362 aa, Panicum virgatum
  misc_feature: Ceres CLONE 1956616
  misc_feature (78)..(339): Pfam Name: Glyco_transf_5 Pfam Description: Starch synthase catalytic domain
  misc_feature: SWISSPROT Homolog: EC 2.4.1.242 NDP-glucose--starch glucosyltransferase
  misc_feature: The sequence is a functional homolog of SEQ ID NO 4 in US patent 7169982
MGSISAYGSYQTNRPSALKQTPHMQFQQCCRGGVRFVSNHSQSVRSKTRLSKRRATNNGIRPKTTRSQAPIVCSTGMTIIFVATEVHPWCKTGGLGDVVGGLPPALAALGHRVMTIAPRYDQYKDAWDTNVLVEVNVGDTVETVRFFHCYKRGVDRIFVDHPMFLEKVWGKTGAKLYGPTTGTDYRDNQLRFCLLCLAALEAPRVLNLSNSEYFSGPYGEDVVFVANDWHTAVLPCYLKSMYKPNGIYANAKVAFCIHNIAYQGRFARADFEVLNLPDSFLPSFDFIDGHVNPVLGRKIDWMKAGIVESDLVLTVSPHYVKELTSGPDKGVELDGVLRTKPLETGIVNGMDVYEWDPSTDKY

SEQ ID NO: 34565 - DNA, 664 bp, Panicum virgatum
  misc_feature: Ceres CLONE 1956616-R
  misc_feature: Encodes the peptide sequence at SEQ ID NO. 34566
ttcaaacgtcccattagcacatatgatgtttgctggggctgacttcatcattgtcccaagtaggtttgagccctgtggtctcattcagttgcaagggatgagatatggagtgatccccatctgttcatcaactggaggacttgtagacacggttaaggagggtgtcaccggattccacataggtcccttcaatgtcgagtgtgaaactgtcgatacagctgacgtcgcagcagtggcatcaactgtcacacgcgctctggaacagtacgccaccccggtgttccatgagatgattcagaactgcatggtgcaggacctgtcctggaaggggcctgcgaagaagtgggaggaggtgcttcttggcctcggggtcgagggaagtgaggcgggcatcgagggcgaggagatcgcccctcttgccaaggaaaatgtggccactccctgaagcctcacgtgcctgtgaaatatgcattaagcattatgacatgttgagccagtcacaggcataggttaaaatttcttagccttccatgacatgttgagccagtcacaggcaaagccactagtttcacgcctctacgtcatgtgtaatataatgcttgatattctaaagaaggcttgcctggtttggttcatgcgccacgttagctggatgtttcgaccc

SEQ ID NO: 34566 - protein, 147 aa, Panicum virgatum
  misc_feature: Ceres CLONE 1956616-R
  misc_feature: SWISSPROT Homolog: EC 2.4.1.21 Starch synthase
  misc_feature: The sequence is a functional homolog of SEQ ID NO 4 in US patent 7169982
SNVPLAHMMFAGADFIIVPSRFEPCGLIQLQGMRYGVIPICSSTGGLVDTVKEGVTGFHIGPFNVECETVDTADVAAVASTVTRALEQYATPVFHEMIQNCMVQDLSWKGPAKKWEEVLLGLGVEGSEAGIEGEEIAPLAKENVATP

SEQ ID NO: 34567 - DNA, 762 bp, Panicum virgatum
  misc_feature: Ceres CLONE 1956620
  misc_feature: Encodes the peptide sequence at SEQ ID NO. 34568
atgagggaagtgggtcaagttggaggttaacaaagtctggaacacctggaaatattggtagttttgaagacattctgtttgcaaataatgacatgcaagattcaccagtcattgttgctttgtttccagtgttccgggaaactcagctgtatgtagggctaagttttttggatatgaccaacaggaagcttgggttagctgagttccctgaagatagccaattcacaaatgttgaatcagcacttgttgcattaggttgcaaggagtgtcttctcccagtagattgtgagaaatcccttgatttgaatccccttcaaaatgccattcggaattgtaatgttctattgactgaaaaaaagaaggctgacttcaaatccagagatcttgcgcaagatcttggtagaataatcaggggttctgttgagccagttcgtgacctgctatctcagtttgactatgctcttggtgcccttggagctctgttatcttatgccgagttgctagcagatgatactaactatggaaattacataattgagaagtacaatttgaattgctacatgagacttgattctgctgctgtgcgagcattaaatattgcagaagggaaaactgatgtgaacaagaacttcagtttgtttggtttgatgaacagaacctgtactgttgggatgggaaagagattgctgaatagatggctgacacaacctctattagatgtaaatgaaatcaataacagattagatatggttcaggctattg

SEQ ID NO: 34568 - protein, 253 aa, Panicum virgatum
  misc_feature: Ceres CLONE 1956620
  misc_feature (35)..(177): Pfam Name: MutS_II Pfam Description: MutS domain II
EGSGSSWRLTKSGTPGNIGSFEDILFANNDMQDSPVIVALFPVFRETQLYVGLSFLDMTNRKLGLAEFPEDSQFTNVESALVALGCKECLLPVDCEKSLDLNPLQNAIRNCNVLLTEKKKADFKSRDLAQDLGRIIRGSVEPVRDLLSQFDYALGALGALLSYAELLADDTNYGNYIIEKYNLNCYMRLDSAAVRALNIAEGKTDVNKNFSLFGLMNRTCTVGMGKRLLNRWLTQPLLDVNEINNRLDMVQAI

SEQ ID NO: 34569 - DNA, 588 bp, Panicum virgatum
  misc_feature: Ceres CLONE 1956620-R
gaagttaaatatgctttacaaggttgaacctggggcatgcgaccaaagttttggtattcatgttgcagaatttgctaattttccagaagctgttgttgctcttgcaaaaagcaaagcagcagaattagaagacttttttactacacccgtgttttctgacgactcaaaagaagaggttgggtcaaagcgcaagagggtatttagcccagatgatgtgacaagaggggctgctcgggctcggcttttcctggaggaaatggcagcattgcctataggtgagatggatgggagccagaccatggagatagccaccaaactgaaagccgacttgcagaaagatgcagccgacaatccttggcttcaacagttcctttgaagcgtattagtttgaatttcgttaaggtaaaactgttagtgaactacgctggtgctaggacctcctgatccattttggttaatatgcattggcgtatattgttctttaggcttaactgaactagtaggctatgcaaaacgacctgcaaaaaacatgtgtacatatggcggtagcacacctgctgaatgcttaatcggccgcagtctgtgttg

SEQ ID NO: 34570 - DNA, 539 bp, Panicum virgatum
  misc_feature: Ceres CLONE 1956624
  misc_feature: Encodes the peptide sequence at SEQ ID NO. 34571
tcacccaccgctctccctcctccctgtgtgtttgttttatagcatctctttgagcagccgagtgctcgaggtaactaacaatggcgcccgctcaatgtgtggctgtgcagagggtgttccccttcggcaagggcaagagcgagggcaacaggggcatgaaggacctgctgggcggcaagggcgcgaacctggcggagatgtcgagcatcgggctgtcggtgccgccggggttcacggtgtcgacggaggcgtgccagcagtaccaggaggccgggcggtcgctgcccgcggggctgtgggccgagatcctcgacggcctggcgtgggtggaggagtacatgggcgcgcgcctcggcgacccgcagcgcccgctcctgctctccgtccgctccggcgccgcggtgtcgatgcccggcatgatggacacggtgctcaacctggggctcaacgacgaggtggccgccggcctggcccgcaagagcggcgagcgcttcgcctacgactcgtaccgccgcttcctcgacatgttcggcaacgtc

SEQ ID NO: 34571 - protein, 152 aa, Panicum virgatum
  misc_feature: Ceres CLONE 1956624
  misc_feature (11)..(152): Pfam Name: PPDK_N Pfam Description: Pyruvate phosphate dikinase, PEP/pyruvate binding domain
  misc_feature: SWISSPROT Homolog: EC 2.7.9.1 Pyruvate, phosphate dikinase
MAPAQCVAVQRVFPFGKGKSEGNRGMKDLLGGKGANLAEMSSIGLSVPPGFTVSTEACQQYQEAGRSLPAGLWAEILDGLAWVEEYMGARLGDPQRPLLLSVRSGAAVSMPGMMDTVLNLGLNDEVAAGLARKSGERFAYDSYRRFLDMFGN

SEQ ID NO: 34572 - DNA, 659 bp, Panicum virgatum
  misc_feature: Ceres CLONE 1956624-R
  misc_feature: Encodes the peptide sequence at SEQ ID NO. 34573
tgctaacaatgttttcactgctatgggtaaaaccattgagtacaaaattggaactatgattgaaattcccagggcagctctagtggctgatgagatagcagagcaggctgaattcttctcttttgggacgaacgaccttacacagatgacatttggctacagcagggatgatgtggggaagtttctccccatttatctttctcagggtatcctccaacatgatccctttgaggtgcttgatcagagaggagtgggcgagctggttaagttagctacagagaggggacgcaaaactaggcctaacctgaaggtgggcatctgtggagaacatggtggggagcctctgtcagttgctttcttcgcaaaggctgggctggattacgtttcttgctcccctttcagggttccgatcgctaggctggctgccgctcaggtgctcatttgagagcacctcctcatcggcaaccggatcgccagctgttggtgtatctggtgaagaataatcatacagggccatggaacggtggaaactttgcttcctggcaaaggctgttgtatgtagtcttctccgtgtgggtgcgcatgtaagccttaatgggtggtgttttgaatttcccttgaactgccatggtaatgtagtaccaaattgaacatcgacg

SEQ ID NO: 34573 - protein, 147 aa, Panicum virgatum
  misc_feature: Ceres CLONE 1956624-R
  misc_feature (1)..(147): Pfam Name: PEP-utilizers_C Pfam Description: PEP-utilising enzyme, TIM barrel domain
  misc_feature: SWISSPROT Homolog: EC 2.7.9.1 Pyruvate, phosphate dikinase
ANNVFTAMGKTIEYKIGTMIEIPRAALVADEIAEQAEFFSFGTNDLTQMTFGYSRDDVGKFLPIYLSQGILQHDPFEVLDQRGVGELVKLATERGRKTRPNLKVGICGEHGGEPLSVAFFAKAGLDYVSCSPFRVPIARLAAAQVLI

SEQ ID NO: 34574 - DNA, 1398 bp, Panicum virgatum
  misc_feature: Ceres CLONE 1956632
  misc_feature: Encodes the peptide sequence at SEQ ID NO. 34575
acggcacccaaaacctagccctccactccaccgcgcctccgtcccctcccctcccctccccgatctcgcctggccgcgagccggcggtcccccagatccgcctgccccctccaaccgccccgccgccagatccgggcctgccccggcaaaaccccgcggcgccgcataccaggccgggggagagcggaggcttaggtctcagcagccatggcggccgcggaggagaacacctcgctgttcctgatcttcatcctcaccatgatcgcgctgccgctcgtgccctacacaatcatgcgcctgtgccgcgccgcctccgagaaggccaagaccatccactgccgctgctcggggtgccaccgctccgggaagtaccgcaagtcgatctacaagaggatatccaacttctcgacgtgcagtaacctgaccatcgttttactctggattgttatgatattcctggtttactacatcaagcatgttagccgtgaggtccatgtttttgagcctttcagcattcttggactggaacctggggcatccgaatctgaaatcaagaaatcatacaggaggctttctattcaatatcatcctgataaaaatcctgatccggaggcccataagtactttgttgaatatatatccaaggcatatcaggcattaactgatcctgtgtctcgtgaaaattatgaaaagtatggtcaccctgatgggcggcaggggttgcaaatgggcatagctttgcccaagttcttactgaatattgatggcacatctggtgggataatgcttttagggatagtcggattttgtatactgttgcccttgatgatagcagttatttatttgtcaagatcgtcaaagtatacgggaaattatgtcatgcatcaaacactgtccacttactactactttatgaagccatctcttgctccaagcaaagttatggatgtcttcatcaagtctgcagaatatatggagatgccggttcgacgcagtgatgatgaacccctgcagaaattgtttgtagctgtgagaagtgagttgaatctggacttaaagaacattaagacagaacaagcaaaattctggaagcagcatccatcactagtaaagatggaactcttgattcaggcgcatctcactcgggagtcatttgccttgaccccagcacttctaaaagattacaggcacatgcttgaacttgcacctcgtcttctagaagaactagttaagattgcagttctaccacggaatccacatggttttggatggctcaggcctgcaactggtgttattgagctttctcaaaatatcatccaggctgtaccgctaagtgcgcgaaaagctagtggtggtaactcagaaggaatagcgccattcttgcagctgccacatttc

SEQ ID NO: 34575 - protein, 396 aa, Panicum virgatum
  misc_feature: Ceres CLONE 1956632
  misc_feature (99)..(161): Pfam Name: DnaJ Pfam Description: DnaJ domain
MAAAEENTSLFLIFILTMIALPLVPYTIMRLCRAASEKAKTIHCRCSGCHRSGKYRKSIYKRISNFSTCSNLTIVLLWIVMIFLVYYIKHVSREVHVFEPFSILGLEPGASESEIKKSYRRLSIQYHPDKNPDPEAHKYFVEYISKAYQALTDPVSRENYEKYGHPDGRQGLQMGIALPKFLLNIDGTSGGIMLLGIVGFCILLPLMIAVIYLSRSSKYTGNYVMHQTLSTYYYFMKPSLAPSKVMDVFIKSAEYMEMPVRRSDDEPLQKLFVAVRSELNLDLKNIKTEQAKFWKQHPSLVKMELLIQAHLTRESFALTPALLKDYRHMLELAPRLLEELVKIAVLPRNPHGFGWLRPATGVIELSQNIIQAVPLSARKASGGNSEGIAPFLQLPH

SEQ ID NO: 34576 - DNA, 632 bp, Panicum virgatum
  misc_feature: Ceres CLONE 1956632-R
atgacgtctggttatcccaaaaggtcagcttcatggatgaggcaactgccattactgcagcatcaaaagctatacaagaaacccaggaggcattgggtgcaagtgcaaaggaaataggaattgcagttagggaggcagttgacagggtgaagaaaggcagtaggttggtaatgggcaagtttcaagctccagcagagggcactcacaacctgacttccttctgtttgtgcgactcgtggataggctgcgacaccaagaccagcttcaagctgaaggtcctgaagcgcagccgtgcaggaaccaggggccatgtgcccgaggaagggcctgtggcagcagcagaggatggcattgaggaggaagaggaggaagaggaagaggagtacgatgactatgagagtgagtacagtgatgacgaggaggatgagaagaacaaggggaagggaaaggggaaggtggcgaatggagcagcccatcaaggggctgactctgatatagattctggcagcgatgagtgatactatacaagcaatatatgcttttaacaccattctgttttgactgttgtaccccgtgaattttaacatacccccaatttatagagtcagccgtaatatttacttggttttgct

SEQ ID NO: 34577 - DNA, 422 bp, Panicum virgatum
  misc_feature: Ceres CLONE 1956639
  misc_feature: Encodes the peptide sequence at SEQ ID NO. 34578
ccgaatttgcaaagaaatgggttcctttctgcaaaaagtttaatattgagcctcgtgctcctgagtggtacttccaacagaagatagactacctgaaagacaaggttgccgcatcctttgttagggacaggagggcaatgaagagagaatatgaggaattcaaggtaagaatcaatgccttggttgcgaaagcccaaaaggttcccgaggaaggatggacaatgcaggatggaagcccctggcctggaaacaacgtacgcgatcatcctggaatgattcaggtattccttggccaaagcggtggtcatgatgtggaaggaaatgagctgcctcgcctcgtttatgtctcgagagaaaagaggccaggctatgatcatcataagaaggctggtgccatgaatgcactggttcgtgtctctgct

SEQ ID NO: 34578 - protein, 139 aa, Panicum virgatum
  misc_feature: Ceres CLONE 1956639
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Functional homolog of the protein sequence given in SEQ ID NO 50499
  misc_feature: Useful for making plants with altered cell wall content and/or composition
  misc_feature: Useful for making plants with modulated biomass
  misc_feature: Functional homolog of the protein sequence given in SEQ ID NO 50124
  misc_feature: Useful for making plants with altered carbohydrate content
  misc_feature: The sequence is a functional homolog of SEQ ID NO 6 in US patent 7285702
  misc_feature: The sequence is a functional homolog of SEQ ID NO 2 in US patent 7049481
EFAKKWVPFCKKFNIEPRAPEWYFQQKIDYLKDKVAASFVRDRRAMKREYEEFKVRINALVAKAQKVPEEGWTMQDGSPWPGNNVRDHPGMIQVFLGQSGGHDVEGNELPRLVYVSREKRPGYDHHKKAGAMNALVRVS

SEQ ID NO: 34579 - DNA, 299 bp, Panicum virgatum
  misc_feature: Ceres CLONE 1956639-R
ccctttccggtggtgccccccggagcagggggatgacggcgattgtttgttgagtaaattaaagttaagttatataccatgcacattccattccccccacagttggcacattagcgaagaacagatgattggttaggagttgattctttgtaagacctgcccgctcgccggaaacacgcggcgcgtgggcagcgatgtgttttttttttttttttgcttccgtggaatcgtatagaaactcccccactttttggtgctgtttcttgacgttttgaaagaagcaaagattggaaatgcgg

SEQ ID NO: 34580 - DNA, 1174 bp, Panicum virgatum
  misc_feature: Ceres CLONE 1956642
  misc_feature: Encodes the peptide sequence at SEQ ID NO. 34581
aaaaacaaaaaaatccgcctacctcgccggcgacaggggcgaccgcacgcgccccacgccggtgccaatcccgaccgccccatgcacccattctgctgcgcgccgctcgtgcccgtgtcgcccgcggcctccgccgcctccgccgcggccgcgtcctccgcggtggcgggcgccccggtgatgatgccgccgccgcagcccccgccgctgccgcctccgccgccgcgaagcaactctgctcccgtcagtgagaggcgggcgcgcgcggcgggggcgagcggtggcggaagaggcggttcctccccgcccgagggaatgaaactgaacgagatcgtcggcggcggcatctcgggaatcctgtacaagtgggtcaactacgggcgcgggtggaggccgcgctggttcgcgcttcacgacggcgtgctctcctactacaagatccacgggcccgaccgcatcgtcctctcgcgcgggaccgagcggggcgccaaggtcatcggcgaggactccctccgccgcctcaaccgcccctccaccccctcgtcctcccactccaacggccatcatcagcctcgcaaccccatcggcgaaatccacctcaaggtgtcaactgtgagggagagcagatcggacgacaagagattctcgatcttctcgggcacgaagacgctgcacctgcgagcggagacaagggaggacagggcggcatggctggaggcgctgcgagcgaccaaggacatgttcccgaggatgtcatcgagcgagatggtcgggccaggggacaccgcagcagccgtggctgtctcaaccgagcgcctaaggcagcggctgcagcaggaaggggtcagcgaggcggccattgctgacagcgagaagatcgtgcgggcagaattcgaggctctgcacaagcaacttgtgctctccaagcagaagcatgcgcttctcgtggaaactcttcgccagctagagacagaaaaggttgatttggagaatacccttgtcgatgagagccaaagacagtcgaaagagtatggatctgcttctaaatcaaggcatgacaagtatagtgaaggaagtgctagtgaatctgatgattataatgaaccacaagatcctgctgaagagactgatgatgatgagaacatttactttgataccagagattttctatcat

SEQ ID NO: 34581 - protein, 364 aa, Panicum virgatum
  misc_feature: Ceres CLONE 1956642
  misc_feature (87)..(219): Pfam Name: PH Pfam Description: PH domain
MHPFCCAPLVPVSPAASAASAAAASSAVAGAPVMMPPPQPPPLPPPPPRSNSAPVSERRARAAGASGGGRGGSSPPEGMKLNEIVGGGISGILYKWVNYGRGWRPRWFALHDGVLSYYKIHGPDRIVLSRGTERGAKVIGEDSLRRLNRPSTPSSSHSNGHHQPRNPIGEIHLKVSTVRESRSDDKRFSIFSGTKTLHLRAETREDRAAWLEALRATKDMFPRMSSSEMVGPGDTAAAVAVSTERLRQRLQQEGVSEAAIADSEKIVRAEFEALHKQLVLSKQKHALLVETLRQLETEKVDLENTLVDESQRQSKEYGSASKSRHDKYSEGSASESDDYNEPQDPAEETDDDENIYFDTRDFLS

SEQ ID NO: 34582 - DNA, 653 bp, Panicum virgatum
  misc_feature: Ceres CLONE 1956642-R
aactgttgctacactatttggaaagtgggatgaaagtatgcactatgtaatgggtgattgctttgggaaaggcaagggatctgaacagttctcagaggcgcatttgctgtggaaaagaagcaaaccacctaagtttcccactagatacaatctcactcgctttgcaattacattgaatgaacttacccctggattgaaggagaaactgccaccgacagactcaagattacgaccagatcagagatgtctggagaatggtgaatatgaaagggcaaatgctgagaagttgaggcttgaacagaggcagcggcaggcacgaaagatgcaggagagcgggtggaagcctaggtggtttgcgacggacaaagctactgacacataccgttacactggtggttactgggaatccagagaaaaaggcagctgggatggctgccctgacatctttggacaagtccctaacgatctgatgataactgactaggtttgagtaggttacaggtcttttggttctctgccgttttggggatcacttgattccagaaattttagtggttcatattagagcaattaaatgcccgttgacatgtaagcaatggcagtgcatcggataatattggcctcgtacataataagaagagaatggttcatcc

SEQ ID NO: 34583 - DNA, 841 bp, Panicum virgatum
  misc_feature: Ceres CLONE 1956645
  misc_feature: Encodes the peptide sequence at SEQ ID NO. 34584
actcttcagctctcttccccttccatcactcccccacacccaccaccaactccccaagcgctcgctatggcagcacccacgggagcttgcggctccaactccccttcttcaacgtgctagcgttcttagctggtgactatggcggcggtggcgagcagggagaggctctccccgggctccgcgccgcaggtggacacgggcaagtacgtgcggtacacaccggagcaggtggaggcgctggagcgcgtctacagcgagtgccccaagcccagctcgctgcgccggcagcagctcatcagggactgccccatcctcagcaacatcgagcccaagcagatcaaggtctggttccagaaccgcagatgccgggagaagcagcgcaaggaggcctctcgcctgcaaactgtgaatcggaagctgagtgcaatgaataagctgttgatggaggagaatgaccggctgcagaaacaggtgtcccgtctcgtctatgacaacgggtacatgaagaatcaacttcacagtccttctgtagccaccacagacacaagctgtgagtctgtggtgacaagtagtcagcactaccaacagcaaaacccagcagttccgcctcctccaaaaagggacgcgaacaacccagcaggtctactcgctatcgctgaggagaccttggcagagttcatgtccaaggcgactggcactgccgtcaactgggtgcaaatggttgggatgaagcctggtccggattccattggaatcatcgctgtttcacacaactgcagtggcgtagcagcacgagcttgcggccttgtgagccttgagcccacaaaggttgcggagatcc

SEQ ID NO: 34584 - protein, 234 aa, Panicum virgatum
  misc_feature: Ceres CLONE 1956645
  misc_feature (22)..(80): Pfam Name: Homeobox Pfam Description: Homeobox domain
  misc_feature: Functional homolog of the protein sequence given in SEQ ID NO 50330
  misc_feature: Useful for making plants with altered carbohydrate content
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 2 in US patent 7056739
  misc_feature: Functional homolog of the protein sequence given in SEQ ID NO 50331
  misc_feature: Useful for making plants with altered lignin content
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
MAAVASRERLSPGSAPQVDTGKYVRYTPEQVEALERVYSECPKPSSLRRQQLIRDCPILSNIEPKQIKVWFQNRRCREKQRKEASRLQTVNRKLSAMNKLLMEENDRLQKQVSRLVYDNGYMKNQLHSPSVATTDTSCESVVTSSQHYQQQNPAVPPPPKRDANNPAGLLAIAEETLAEFMSKATGTAVNWVQMVGMKPGPDSIGIIAVSHNCSGVAARACGLVSLEPTKVAEI

SEQ ID NO: 34585 - DNA, 490 bp, Panicum virgatum
  misc_feature: Ceres CLONE 1956645-R
  misc_feature: Encodes the peptide sequence at SEQ ID NO. 34586
tacctccctggcggcacgtgccagtcgagcatggggcggcaggcatcgtacgagcaggtggtgacctggaaggttgttggcaacgacggcgcgccgcagggccttgcgctcatgctctccaactggaccttcatctgacgctgctcctgagctttcggcctcaccattttcatcagatggtgactgtatcctactctactacgtagtttgcttgcatcgcacctgtttgcatgttgtgtgtgctgtaatgactggagacctgaaatgtctgctgctcctgctacgttctaagttgatgctgtatcctttggatcaagacagtgctgctgcaacttgtgtgaggttaaagacctagtattatccttgtcatgagatgtattggtgagcttggaccatgccatggtttcagtggtgttgtgctgttcagtgttcaggacaattcagagattgaagaagtctgcttgatgcagtgttcctgtaaatttccccc

SEQ ID NO: 34586 - protein, 45 aa, Panicum virgatum
  misc_feature: Ceres CLONE 1956645-R
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
YLPGGTCQSSMGRQASYEQVVTWKVVGNDGAPQGLALMLSNWTFI

SEQ ID NO: 34587 - DNA, 1135 bp, Panicum virgatum
  misc_feature: Ceres CLONE 1956654
  misc_feature: Encodes the peptide sequence at SEQ ID NO. 34588
agattccatcgaatccttccttctaactctccaccgcgggaaggaaggagggagacgaagcagaagcttctcgcagggccttcccgttcggcggcgtttgtggcggggcgactccgggcgccatgagcagcagcaagcaggcgctgatttacagcttcgtcgccaagggctccgtcgtgctggcggagcacaccgccttctccggcaacttcagcaccgtcgccgtccagtgcctccagaagctgccccccaacagcaccagatccacctactcctgcgatggccacaccttcaacttcctcgtcgaccgcggcttcgtgttcctagtggtcgcggatgaggcggccgggaggagcgttcccttcgtcttcctagagagggttagggaagacttcatgcagcggtatgggtccagcatcgacgaggaggggcagcacccgctcgctgatgatgcggacgaagatgactttctgttcgaagaccgcttcagcattgcctacaaccttgaccgtgaattcggcccgaggttaaaggatcatatgcagtattgtgttaaccmcccagaggaaattaacaagctctccaaggtgaaggcccacctgtcagaagtcaaagggatcatgatggataatattgagaagatattggaccgtggtgagaagattgagcttttggtggggaagactgagaccttgcaatcacaggctgacaccttccacaggcatggcagagagctgaggcgaaagatgtggcttcagaacctaaggttcaagctgatggttggtggaggcattgcagctctgattctcatcctttggctgatggtctgcaggggattcaaatgttagatcgctcgaaatcattgctcgccctctcactttttttttaaaaaaaagaagtgtttgtgttgttgaccgtttcacatgcacagaatggtcaccgaatcatgtttcagtcatgctgtgggtattggtatcgcttagcagatgttaattctgtgcggtccttgccgtgtttcatatgataatggtaggcagctatagtacctgtgatagataactttgtgggagaaggggatatgacactatgacctttattgtctgtacattctgaaatgcaaactcttattatttgg

SEQ ID NO: 34588 - protein, 241 aa, Panicum virgatum
  misc_feature: Ceres CLONE 1956654
  misc_feature (149)..(237): Pfam Name: Synaptobrevin Pfam Description: Synaptobrevin
  misc_feature (146)..(146): Xaa is any aa, unknown, or other
MSSSKQALIYSFVAKGSVVLAEHTAFSGNFSTVAVQCLQKLPPNSTRSTYSCDGHTFNFLVDRGFVFLVVADEAAGRSVPFVFLERVREDFMQRYGSSIDEEGQHPLADDADEDDFLFEDRFSIAYNLDREFGPRLKDHMQYCVNXPEEINKLSKVKAHLSEVKGIMMDNIEKILDRGEKIELLVGKTETLQSQADTFHRHGRELRRKMWLQNLRFKLMVGGGIAALILILWLMVCRGFKC

SEQ ID NO: 34589 - DNA, 1933 bp, Panicum virgatum
  misc_feature: Ceres CLONE 1956660
  misc_feature: Encodes the peptide sequence at SEQ ID NO. 34590
aatcgtgctcctttctcaccaaactaggcacgaactaactcaagctgtacaccgagctagctaacaaaccagctgcactgctacagtatgtctagtagccgagacgagatcaagaccacgagcttgatccaaggccatgtcgagttattccgcctcatgttcagccacctcaagtcgcaggcgctcagatgcgccggcaatctaggcatccctggagccatccaccgtcgcggtggcgcggcgacaatctccgacatcattacggagaccgggctcccccaatcgaagctccaacacctccggcgtctcatgcgcgtgctcgccgtctccggcgtcgtcgcagccagcaaccagccgccgtcgtcagccgcggagtcgtgcaccggcgacaccatctacacgctcaccccggtgtcctccctcctcgtcggcggcgagggggcctcgccgttcgacatgtccgccctgctgcgcgccttaatgcgccccactacgacggccatgttctttcacctggaggagtggttcagggacgacaccggcgcggagtcgctcgtccacatggtgcacggctcgtcgccgtggaccctgaccaagaacgacaccaccctcaacaccgccctcaacgacgcgtgtgtcgccgataccaacctggtcatgcaggtggtgctcacggaggccggcgacgtcttccgcgggatcggctcgctggtcgacgtcggcggcggccacggagcggccgcgattgccatctcccgggcattcccgcaggtcaagtgcaccgtgctggacctcccgcacgtgataagccaagcgccggagcatagcacggtgcagttcgtcgccggggacatgttcgacttcattccaccagcagatgccattttcctcaaggtgtagtgcacgcttctctcttctccttcgactttttttttctttcaaaacgcacgacagatctctcgctaccggaaacgcatatttgtcgagtgcctccggcttcgccgaatgcccgaacatgagcactcggcaaagcgcctctttgccgagtgcccaaggcgccgcactcggcaaacacccggcactcggcatgcccaacctttgccgagttccggccgtcggcaaagaagggacactcggtatcatttatctttgccgagtgccggccagcactcggcgaagggggcgcaggtgcccagcacgcgtgcccgctgtccgcctttctaacagtcggctgatggacgttagctttgccgagtgctgcaagactggcactcgggaaagacttaacttcgctgagtgactgtagccggcactcggcaaagacagtttcgctcggcaaagagtttctttttttttacattcaaacttttttattctcaactcaaatttgaaaagtcaatccctgatagcatatgatacttttattgattattttagagtgtatatctgcttttgccgagtgtatccgacactcggcaaagccgctgaatccagtagtgcctgttggcggccaacaagtaacactattactactgtgatgacgttgaaacatttatctatggacgctgttatatatgtttgcagggtgttatggatagtttcagtgatgaggactgtgtcaaactacttcgacagtgcaagaaagcaattcatagggacagtgccggaggaaaaatcataatcataaattcggtaattggatttgggccgcaggacgatgttgtcagagaggcgcaagttttatttgatttgtacatgatgtgtggcaacggggccgagcaagaagagcatgaatggaagaggatcatcttagaagctggattcagcgaattcaaagtcgtggcaacattaggtctagtatctgtcatcgaggttctcccctaaataagcccttgaggaaacaataaagcgttttgctccatgaagtttgcac

SEQ ID NO: 34590 - protein, 270 aa, Panicum virgatum
  misc_feature: Ceres CLONE 1956660
  misc_feature (99)..(269): Pfam Name: Methyltransf_2 Pfam Description: O-methyltransferase
  misc_feature (31)..(79): Pfam Name: Dimerisation Pfam Description: Dimerisation domain
  misc_feature: SWISSPROT Homolog: EC 2.1.1.146 (Iso)eugenol O-methyltransferase
MSSSRDEIKTTSLIQGHVELFRLMFSHLKSQALRCAGNLGIPGAIHRRGGAATISDIITETGLPQSKLQHLRRLMRVLAVSGVVAASNQPPSSAAESCTGDTIYTLTPVSSLLVGGEGASPFDMSALLRALMRPTTTAMFFHLEEWFRDDTGAESLVHMVHGSSPWTLTKNDTTLNTALNDACVADTNLVMQVVLTEAGDVFRGIGSLVDVGGGHGAAAIAISRAFPQVKCTVLDLPHVISQAPEHSTVQFVAGDMFDFIPPADAIFLKV

SEQ ID NO: 34591 - DNA, 532 bp, Panicum virgatum
  misc_feature: Ceres CLONE 1956663
  misc_feature: Encodes the peptide sequence at SEQ ID NO. 34592
gcccgagtcgccgcccaacgccgacgtcggcgtcgacgggatggtgagcgtcatcgcgcacgagctggcggagctggcgtccaacccgctggccaacgcgtggtacgcggggacggacccgtcgttcccgacggagatcgccgacctctgcgagggcatctacggcaccggcggcggcggcgcgtacacggggcagctgctgacggacgcgcgctccggcgccgcgtacaacgtcaacggcgccggcggccgcaggttcctcgtgcagtgggtgtggaaccccgtgctcagctactgctccggccccaacgcgctcgaccaggactaggcggagttgcatcgcatccgctgtccaaggattgatggtttgctggccgatgcatcatcatccatcgtcgtctagcacgtactagtagtgttctatctccatggattcggtttcctttctcgggaaaatccatggaatgtttttgtatagagttcgtcagtggagtgtgaaggaaggtggcgagagccgccagcaggaagagtg

SEQ ID NO: 34592 - protein, 108 aa, Panicum virgatum
  misc_feature: Ceres CLONE 1956663
  misc_feature (1)..(103): Pfam Name: Phi_1 Pfam Description: Phosphate-induced protein 1 conserved region
  misc_feature: Functional homolog of the protein sequence given in SEQ ID NO 51465
  misc_feature: Useful for biocontainment applications
PESPPNADVGVDGMVSVIAHELAELASNPLANAWYAGTDPSFPTEIADLCEGIYGTGGGGAYTGQLLTDARSGAAYNVNGAGGRRFLVQWVWNPVLSYCSGPNALDQD

SEQ ID NO: 34593 - DNA, 777 bp, Panicum virgatum
  misc_feature: Ceres CLONE 1956675
  misc_feature: Encodes the peptide sequence at SEQ ID NO. 34594
actttgctccgcttccctccgcttgacgcgagccgcgcgggagcacgagcccatggcgacgacgccggcgccggcgacggcgtccgcgctgcacaagtcgggggcggtctccaagggctacaacttcgcgtccacttgggagcagaatgcgccgctcacggagcagcagaaggccgcgatcgccgcgctctcccacgccgtctccgagcggccgttcccagcgaacctggaaaagagttcagggaaggatggaggtgtgacagttccagagaaagagtctgctttggaggaggctggtgcaatggatgcggtcttggtgaatacacatcagttctacaagtggtttgcagaactggagtcagctatgaaatctgagacagaggagaagtatcgcctctatgagaatacactacaggagcgtgtcaatacatgtgacggcatccttaagcaagttgatgatacattgaacttgtttgaagaactgcagtccttgcactcgagtgttgccacaaagactaaaactttgcatgatgcttgtgaccaactgttggttgagaaacaaaggctgattgagtttgcagaggcacttcgaagtaggctcaactactttgacgaattggaaaatgtctcaagcagcttttattctcaaaatatgaccatcggaaatgaacagtttctcccacttttgaagcgccttgatgattgtatctcatatgttgaaaacaacccacaatatgctgaatctgctgtttacttggtcaagtttcgccaacttca

SEQ ID NO: 34594 - protein, 241 aa, Panicum virgatum
  misc_feature: Ceres CLONE 1956675
  misc_feature (109)..(241): Pfam Name: Sec34 Pfam Description: Sec34-like family
MATTPAPATASALHKSGAVSKGYNFASTWEQNAPLTEQQKAAIAALSHAVSERPFPANLEKSSGKDGGVTVPEKESALEEAGAMDAVLVNTHQFYKWFAELESAMKSETEEKYRLYENTLQERVNTCDGILKQVDDTLNLFEELQSLHSSVATKTKTLHDACDQLLVEKQRLIEFAEALRSRLNYFDELENVSSSFYSQNMTIGNEQFLPLLKRLDDCISYVENNPQYAESAVYLVKFRQL

SEQ ID NO: 34595 - DNA, 654 bp, Panicum virgatum
  misc_feature: Ceres CLONE 1956675-R
aatgctttcttttgttactaaggtaactgccgtaaaagttgcattgtcctctggtagccagggtcagaagttggattctgttctagcaaagcccctgaagactcaagcttttgcttctccagataaagttgctgagttggttcagaaggttgccgctgctattcaacaagatttgcccaaagtaatgaccaagatgaggttgtatttgcaaaatccatctactcggatgatcttattcaaacctatcaagacaaatatagtggaggctcatgtacagctgcaatcccttctgaagtctgaatactcgactgaggaaatgcaatccatcggtatgttgccgatacctgatttgcagtctcagctcgacagccttttgtagcatgtatacagtcgcaatccttggtacaaacctcttcggagattacagtgcagttccttcgagtataaccaaagtaaaagttgttgtcacacttaccaacctctaccaggttgctgttgtaaattttccttgttttatgttgaaatggagatggaaccaaagagacatgatgtagctcatgctggacatcttttacgaatggctgctgtaccattattctggttctgggagttcgaatgcgtatcccactatatagcgatttgtgtatattgcac

SEQ ID NO: 34596 - DNA, 1198 bp, Panicum virgatum
  misc_feature: Ceres CLONE 1956685
  misc_feature: Encodes the peptide sequence at SEQ ID NO. 34597
acaaagcggccgcggagccgtctgcttccttccgtcgtcctccttccccgcctcccacggcagggaattgaagcagcaaccaccatcttccacgaccagcagcagcagcagcggaccatggcttccatcatcttcttcctcgtcaccagcaaccgacgctcgcatcactgccgttcctctctctagcctgaattgaaccttccttcctctaaccacccactcaccattcgatcgataaaggataagttaattacacaagaggatcgatgaagctcgccgtggagatctccgacgcgtccgacctcgcgcccaaggacggcgcggcgtcctgcaacccctacgtggaagtcgacttcgacggccagcggcagcgcacggccaccaagccggccgaccggagcccctactggaaccagacgctcgtcttcgacgtccgcgacccaggcaggttcccttccctccccatcgacgtctccgtcctccacgaccgccgcctcaccgaccacaacgccctccgcccccacaccttcctcggccgcgtccggatcaacgcctcctccgtcccgcagtccccgcacgaggccgtgctccagaggtacccgctcgagaagcgagggctcttctcccgcgtctccggcgacatcgccctcaggatctacctcatccacgatggtaatccgaccaacaatggcgccgccgctgctgttgctgacatgggcggcgctcctgcacccaaccagcagcaggaacaggaggccgccggcggcgaggccgaaaggatcctccgctccgccttcggggcggcgccgcaagtccagcagcaggagaagaatcatggccacgagcacgagcaggcacggcctcgcatcttccgctccgtgcctacgtcgtcagcctccgccggagaaaaccaccagcagcagcagcctcgccggacgctccacgccgtggcggcgccgccgccgccgccggggcagacggtggtgatgccgcggcccgctggcccacccccggccgccccggcgccgggctccgctttcggcctggtggaaaccaagccgccgctgccggccaagatgggcccacgggccgcggcggcggccgcggccaagatcgcgtcgacctacgacatggtggagcccatgacgtacctgtacgtgagcgtgatcaaggcgcgggacctcccgaccatggacgt

SEQ ID NO: 34597 - protein, 310 aa, Panicum virgatum
  misc_feature: Ceres CLONE 1956685
  misc_feature (3)..(93): Pfam Name: C2 Pfam Description: C2 domain
MKLAVEISDASDLAPKDGAASCNPYVEVDFDGQRQRTATKPADRSPYWNQTLVFDVRDPGRFPSLPIDVSVLHDRRLTDHNALRPHTFLGRVRINASSVPQSPHEAVLQRYPLEKRGLFSRVSGDIALRIYLIHDGNPTNNGAAAAVADMGGAPAPNQQQEQEAAGGEAERILRSAFGAAPQVQQQEKNHGHEHEQARPRIFRSVPTSSASAGENHQQQQPRRTLHAVAAPPPPPGQTVVMPRPAGPPPAAPAPGSAFGLVETKPPLPAKMGPRAAAAAAAKIASTYDMVEPMTYLYVSVIKARDLPTMD

SEQ ID NO: 34598 - DNA, 642 bp, Panicum virgatum
  misc_feature: Ceres CLONE 1956685-R
  misc_feature: Encodes the peptide sequence at SEQ ID NO. 34599
ctcatcctcgtgtgctacccggagytcatcctgcccacggtgttcctatacctcttcatgatcgggctctggaactaccgcaggcggccgcgcaagccgccgcacatggacacggtgctgtctcacgccgagctcgtgcacccggacgagctcgacgaggagttcgacacgtttccgacgagcaagccgggggacgtggtgcggatgcgatacgaccggctgcgaagcgtggcggggcgcgtgcagacggttgtgggtgacctggcgacgcagggggagcgcgcgcaggcgctgctgagctggagggacccgagggcgacggccatcttcgtgatgcttgcgctggtggtggccgtggtgctctacgtgacgccgttccaggtggtggccgtggtgttggggctctacctgctgcggcacccgcggttcaggagcaagcagccgtcggtgccgttcaacttctacaagaggctgccggccaagacagacatgctgctctgaaagtctgaatgatgactacgctagttctttctttatttcttctttttgttatttattatgtatttactacattccattctcgtcatcgtcagtaataatttaataataatggtggtaataaaataaggacagcaagtacat

SEQ ID NO: 34599 - protein, 166 aa, Panicum virgatum
  misc_feature: Ceres CLONE 1956685-R
  misc_feature (11)..(166): Pfam Name: PRT_C Pfam Description: Plant phosphoribosyltransferase C-terminal
  misc_feature (9)..(9): Xaa is any aa, unknown, or other
LILVCYPEXILPTVFLYLFMIGLWNYRRRPRKPPHMDTVLSHAELVHPDELDEEFDTFPTSKPGDVVRMRYDRLRSVAGRVQTVVGDLATQGERAQALLSWRDPRATAIFVMLALVVAVVLYVTPFQVVAVVLGLYLLRHPRFRSKQPSVPFNFYKRLPAKTDMLL

SEQ ID NO: 34600 - DNA, 656 bp, Panicum virgatum
  misc_feature: Ceres CLONE 1956694
  misc_feature: Encodes the peptide sequence at SEQ ID NO. 34601
acacacacaacccgctcgtcttcgcctcctccaccttcacctccgaatcccgctgcctccaccgccaccaccggcgccctcgccgcggcgccgtgcgctccgatgatcacgttcgcggacctgacggagccggccgcggccggcgtggactggcagctgtggctggcctgcgcgggcgggatgtgcaccgtgccgcccgtgggcgccagcgtctactacttcccgcagggccacgcggagcacgcgctgggcctcgccggggcggccgacctctccgcggcgcgcgtcccggcgctcgtcccctgccgcgtcgccgccgtgcggtacctggccgacccggacaccgacgaggtcttcgccaggatccgcctcgccccgctcctcgccggggaggcggacgccggccccgacgacgacgcggccgcgggcgacgagcaggagaagccggcgtccttcgccaagacgctgacgcagtccgacgccaacaacggcggcgggttctccttgccgaggtactgcgcggagaccatcttcccgcggctcgactacgcggccgacccgcccgtgcagaccgtcgtcgccaaggacgtgcacggggtggcgtggaagttcgccacatctaccggggcacccgcgcccgcatctgctcaccacgg

SEQ ID NO: 34601 - protein, 184 aa, Panicum virgatum
  misc_feature: Ceres CLONE 1956694
  misc_feature: The sequence is a functional homolog of SEQ ID NO 1184 in the 10/666,642 US patent application
  misc_feature: The sequence is a functional homolog of SEQ ID NO 1185 in the 10/666,642 US patent application
  misc_feature: The sequence is a functional homolog of SEQ ID NO 1186 in the 10/666,642 US patent application
  misc_feature: The sequence is a functional homolog of SEQ ID NO 1428 in the 10/666,642 US patent application
  misc_feature: The sequence is a functional homolog of SEQ ID NO 1431 in the 11/479,226 US patent application
  misc_feature: The sequence is a functional homolog of SEQ ID NO 168 in the 10/666,642 US patent application
  misc_feature: The sequence is a functional homolog of SEQ ID NO 442 in the 10/666,642 US patent application
MITFADLTEPAAAGVDWQLWLACAGGMCTVPPVGASVYYFPQGHAEHALGLAGAADLSAARVPALVPCRVAAVRYLADPDTDEVFARIRLAPLLAGEADAGPDDDAAAGDEQEKPASFAKTLTQSDANNGGGFSLPRYCAETIFPRLDYAADPPVQTVVAKDVHGVAWKFATSTGAPAPASAHH

SEQ ID NO: 34602 - DNA, 617 bp, Panicum virgatum
  misc_feature: Ceres CLONE 1956694-R
  misc_feature: Encodes the peptide sequence at SEQ ID NO. 34603
tgaccgagaacagcccgaccaagaactactcgtcgtcggagcggcccccgtggttcagggacggcagccaggcccccgaggtcgccgggctggagcccgggcagtgcaaggtgttcgtcgagtccgacacggtcggccgcaacctcgacctctcggcgctgggctcgttcgacgagctctacgggcgcctgtccgagatgttccgcatcgagagcgcggagctgcggagccgcgtgctctaccgcggcgccgccgccgacgtgaagcacgccggcgacgagcccttcagcgtcttcgtcaagtcggcacggaggctcacgatactaaccgacgccgggagcgacaacctagggagctagacgagcagcgtcagtgaccaatccaaagccgcaagcattccgttcctggtactactgctactagtagtagtagcaactccgttgcggctctgaagagagagatagatagatagacctccccgtggcagctcgcaagcaatgccacaatcattgggcacacttagttctaccctctctccccgtgtatccctgtcaaatgtaaaacgtgggggtaaccctagtactctgatgcatcttgtcaatcccttgtccgtattc

SEQ ID NO: 34603 - protein, 118 aa, Panicum virgatum
  misc_feature: Ceres CLONE 1956694-R
  misc_feature: The sequence is a functional homolog of SEQ ID NO 1185 in the 10/666,642 US patent application
  misc_feature: The sequence is a functional homolog of SEQ ID NO 1184 in the 10/666,642 US patent application
  misc_feature: The sequence is a functional homolog of SEQ ID NO 442 in the 10/666,642 US patent application
  misc_feature: The sequence is a functional homolog of SEQ ID NO 1428 in the 10/666,642 US patent application
  misc_feature: The sequence is a functional homolog of SEQ ID NO 1431 in the 11/479,226 US patent application
  misc_feature: The sequence is a functional homolog of SEQ ID NO 168 in the 10/666,642 US patent application
TENSPTKNYSSSERPPWFRDGSQAPEVAGLEPGQCKVFVESDTVGRNLDLSALGSFDELYGRLSEMFRIESAELRSRVLYRGAAADVKHAGDEPFSVFVKSARRLTILTDAGSDNLGS

SEQ ID NO: 34604 - DNA, 1348 bp, Panicum virgatum
  misc_feature: Ceres CLONE 1956697
  misc_feature: Encodes the peptide sequence at SEQ ID NO. 34605
gtcccgtgtgttctctgtttggaaaggcggagggaggggggaagcgaagttctcggagaggtcgccatcgtcggagttcctccactatctcgcggcttggcagctttcctgcaaggctatctaaatggagcctcacaatggcaaggctgatgacttgcctcctcctccacctctagatgcgggtattgaacctcttaaagctgatgaaacaaagaagatgttgaaacctaagagggctctggtccctaggcagggttttggcaaaaaggggcagccaataaagcttctaacgaaccacttcaaagttttgctgaagaacactgaagagtttttctatcactactatgtgaatttgacatatgaagatgatacacctgttgatagcaagggagcagggcggattgtgattgagaaacttcagcaaacctatgctactgaacttgcaaataaagattttgcatatgatggtgagaagagcctgttcacaattggtgctcttcctcaaattaataacgagttcactattgtggtggaagacgcttcaactggaaagactcctgcaaatggcagccctggtaatgacagttcacctggaagtgacaggaaaagggtccgaagaccttacaatacaaagacgtacaaagttaggctgtctttcgcagcaaaaattcctatgagtgcaatcgcacttgctctgaaaggtcaggaatcagagcatactcaggaagcaattcgagtgattgatattattctgaggcagcattcagcaaagcagggttgcctcttggttcgtcaatcattcttccataacaatccatctaactttgttgaccttggaggtggtgtaatgggctgtagaggattccattctagtttccgtgccacacagagtggactttcacttaatattgatgtgtcaacaacaatgattgtaaaacctggacctgttgctgattttctgatggccaaccagaaggttgacaacccaaacatgattgactggacaaaggcaaagcgctcattgaagaacttgaggataaaaataaccccaacaaatacagaaaacaagattgttggtctgagtgacagatcttgccgagaaacaatgtttacactaaagcgtagagatggtgactctgaagagatcagtgtttttgactacttcgtaaagaaccgtcgcatagagctcaggtactctggtgactttccttgtatcaacgtgggaaaaccaaagcgtccaacttattttcctatagagctctgtacgcttgtgtctttacaaagatacaccaagtcattgagtacacttcagaggtcttcacttgttgagaagtctaggcagaaaccc

SEQ ID NO: 34605 - protein, 407 aa, Panicum virgatum
  misc_feature: Ceres CLONE 1956697
  misc_feature (273)..(407): Pfam Name: PAZ Pfam Description: PAZ domain
  misc_feature: The sequence is a functional homolog of SEQ ID NO 2 in the 11/375,241 US patent application
  misc_feature: The sequence is a functional homolog of SEQ ID NO 2562 in the 10/374,780 US patent application
MEPHNGKADDLPPPPPLDAGIEPLKADETKKMLKPKRALVPRQGFGKKGQPIKLLTNHFKVLLKNTEEFFYHYYVNLTYEDDTPVDSKGAGRIVIEKLQQTYATELANKDFAYDGEKSLFTIGALPQINNEFTIVVEDASTGKTPANGSPGNDSSPGSDRKRVRRPYNTKTYKVRLSFAAKIPMSAIALALKGQESEHTQEAIRVIDIILRQHSAKQGCLLVRQSFFHNNPSNFVDLGGGVMGCRGFHSSFRATQSGLSLNIDVSTTMIVKPGPVADFLMANQKVDNPNMIDWTKAKRSLKNLRIKITPTNTENKIVGLSDRSCRETMFTLKRRDGDSEEISVFDYFVKNRRIELRYSGDFPCINVGKPKRPTYFPIELCTLVSLQRYTKSLSTLQRSSLVEKSRQK

SEQ ID NO: 34606 - DNA, 794 bp, Panicum virgatum
  misc_feature: Ceres CLONE 1956729
  misc_feature: Encodes the peptide sequence at SEQ ID NO. 34607
aatagcagcctctgcgccccttcgccttccaggaccaggactcgtgctcgcccccaccgcaccgcgcgacactcccgtcccgtcaccatgcgccgcccgtggaggcacccgaccccggcggcagccgccgtcgcgcggcgccacggcgcggcggacctctgcttccgcgaggtcggggacctcctcccccgccacttcgcccgccgcgcggccggctccgaggaccttgtgatgcggcttcaggttcaccggaagcttgacaggcacacgggctgcgtcaacacagtgggcttcaatgagctcggtgataccctcatatcagggtccgacgaccagatggtgatgctgtgggactgggacactggttccgtcaaattggagttccattctggccatggtgggaatgtgttccaggcacgcttcatgccctgcacagacgataggaccattgtcacctgtgctgccgatggcgaggtgagactcgccaaggtacaggatggtggagatgtgtccactacattgcttggtgaacacgggggaagggctcataatttgtctgtagagcctggtagcccttatatcttttacagctgtggcgaggatggccttgttcaacattttgatctcagaacaaacacagccacaaaactattcctctgcagaagttctttgaggaaatcaggattctcctcctgtgttcaccttaatgcgattgcaatggatccaaggaacccaaatctttttgcagttggaggaagcaatgcatatgctcgtgtgtatgacatccgcaagca

SEQ ID NO: 34607 - protein, 235 aa, Panicum virgatum
  misc_feature: Ceres CLONE 1956729
  misc_feature (51)..(89): Pfam Name: WD40 Pfam Description: WD domain, G-beta repeat
  misc_feature: SWISSPROT Homolog: EC 2.3.1.48 Histone acetyltransferase
MRRPWRHPTPAAAAVARRHGAADLCFREVGDLLPRHFARRAAGSEDLVMRLQVHRKLDRHTGCVNTVGFNELGDTLISGSDDQMVMLWDWDTGSVKLEFHSGHGGNVFQARFMPCTDDRTIVTCAADGEVRLAKVQDGGDVSTTLLGEHGGRAHNLSVEPGSPYIFYSCGEDGLVQHFDLRTNTATKLFLCRSSLRKSGFSSCVHLNAIAMDPRNPNLFAVGGSNAYARVYDIRK

SEQ ID NO: 34608 - DNA, 619 bp, Panicum virgatum
  misc_feature: Ceres CLONE 1956729-R
  misc_feature: Encodes the peptide sequence at SEQ ID NO. 34609
gggtcagactgtggtcggatatttatttggagaaagagagatgggaagtttttacgagccatggagggtgatgagtgcatagtgaattgcattgagcctcatcctcatgatatgacaattgcaagcagtggaattgataatgatgtaaaaatgtggacttcctctgccatcgagcgagcacctgtggtaaatattgaggagttgagacctcgcaagagaagagccaagctttggcactttgacttaccagagctgttgatccggcacttactggcatcagagcgtaggcaacaatcaactgaagaagattcatcggaggaccttgaggacagcacaggattacttagtctagtactacatgctgctgatggaagtgtgtcatcgactgatgatgaagagatctttgatggctctgaagagtttgcagtcaactgatctgttgtccaactttcagggccatttcaaaattgtacatatacatcaataagttatcatgctcttatggatgatatagcagcaaagtgtggtttagtagcttgtcgtttctatgttataggtatgtgtttcggaggccattttaatgaaaaatttgagttgttttttttttctcgaacagcag

SEQ ID NO: 34609 - protein, 144 aa, Panicum virgatum
  misc_feature: Ceres CLONE 1956729-R
  misc_feature (15)..(53): Pfam Name: WD40 Pfam Description: WD domain, G-beta repeat
GSDCGRIFIWRKRDGKFLRAMEGDECIVNCIEPHPHDMTIASSGIDNDVKMWTSSAIERAPVVNIEELRPRKRRAKLWHFDLPELLIRHLLASERRQQSTEEDSSEDLEDSTGLLSLVLHAADGSVSSTDDEEIFDGSEEFAVN

SEQ ID NO: 34610 - DNA, 1416 bp, Panicum virgatum
  misc_feature: Ceres CLONE 1956731
  misc_feature: Encodes the peptide sequence at SEQ ID NO. 34611
ggaggagtcacacaccaaggcccatctaaagctccttgctcttgtcacttgtaagcaagcaccagccaccttgcttctctctctcacacgcacacacatcatggtgggcatgagaggtgcctacggcggtggtggttacagcaatggcaatgagagccgaccgcttggagcggcggcggcggcggcggctccaatgacgacgtcgacggagatcgcgtcgatggcggtgcacaaggtggcgccgcctccgccgcagagcacggcgagcaagatgaaggcgagggtgaaggagaccttcttccccgacgatccgttccgagggttcaaggggcagccgctggggacgcagtggctgatggcggtcaagtacctgttccccatcctcgactggttgcccggctactccttgtcgctgttcaagtccgacctcatctccggcctcaccattgccagcctcgccatccctcagggtatcagctacgcgaagctggcaagcttgcctcccataatcggcctgtattcgagcttcgtgccgccgatggtgtacgcggtgctggggagctcgcgcgacctggcggtgggcccggtgtcgatcgcgtcgctggtgatgggctcgatgctgcgcgacgccgtgagcccctccggcgagccgctgctgttcctgcagctggccttcacctccaccctgttcgccggcgtggtgcaggcctccctcggcatcctccggctggggttcatcatcgacttcctgtcgagggcgacgctggtggggttcatggccggcgccgccatcatcgtgtcgctgcagcagctcaaggcgctgctgggcatcacccacttcaccacccagatggggctcgtccccgtcatggcctccgtcttccaccacaccaaggagtggtcgtggcagacgattctcatgggcgtgtgcttcctggtgttcctgctcgcggccaggcatgtgagcatgagatggccaaaacttttctgggtttcagcatgcgcgcccctggcatctgtcatcatctccaccctgctcgttttcctcttcaaagctcagaatcatggcataagcattattggccagctcaagtgtggtctgaaccgcccctcatgggacaagctactctttgaccccacatatttaggcctaaccatgaagactggccttatcaccgggatcctctcccttatggaaggaattgcagttggtagaacatttgcttccctgaaggactaccaagtagatggaaacaaagagatgatggctatagggttgatgaacgttgtgggctcatgtacatcctgctatgtaacaacaggagcattctcccgctctgctgtaaaccacaatgccggctgcaagactgccatgtcgaatgtggtcatggcactaactgtgatggttacactgct

SEQ ID NO: 34611 - protein, 438 aa, Panicum virgatum
  misc_feature: Ceres CLONE 1956731
  misc_feature (205)..(438): Pfam Name: Sulfate_transp Pfam Description: Sulfate transporter family
MVGMRGAYGGGGYSNGNESRPLGAAAAAAAPMTTSTEIASMAVHKVAPPPPQSTASKMKARVKETFFPDDPFRGFKGQPLGTQWLMAVKYLFPILDWLPGYSLSLFKSDLISGLTIASLAIPQGISYAKLASLPPIIGLYSSFVPPMVYAVLGSSRDLAVGPVSIASLVMGSMLRDAVSPSGEPLLFLQLAFTSTLFAGVVQASLGILRLGFIIDFLSRATLVGFMAGAAIIVSLQQLKALLGITHFTTQMGLVPVMASVFHHTKEWSWQTILMGVCFLVFLLAARHVSMRWPKLFWVSACAPLASVIISTLLVFLFKAQNHGISIIGQLKCGLNRPSWDKLLFDPTYLGLTMKTGLITGILSLMEGIAVGRTFASLKDYQVDGNKEMMAIGLMNVVGSCTSCYVTTGAFSRSAVNHNAGCKTAMSNVVMALTVMVTL

SEQ ID NO: 34612 - DNA, 702 bp, Panicum virgatum
  misc_feature: Ceres CLONE 1956731-R
  misc_feature: Encodes the peptide sequence at SEQ ID NO. 34613
tgggaactgacatttcccgggacctgcatcagtacaaggaggctcaaagagttcctrggatcttaatctkggcaattgaagcaccgataaacttcgctaactccaactaccttaacgaaaggattaaaagatggatagaggaagaaaattccacgcagaacaaacaaactgaactccatgttgtaatcttggatctgtcagctgttcctgcaattgacacaagtggcattgcgttcctcattgacataaagaaatcaatagagaaacgtgatctggaacttgttctagtgaatccaaccggagaggtcatggagaaaatacagcgagcaaatgttgctcaaaaccatttcaggtcggattgcctgtatttgaccactggggaggcagttacttcactttctgcacttgccaagatgacaaagccctagagtggtactgaattatcattgagctcatccaatgatccatttcggaattgcactgctaaagttgttagtgcaagattttccattacagaaagtagtgcctccatcaaagtatttcataatatgtttgtatgtaattttcacaattcttcagatctatgtggggtgtaaatttagcgctggaatgtgatgaagaattgagaatatgtacattcatggatacccgtcattagctgtctacatgagaaaaatatgacagcaaaatattagtgcttac

SEQ ID NO: 34613 - protein, 141 aa, Panicum virgatum
  misc_feature: Ceres CLONE 1956731-R
  misc_feature (11)..(128): Pfam Name: STAS Pfam Description: STAS domain
  misc_feature (19)..(19): Xaa is any aa, unknown, or other
  misc_feature (23)..(23): Xaa is any aa, unknown, or other
GTDISRDLHQYKEAQRVPXILIXAIEAPINFANSNYLNERIKRWIEEENSTQNKQTELHVVILDLSAVPAIDTSGIAFLIDIKKSIEKRDLELVLVNPTGEVMEKIQRANVAQNHFRSDCLYLTTGEAVTSLSALAKMTKP

SEQ ID NO: 34614 - DNA, 662 bp, Panicum virgatum
  misc_feature: Ceres CLONE 1956747
  misc_feature: Encodes the peptide sequence at SEQ ID NO. 34615
aaggcgacgacgcgtcaatcgattccttcctccacctcctccttccccggcgacgcctgtctcctcctccgatccacacacccccgagagatcgatcgatcgccgatcgatccggcccccgagcacacgatccacccagcaaccgaccggccgccggcgcgagcgcaagattcagatttgccccggcgcgcgggaggggccggagaaggagggcgagccaggatgggcgcgtggatgtcgcgcgtgtggttcctgatgttcccggcgcgggagtacaagctcgtcgtggtggggctcgacaacgcgggcaagaccaccacgctctacaagctccacctcggcgaggccgtcaccgccgcgcccaccatcggcagcaacgtcgaggaggtcgtcttcaagaacctgcgcttcgaggtcagcttccctccctcctcccttgctcccccgtccgggccacagagcacggatattaggctggggattcgcttcgcggctagcttgctccgcgccacggtcgccgccggatcgagcgacgcggtagagccggaggcgcgtttgtccgttaggcttcctaagatctatgctctacaggtcgaggggaaaggtgaaatttcgcgccttttttattaatattacttccctgtatgtacaattcctaggaa

SEQ ID NO: 34615 - protein, 135 aa, Panicum virgatum
  misc_feature: Ceres CLONE 1956747
  misc_feature (5)..(133): Pfam Name: Arf Pfam Description: ADP-ribosylation factor family
MGAWMSRVWFLMFPAREYKLVVVGLDNAGKTTTLYKLHLGEAVTAAPTIGSNVEEVVFKNLRFEVSFPPSSLAPPSGPQSTDIRLGIRFAASLLRATVAAGSSDAVEPEARLSVRLPKIYALQVEGKGEISRLFY

SEQ ID NO: 34616 - DNA, 574 bp, Panicum virgatum
  misc_feature: Ceres CLONE 1956747-R
  misc_feature: Encodes the peptide sequence at SEQ ID NO. 34617
tgaatgcgccaggtgtgggatctaggtggacaagagagcctacgaacttcatgggcaacatactaccgaggaactcatgctgtcatcatagtaattgacagcaccgaccgcgctcggatcaacatcatcaaggacgagctcttccggttgctccaacacgcagatctggagggtgcagtggttctcgtgttcgcgaacaagcaggacctcaaggacgccatgtcccccgccgagatcaccgatgccctctccctccacagcataaagaaccatgactggcacatccaggcctcgtgcgccatcaccggtgagggcctgtacgacggcctgggttggatcgcccagaaagtcgctggcaaggcgacagcaagctgacgccgattgactgtgtttccatggatttattgaatgtggcaggatgggtttgttcttactgccaccgcctttagtgtttgttttgtttatgttgcaaggctgcctgaaaactgtgtctgtattccaaccaatctgaatataaaaattgaaaggagcaaatttgcacggtgtcaaatatgagattttatctgattcttgc

SEQ ID NO: 34617 - protein, 123 aa, Panicum virgatum
  misc_feature: Ceres CLONE 1956747-R
  misc_feature (1)..(116): Pfam Name: Arf Pfam Description: ADP-ribosylation factor family
  misc_feature: Functional homolog of the protein sequence given in SEQ ID NO 51466
  misc_feature: Useful for making plants with altered lignin content
  misc_feature: Functional homolog of the protein sequence given in SEQ ID NO 50150
  misc_feature: Useful for making plants with altered alkaloid content
  misc_feature: Functional homolog of the protein sequence given in SEQ ID NO 50219
  misc_feature: Useful for making plants with modulated nitrogen use efficiency
MRQVWDLGGQESLRTSWATYYRGTHAVIIVIDSTDRARINIIKDELFRLLQHADLEGAVVLVFANKQDLKDAMSPAEITDALSLHSIKNHDWHIQASCAITGEGLYDGLGWIAQKVAGKATAS

SEQ ID NO: 34618 - DNA, 665 bp, Panicum virgatum
  misc_feature: Ceres CLONE 1956773
  misc_feature: Encodes the peptide sequence at SEQ ID NO. 34619
aacctttggctccaagctgcagccgggtctttcttcctcctctccaccccccccacccccccccctcgggccaacgcgaggcgaaaaccaattccacatctccgccctcgctcgccgaggaagctcgccaagaactgcatctacagcgggggagaggttgagagagaggcgataaaagtttctcctcgcctctctctctgtatctccttcccgtcttcctatctgtctgcgattctcgtcgcattggtttggtttccttgcaaaagggggcagctttttctgtcttcccttgatccagatgatggcgagcacgacgtcagcgaccgccgccgcggcggcattcgggggcgcaaccaccgccaagacgcgggggtcgtcgtcggccatctgcccgagggtgtccaccggcggcaggaggcgctccggggtggtgcggtgcgacgccggcgtggagacccaggtgcaggcggtggccaaggcggccagcatcgccgcgctcgagcagttcaagatctccgccgaccggtacatgaaggaaaggagtagcatagctgtgattggcctcagtgtgcacacagcaccagtggagatgcgtgaaaaacttgctgttgctgaggaactatggccccgtgctattcaagaactcactagtctaaaccatattg

SEQ ID NO: 34619 - protein, 121 aa, Panicum virgatum
  misc_feature: Ceres CLONE 1956773
  misc_feature: SWISSPROT Homolog: EC 1.2.1.70 Glutamyl-tRNA reductase
MASTTSATAAAAAFGGATTAKTRGSSSAICPRVSTGGRRRSGVVRCDAGVETQVQAVAKAASIAALEQFKISADRYMKERSSIAVIGLSVHTAPVEMREKLAVAEELWPRAIQELTSLNHI

SEQ ID NO: 34620 - DNA, 260 bp, Panicum virgatum
  misc_feature: Ceres CLONE 1956773-R
tttttacccggtgtatacatattttgattcccagttttttttgtaatccttcgcttactaagctccatccctgctcgctgagatcgccaactgtgtcgtgaataagcgccatggcagtagctcaatccattgagaggtagtggcaaattgtctctattccagctgcatgtctctgtaaattattgctctaactgctgtggcaagcggccattcttcttacgttgtatacgctatttggacgaaataaacaggaatccatc

SEQ ID NO: 34621 - DNA, 666 bp, Panicum virgatum
  misc_feature: Ceres CLONE 1956792
  misc_feature: Encodes the peptide sequence at SEQ ID NO. 34622
accagctcggaagcccgtagctagcagctagtagctctactacctcgatcgagctcattccttccccgagtcgagggagtagagatagatacgcgcagaggaggctgtccatggaggcgtcggccgtgatgtcgttgcggcgggcggcggcggcggccgtggcgtgcgtgctcgcgctggcgctcggcgcggcggcgcagctcacgccgacgttctacgacgggagctgcccgaggctgcagtccatcgtgcgctccgggatggccgccgccgtgcagcaggagccgcggatgggggcctccctcctccgcctcttcttccacgactgcttcgtccagggctgcgacgcgtcggtgctgctggacgactcgccgacgctgacgggggagaagaacgccgggcccaacgccaactccctccgcggctacgaggtcatcgactccatcaaggcgcaggtcgaggccgcctgccccggcgtcgtctcctgcgccgacatcctcgccctcgccgcccgcgacggcgtcaacctggtcagtgaactaaccaatagtaactggcagtagtagtagtactaggctactagcagtagtctagtagtacagcaccacctgccgacacccgtaccacctgctgccaccaatcaccatgcatgtcgaccggtcaaac

SEQ ID NO: 34622 - protein, 150 aa, Panicum virgatum
  misc_feature: Ceres CLONE 1956792
  misc_feature (47)..(148): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50996
  misc_feature: Useful for making plants with altered carbohydrate content
  misc_feature: Functional homolog of the protein sequence given in SEQ ID NO 51327
  misc_feature: Useful for making plants with altered cell wall content and/or composition
  misc_feature: Functional homolog of the protein sequence given in SEQ ID NO 51034
  misc_feature: Useful for making plants with modulated nitrogen use efficiency
MEASAVMSLRRAAAAAVACVLALALGAAAQLTPTFYDGSCPRLQSIVRSGMAAAVQQEPRMGASLLRLFFHDCFVQGCDASVLLDDSPTLTGEKNAGPNANSLRGYEVIDSIKAQVEAACPGVVSCADILALAARDGVNLVSELTNSNWQ

SEQ ID NO: 34623 - DNA, 663 bp, Panicum virgatum
  misc_feature: Ceres CLONE 1956792-R
  misc_feature: Encodes the peptide sequence at SEQ ID NO. 34624
tggacaacggctacttccgcaacgtcgtcgcccagttcggcctgctccactccgaccaggagctcttcggcggcggccaggtggacggcgtcacggcgcagtacgcgcgcaacggcgccgccttcgcgcgggacttcgccgcggccatggtcaagatggggaacatcagcccgctcacggggtccagcggcgagatccgggccaactgccggaagcccaactaacaataatcagccgcgccccgccgccgccggccggccggccggccttgagatgtgtgcgggacggagaagggacggcgcggatgggcggggccgatcgacatatggccagctaagaggagtgcggcttttgcgcgtggggaagtgtggagtgcgttggaagggagcggcggcggctggccggagacggcgatgattgaggtggggcggatttggtgggtggggcggcgctgtcaaggggggaggaggagggagacgagaggtggggcccagcgtgccgtgacacatcgatcacgcgctgcaatgcatgcatggctggccactgcggctgcttttggtttggttgcattctttccttgtaccataccgattcgattcatgattatttttcagggaggggacacgaataagaacgtatatataaaaaaatgtgctttatttc

SEQ ID NO: 34624 - protein, 73 aa, Panicum virgatum
  misc_feature: Ceres CLONE 1956792-R
  misc_feature: SWISSPROT Homolog: EC 1.11.1.7 Peroxidase
  misc_feature: Functional homolog of the protein sequence given in SEQ ID NO 50229
  misc_feature: Useful for making plants with altered cell wall content and/or composition
  misc_feature: Functional homolog of the protein sequence given in SEQ ID NO 50228
  misc_feature: Useful for making plants with altered carbohydrate content
DNGYFRNVVAQFGLLHSDQELFGGGQVDGVTAQYARNGAAFARDFAAAMVKMGNISPLTGSSGEIRANCRKPN

SEQ ID NO: 34625 - DNA, 553 bp, Panicum virgatum
  misc_feature: Ceres CLONE 1956802-R
  misc_feature: Encodes the peptide sequence at SEQ ID NO. 34626
tcttacacgtttgacggagtgaataagccccgtgacctgtacgagaagctgcgcatccctgtggacaacctgttctttgcaggggaggccacaagtgtgaagtacactggcacagtgcacggcgccttctccactggtctcatggcatctgaggagttaaagatgcgggttctggagcggttcagggagctggacatgttggagatgtgccaccctgccatgggcgaggacagccctgtctctgtcccactgctcatctctcggctctaagcgggatcagcagttgtttatgggattaacacctgcgagtatgtcggacatcccactgattgctcaagggaggcagtataaggagaaagaatctcctcttgcttctcctttgcatgaggcatgtgttgacatcacttgtgcggtgtgctatattaatcttatatgtttgggaacccatacgtatattggggtctgtgtttgatcaagtaacacgagcgggccatctttgtagaagatgccttatgtatgatgaacactgtaatacacatactatgtttggagt

SEQ ID NO: 34626 - protein, 89 aa, Panicum virgatum
  misc_feature: Ceres CLONE 1956802-R
  misc_feature: SWISSPROT Homolog: EC 1.5.3.11 Polyamine oxidase
SYTFDGVNKPRDLYEKLRIPVDNLFFAGEATSVKYTGTVHGAFSTGLMASEELKMRVLERFRELDMLEMCHPAMGEDSPVSVPLLISRL

SEQ ID NO: 34627 - DNA, 574 bp, Panicum virgatum
  misc_feature: Ceres CLONE 1956802
atccaaacggttggaagcagcagcaggcaggactcatcctccctctccgtctccgaatccccccgaaatcctctccagttctccggccccgggcaagtctctgccgagtgtgcctcgatccgattggtggacggagtcctgaaccgaggtttgaagtgttgcctgccccgccggagtttttctcttacccgcgaccgaatcggctcaaaagttcatgggatcgtggggatactggaaagttgtgtgagatcgacgagcgggaaccgtgaattccttggagggttgcggcgatccggctgcacggctgcatgaactgtttcgagaacctgggactcaactcgaactcgaaccactacgtcgcctgcctcctcatcttcctgctgcatttctcccctcagttgttatatccctccaattctaattcaagtagtactcgtcaaggagaagaacagagctgcacagatggcgaacaacagtgcaacaatttgcatgtagttgatacattctcggtacatatatgcttggtggccattaaaggggctgttttttaagtgtcctgaagcatatccgatac

SEQ ID NO: 34628 - DNA, 609 bp, Panicum virgatum
  misc_feature: Ceres CLONE 1956809-R
  misc_feature: Encodes the peptide sequence at SEQ ID NO. 34629
ctgcggcacatcattctcgagaacaatgataataaacctgtgacgaatagcagggatacccaggaggtgaagctggaacagggcctccagatgctaaccatcttcaagaaccatgaggctgagacgacaatcctggaggattttgacttctatgagcagcgggagaaagccttgcaggagaacagacgtcaacagcagcctggcagcgccgatcctcagaagccagcagataccaaggaagctgtggccaatatgtcagacgcatttgctaaggtccagttgaaggagactgagaacagtgggaaaccccagaaagctgagggcgtgtcagctgaaaatggaaccacggctacagctaaggttgaggaaggcgacgcaaacgcgaaggcaggccctgtggaggaaagtggttgatttgtctgtctgctaatttggaagcagcagttgaatagagtgctgctgtgtgaaggttggagggggcaaagtgcaggttgattgtgttaaatatggtggccgcgtcagttgtacaacatcataggctttgtttcatctccatttaggttataatttcaatatcatagttctataattattgttcgcagttctctt

SEQ ID NO: 34629 - protein, 137 aa, Panicum virgatum
  misc_feature: Ceres CLONE 1956809-R
  misc_feature (1)..(38): Pfam Name: YTH Pfam Description: YT521-B-like family
  misc_feature: SWISSPROT Homolog: EC 3.1.2.15 Ubiquitin thiolesterase
LRHIILENNDNKPVTNSRDTQEVKLEQGLQMLTIFKNHEAETTILEDFDFYEQREKALQENRRQQQPGSADPQKPADTKEAVANMSDAFAKVQLKETENSGKPQKAEGVSAENGTTATAKVEEGDANAKAGPVEESG

SEQ ID NO: 34630 - DNA, 715 bp, Panicum virgatum
  misc_feature: Ceres CLONE 1956809
gcttaaaccctcgccgggagggccgactccgccaatcccgacgcgcgccaccgcccccggatctccgccgccatggccgccgcgccgccgcaggcccagcagggctccgcagacagcgtgatcccgctgcagtcggaagctgtgctggagaataacccctcaaagagcgcaagctccaaggatcagattctttctggtacagagaatacgaatgcaagcaatgcccgtggtgccacctcaataaaatctccaaagggagcacatgagaaggctggctctgtcggaaaaggtggagagcaaccttatctctacctgcacaatgtgtatgcgccgcagccacaggctctctatcctggaggatacatgaatccttcagggcaatgggaagaatatccccattatgtgaatatggaggggctccactctgtatcacctggtatctacaatgacaaccagtcactcatgctatctcctggatatgcaaacaacccccaaatgatgtatggggcctattctcctgtttcaaccgtcggggatggccaacaatacttgcctatgcacttccctttctcaagttcatattatcagccaccagcttctcctagcatgggatactcgaactcagtgacaggaatatctcaaggagaccctatgcttcagccagagtacttccttcctgatggccttctatattcacccacaccagggtatcacc

SEQ ID NO: 34631 - DNA, 1453 bp, Panicum virgatum
  misc_feature: Ceres CLONE 1956815
  misc_feature: Encodes the peptide sequence at SEQ ID NO. 34632
ctctttctacgccacctcctcccaccgctcaccccacgcctcccaacccctctctcctcctctgctcccaagatctcctcatctcccggcccggcagcagcgcgcggggggtagagagatcgagatccggaggaggcgcggcacctcgcggcaccagcaatggcgggcacggtgacggtcccgggggcgaacgtcccctccacgccgctgctcaaggacgagctcgacatcgtgatcccgacgatccgcaacctcgacttcctggagatgtggcggcccttcttccagccgtaccacctcatcatcgtgcaggacggcgacccgaccaagaccatcaaggtgccggagggcttcgactacgagctctacaaccgcaacgacatcaaccgcatcctcggccccaaggcctcctgcatctccttcaaggactccgcctgccgctgcttcggctacatggtctccaaaaagaagtacatctacaccatcgacgacgactgcttcgtatgacctcttcctctcttttttttactgctcccgttcctgttaaattcactcttggatccgacggaaaggcgggatcttggcgccggatctgggtccaattcgcccagatccggctcgatcagatctggatctcggctcgcgcggttaattgcctttgatccttagcgtcggtggtggtttcgcattgcggatctcgatccgtagcacctggctatgctcagtaactgtagtggctttgttccgagggaacagggccagcagcgtactggttgttagtgcctttgtcgttgaggaggggtccttttcatttggccagggtccttgtttatgggatcccgtcgtggatcacaaactggcatgtattaatcaacacgtatttaaaatgctctaatgtcatcggatctagttgcatcagatctgatccgagcagtaggcccaattcaggtcaacattaggtttagctcctcctaatacacactttctgagggaaattttttcaccttttaccacgatcagctcttattaaacgagccagacgcagtttaaattttcacctttcaccttgcaagatccacacacctagatcataatgctgagggtggaactggcagctctgtgatctgttgaaacattgacagtaatatccagtgatgcactcaaattaggagtttttatcatctgaactagcaacatcatgattataactagcagcatcattgcactcattctattttgtcacattaattgtctttttttgccatttaggttgccaaggatccatctggcaaggacatcaatgctcttgagcagcacatcaagaacctcctcagcccatccaccccgttcttcttcaacacgctgtatgacccctaccgcgagggtgctgactttgtgcgtgggtactccttcagcctcagggagggcgcccacactgctgtctcccacggcc

SEQ ID NO: 34632 - protein, 115 aa, Panicum virgatum
  misc_feature: Ceres CLONE 1956815
  misc_feature (13)..(115): Pfam Name: RGP Pfam Description: Reversibly glycosylated polypeptide
MAGTVTVPGANVPSTPLLKDELDIVIPTIRNLDFLEMWRPFFQPYHLIIVQDGDPTKTIKVPEGFDYELYNRNDINRILGPKASCISFKDSACRCFGYMVSKKKYIYTIDDDCFV

SEQ ID NO: 34633 - DNA, 667 bp, Panicum virgatum
  misc_feature: Ceres CLONE 1956837-R
  misc_feature: Encodes the peptide sequence at SEQ ID NO. 34634
aggggggaagcttgggattttgctagggtcagaaatgcttgctttgagcaggctagacaggcttatttagtggcaaacaaagctctggccaaggaactgagcatgaagggtcaggcgtacaatgcacaaatgaaagcagctcatgagaaagccagagaagctatttatcgacaaaggaatcctgtttcgcaacggggaggtgatggtctgattgatttacatggactgcatgtgagtgaagcaatccacatcctaaaggttgagcttgctgccatgaagagcgcagcaagggctgcaggggagaggatgcaggtcatggtatgtgtcgggacaggccaccacaccaagggctcgcgcaccgcaaggttgcccatcgccgtggaacagttcctcctggacgaaggcctccactacacgcagcctcaaccaggtcttttccgcgtcatggtgtactaacatctcttaggtaagacaccacggaggaaaaaaaggaccgcccaaaaaaacaagaaaagagatgtacggaaaacacaaaaaaaagcgtcgttggagcacgcactgtaatttccttgtagctgtatattaaaagaggcagcaggagaatagcctgacaacagaatacagtgtaaaattatacatagcttcattcaattcacattccattccc

SEQ ID NO: 34634 - protein, 151 aa, Panicum virgatum
  misc_feature: Ceres CLONE 1956837-R
  misc_feature (71)..(151): Pfam Name: Smr Pfam Description: Smr domain
RGEAWDFARVRNACFEQARQAYLVANKALAKELSMKGQAYNAQMKAAHEKAREAIYRQRNPVSQRGGDGLIDLHGLHVSEAIHILKVELAAMKSAARAAGERMQVMVCVGTGHHTKGSRTARLPIAVEQFLLDEGLHYTQPQPGLFRVMVY

SEQ ID NO: 34635 - DNA, 383 bp, Panicum virgatum
  misc_feature: Ceres CLONE 1956837
acccacccaccagcccgcccccgcctccatccacagcggccacgcccgctcccccctcccctcccctctccctagtccctcctcgtccccggacgcggcgtgcccgtccgtcagccaccgactccctcccccaccgccccgatccggagccgagtcgcccttgctcaggaggcagagagccccgaaccgcggcgggagggagggcggccttcctcttagcttccaccccgccggaggccagccgccccatgggccggtcgcccgcgcgcgctacgtaccagctcatcgaccgccggaaagagtgatgaatttggagagtggaagcttgcaccatgatgggaagctgcttcttttatgaagcacaagtagtaccgttctgcaac

SEQ ID NO: 34636 - DNA, 664 bp, Panicum virgatum
  misc_feature: Ceres CLONE 1956854
  misc_feature: Encodes the peptide sequence at SEQ ID NO. 34637
ccattggcctgcttccctctgtttgaccactgggattgagtatcactgagcaatggctgccaagctgactcgcctccacagtcttcgtgagcgtcttggtgccacgttctcctctcatcccaatgatctgattgccctcttttcaaggtatgttaacctgggtaagggaatgcttcaacgccatcagctgcttgctgtatttgatgctctgtttgatgctgacaaggagaagtacgcaccctttgaagacattcttcgtgctgctcaggaagcgattgtgcttcctccctgggttgcacttgctatcaggcctaggcctggtgtctgggattacattcgtgtgaatgtgagtgagttggctgttgaggagcttagtgtttctgagtacctcgcattcaaagaacagctagtgaatggacaagccgatagcaactttgtgcttgaacttgattttgagcccttcaatgcctccttccctcgtccatccatgtcaaagtccatcggcaacggagtacagttccttaatcgacacctgtcttccaagctgttccaggacaaggaaagcctgtaccccctgctgaacttccctgaagtccatagttacaagggcacgacaatgatgctgaatgacagaattcagagtcctcgtgggctcccatcatcc

SEQ ID NO: 34637 - protein, 203 aa, Panicum virgatum
  misc_feature: Ceres CLONE 1956854
  misc_feature (6)..(203): Pfam Name: Sucrose_synth Pfam Description: Sucrose synthase
  misc_feature: SWISSPROT Homolog: EC 2.4.1.13 Sucrose synthase
  misc_feature: Functional homolog of the protein sequence given in SEQ ID NO 51467
  misc_feature: Useful for making plants with altered carbohydrate content
  misc_feature: Functional homolog of the protein sequence given in SEQ ID NO 51468
  misc_feature: Useful for making plants with altered cell wall content and/or composition
  misc_feature: The sequence is a functional homolog of SEQ ID NO 12 in US patent 7091398
  misc_feature: The sequence is a functional homolog of SEQ ID NO 2 in US patent 7091398
MAAKLTRLHSLRERLGATFSSHPNDLIALFSRYVNLGKGMLQRHQLLAVFDALFDADKEKYAPFEDILRAAQEAIVLPPWVALAIRPRPGVWDYIRVNVSELAVEELSVSEYLAFKEQLVNGQADSNFVLELDFEPFNASFPRPSMSKSIGNGVQFLNRHLSSKLFQDKESLYPLLNFPEVHSYKGTTMMLNDRIQSPRGLPS

SEQ ID NO: 34638 - DNA, 1414 bp, Panicum virgatum
  misc_feature: Ceres CLONE 1956857
  misc_feature: Encodes the peptide sequence at SEQ ID NO. 34639
tggcacacactcagtagttgacactccactagtccagtcccaactccggctctccgtgcggcgccacgctcaccagctctgtcgtccatggcatccgccgccggcaccggggccgccagccttccgctcttcctcctcctcgcctcaacgctgatcgcggcctcagcctcgccgtcttcggcagcagcggaggcgctggcgccgcaggagctgctgctcaacttcaaggcgtccctgcgggacccgtcgggcgcgctcgccggctggtcgcgctccgcgccctactgcaactggccgcacgtcgcctgcaccagcgccgccgccgccgccgcgaacgccaccgtctccgtctcgctctcgctccagggcctgggcctctccggcgagctctcggccgcctcgctctgccgcgtgccgggcctcgtcgcgctcagcctcgcgtccaacgggttcaaccagaccatcccgctggacctcgcgcgctgcgcctccctcgcgtccctcaacctcagcgccggcgccttctggggcccgctccccgagcagctcgccgcgctccccgcgctcgtgtcgctcgacctcagcggcaacagcatcgaggggcaggtgcccgccggcctcgccgcgctgggaagcctcgaggtgctcgacctcgggggcaaccgcctctccggcgtgctccacccggcgctgttccgcaacctcaccagcctgcacctgctggacctgtccgggaaccagttcctggagtccgagctgccaccggagatcggcaggatgggcagcctcaggtggctgtacctgcagggctcagggttcaccggcgcgatccctgagtccttcctcgggctggagcagctgcaggttcttgatctgtccatgaacagcctgaccggagccgtgccgcccgggttcggcctcaggcttcagaagctgatggccctggacttgtcgcagaacggactctccgggccgttcccggaggaggttggtaagtgttcgatgctccagaggttcgaggtgcacgacaacaccttcaccggggagctccccggcgggctctggtcgctgccggacctgcgcgtgatccgggccgagaacaaccgcttcaccggccggttgcccgagttccccggcggccagtctcggcacgagcagcttcagcttgacaacaacagcttctcaggcgggatacctcagagcatcggccaggtccgcaccctgtaccggttctccgcgtccctcaacgagctcaacggcagcttgccggacaacatctgcgactccccggcgatgagcatcatcaacatctcccgcaactcgctctccggctcgatcccggagttcaggagctgcaagaggctggtgtcgctgtacctggccggcaacggcttcaccgggccgataccgtcgt

SEQ ID NO: 34639 - protein, 442 aa, Panicum virgatum
  misc_feature: Ceres CLONE 1956857
  misc_feature (36)..(75): Pfam Name: LRRNT_2 Pfam Description: Leucine rich repeat N-terminal domain
  misc_feature: SWISSPROT Homolog: EC 2.7.11.1 Non-specific serine/threonine protein kinase
MASAAGTGAASLPLFLLLASTLIAASASPSSAAAEALAPQELLLNFKASLRDPSGALAGWSRSAPYCNWPHVACTSAAAAAANATVSVSLSLQGLGLSGELSAASLCRVPGLVALSLASNGFNQTIPLDLARCASLASLNLSAGAFWGPLPEQLAALPALVSLDLSGNSIEGQVPAGLAALGSLEVLDLGGNRLSGVLHPALFRNLTSLHLLDLSGNQFLESELPPEIGRMGSLRWLYLQGSGFTGAIPESFLGLEQLQVLDLSMNSLTGAVPPGFGLRLQKLMALDLSQNGLSGPFPEEVGKCSMLQRFEVHDNTFTGELPGGLWSLPDLRVIRAENNRFTGRLPEFPGGQSRHEQLQLDNNSFSGGIPQSIGQVRTLYRFSASLNELNGSLPDNICDSPAMSIINISRNSLSGSIPEFRSCKRLVSLYLAGNGFTGPIPS

SEQ ID NO: 34640 - DNA, 686 bp, Panicum virgatum
  misc_feature: Ceres CLONE 1956857-R
  misc_feature: Encodes the peptide sequence at SEQ ID NO. 34641
cgcaccttcaccgtgaccatagtccccaagtgctgcacagagatctgaaggccagcaacgtgctacttgatgacgaatttgagcctagggttaccgggtttgcgattgatcgtgttgtcggggaaatggcgtaccagacttccatggcttcggatctgaactgcaagtgctacgtcgcaccagagcaaagccgcgccaagaatccgacgcacctcatggacgtgtacagcttcggggtcatcctcctggagctggtcaccgggaagccagcggagcagccggcgtcggacgactccgtcgacatcgtcaggtgggtgcgccggcggatcaacatgaccgacggagcgtcgcagatacttgaccccagcatctcccacaccgcgcggcagggaatgcaggctgccctcgagctcgccctgcgctgcacgtcagtgatgccccaccagagaccggccatggatgaggtcgtccggtcgctccagccgctgtgcttcagctttcatccacagacgccgctgaccactgaaatcgttctggagccctgaatgcagaagcacgttgacctcgcctgcttctgcccatggtagcttaagagttcagagagtatgtatcactgcatagcccttgcttgttgtatttgtatagcatgacaaacagaataaagagaagggatcagcgtgatcacc

SEQ ID NO: 34641 - protein, 180 aa, Panicum virgatum
  misc_feature: Ceres CLONE 1956857-R
  misc_feature: SWISSPROT Homolog: EC 2.7.11.1 Non-specific serine/threonine protein kinase
HLHRDHSPQVLHRDLKASNVLLDDEFEPRVTGFAIDRVVGEMAYQTSMASDLNCKCYVAPEQSRAKNPTHLMDVYSFGVILLELVTGKPAEQPASDDSVDIVRWVRRRINMTDGASQILDPSISHTARQGMQAALELALRCTSVMPHQRPAMDEVVRSLQPLCFSFHPQTPLTTEIVLEP

SEQ ID NO: 34642 - DNA, 633 bp, Panicum virgatum
  misc_feature: Ceres CLONE 1956859-R
  misc_feature: Encodes the peptide sequence at SEQ ID NO. 34643
tggctgttcttctctgtgcactgatctgtgcgctcgggctcaactcaatagtccggtgtgcgctgcggtgctcgagccgagcggttgctgatcccgtgccgaacccggtggcacgtttggctcagagcgggctgaagaggaaggccatccgagccatgccgatcgtggtctactcggcggggctgaagctcaatgctgccaacccgatgtgcgcgatctgcctctctgactttgaggctggagagcatgtcagggtcctccccaagtgcaaccatgggttccatgtcaggtgcatcgaccgatggctcttggcgcggtcgacgtgcccgacatgccggcaatccctgtttggagcgccgccgaaggcctctggctgctctgagtcgagccgggtcgagcctgtgcctgcccactctgtcctcgtgccactcagacctgaaggtttggccactccatatgatttttagtctcttcagttgcttctttgttgtttcatgatggacaagagggtgaggaaaagtaggaacaaaaaattgtgatcgttaggatactgccaatctggcttgtacattgttgctgaaaaaaaaagaattgtacagatttcctcagttttctatttgctttgttggtgcc

SEQ ID NO: 34643 - protein, 154 aa, Panicum virgatum
  misc_feature: Ceres CLONE 1956859-R
  misc_feature (70)..(111): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature: Functional homolog of the protein sequence given in SEQ ID NO 51049
  misc_feature: Useful for making plants with modulated nitrogen use efficiency
AVLLCALICALGLNSIVRCALRCSSRAVADPVPNPVARLAQSGLKRKAIRAMPIVVYSAGLKLNAANPMCAICLSDFEAGEHVRVLPKCNHGFHVRCIDRWLLARSTCPTCRQSLFGAPPKASGCSESSRVEPVPAHSVLVPLRPEGLATPYDF

SEQ ID NO: 34644 - DNA, 1368 bp, Panicum virgatum
  misc_feature: Ceres CLONE 1956859
tttctctatcatttatagcaaggataccatggtaattttctcttgttgttcaccttgttaatccttgtggccatgttaggcaagaatgcagtgcaggcaagacagaaacggccaacatacattcatgtaattgcgcatgtggatttttattaagcttttatatgaatgaacacggatcagtacacataccttttgttctgtttttccttcttttcccggtttagttttatcacatttttcgttgagtggaccttatgtctcctccagactaacttaagataagcactgaaccatgcctgtaacttaagattgactagatagatctaaggctccaaagcataaagtgtaaaagtgatgggttgagataagcttaattatggatagcctggaacaatcatatgacttacacgtagatgtctacaacttcacactgaagatgcattagcacaatgggtcaccaaggagttcttgtgacaagcaattttctgcatatccgaaattgaaactattgttatattttcacattctacagagctcatacgacagctttgctctttgcaggttagcataattagaaactaagaagattacatcagaattagtaaagaggcagcatgtttggcagagaatttcagtgacaaccatttgttcaaattgaaataaaaagagactagctagggggaccaagtgattttgtattaagaaggaaatagtcacccaatctttttgtgaagtggactcaaatttgggtggtggatagtcagcatatattgtgcacacctacacctccgactaactgagcaaatcttgattcctggaaatcattagttcctccaccatgatttttgcttctcatcaaagcaaccacaaccgataagttcatgttctttttttttaatgaaacaggagggtttccccctactggttatatattaattttaaaaaagggtgaagatacaaataaaatgaagcacaaaagaaaaacagagagtccacatgtctaatttctatgctgcaaaaatcatgctacttctcattatcaacaaatccatatttagaaaaaggtacttccttcaaattattttatggagtgccctgtttatgttaaccatattacttaatcagtcctttctatactacactgatcagcgaggtgtcagcacatagttgacttggctaccagctaagcttgtggatgtcggcaccatatgaaagaaacatacagctttgtggaggaagcaacactcatagtttatataatgcttcatagataacatgtgtaacttattttttttgtatgcctaaattgctttttgtcgactaaccactcattcaaggggtgctttacccagtaggattgctgttgat

SEQ ID NO: 34645 - DNA, 656 bp, Panicum virgatum
  misc_feature: Ceres CLONE 1956860-R
  misc_feature: Encodes the peptide sequence at SEQ ID NO. 34646
attttcctgaaactggtggcgatgacaaccagcagcgaatacctccttaccgaagccgctctctcactgatctgtattctgttgttcatcctgttgagatggcttcacaagatacaccagcaagttcccaggccattgtccctgttgcaccttcagaagatggtgctctagctattgtgcctctttgtaagcccaggccatctgacatcggactaaggcgcactaggaggcccttcactgttggcgaggttgaggtgctggtggaagctgtcgaactgattgggactggaaggtggagagctgttaaaatgcatgcatttgaccatgtggaccacaggacatatgttgaccttaaggacaagtggaagaccttagttcacactgcaagtatatccccgcaacaacgaagaggccagccagtcccacaagaactcctggaccgtgtgcttgcggcgcaggcctactggtcccagcagcaggcaaagctccaggacaagcctcatggcaagtctgcgcttcctgagatctgccctgcctaggaatggaagctggtctttgttgtaaatactgttcctaatagaaacaaggtagaagggatgtccaaagaaatcagactaatttgtgtgccattgcaaacttacaacattgcttttctc

SEQ ID NO: 34646 - protein, 178 aa, Panicum virgatum
  misc_feature: Ceres CLONE 1956860-R
  misc_feature: The sequence is a functional homolog of SEQ ID NO 1240 in the 11/479,226 US patent application
  misc_feature: The sequence is a functional homolog of SEQ ID NO 164 in the 10/374,780 US patent application
  misc_feature: The sequence is a functional homolog of SEQ ID NO 566 in the 10/412,699 US patent application
  misc_feature: The sequence is a functional homolog of SEQ ID NO 894 in the 10/225,066 US patent application
  misc_feature: The sequence is a functional homolog of SEQ ID NO 1796 in the 10/412,699 US patent application
  misc_feature: The sequence is a functional homolog of SEQ ID NO 2042 in the 10/374,780 US patent application
  misc_feature: The sequence is a functional homolog of SEQ ID NO 398 in the 10/412,699 US patent application
  misc_feature: The sequence is a functional homolog of SEQ ID NO 945 in the 11/479,226 US patent application
  misc_feature: The sequence is a functional homolog of SEQ ID NO 770 in the 10/412,699 US patent application
  misc_feature: The sequence is a functional homolog of SEQ ID NO 88 in the 10/286,264 US patent application
FPETGGDDNQQRIPPYRSRSLTDLYSVVHPVEMASQDTPASSQAIVPVAPSEDGALAIVPLCKPRPSDIGLRRTRRPFTVGEVEVLVEAVELIGTGRWRAVKMHAFDHVDHRTYVDLKDKWKTLVHTASISPQQRRGQPVPQELLDRVLAAQAYWSQQQAKLQDKPHGKSALPEICPA

SEQ ID NO: 34647 - DNA, 1435 bp, Panicum virgatum
  misc_feature: Ceres CLONE 1956860
ctcccctctctatcctccattcctcccccatcccttcttcgccctcgaggctttgggctcgtccatctccggccaaatctggaagcagcgacggcacccgaggccgtcgcacccccgcgctccttgccccggaacccgacgcctcccttccgcagcccgatccggagcggagcggctaccgctgtccaaatcgagccacctgcgcccgtcgggggagaagcagggtgcgcatccagcctctccgctgagccgtccacaaggatccatttcctctcccatcggcggcgtggaagagaaccggtgaggggattgcgaagctagaagcccacgacgtcgaccgccgagccaccgcgcacgctcctgcagataaagacgatggatgtggtgtttgtctccctttgtcgtctgtgaagacccgctgtgaggtgatatcaagatatggtgatgcggaagaggtccgattatggatcccgcggccgccgagtcgcaaccatgccacgtgttccaaactcagctcgggggaaacgcaccaccaggaaaaagaaagatgagatgtgcgcatttgatttgctcgccaccgttgcaggaacattattggcagatcaggacaattcagccaatgttcctaatactagtggtgcagcaaaagctaaaaatgagaaagcagttaaagaagagccacatgatgaaattctgcccctaaaaaacatagttatggagaaagattgctgcagtgggtgtgtagtgggttctggtggtatctgttcctttcctaggcaagctaacaactgcttggcagaaaactcgtcgacaagaaatgaagctgggtcaatattagagtcactaacagtgaaatcaaatatgttagttagggattcgttggttagttgtacaagaccatgtgaaactagccatggtcttggcataattcttgagtttggagctcatggaatatgccatccaggatcctcaagttcagcagaagctgaacaagtgcaccaggctgaatcaaatgtggtcagaagacaagcagatgggcatgctccgtctcttcacagtttgtttgactctgtggatctggatggtagacctcctgctttggttagctctgacagtagctcgtgtgttcctctgtgcagccatgacaaggaacatcaaacctcttccttgtgtcggggtgaagtgcagtatactgcggacaaagacgatgatgaaaattcttctggatgcacggatccaagcaccataggggataagggttacaaaccacaatatctaggtaaccataggataaggaaattgcttgcctcgaaggtaaggaaggcagcacgtaataatatctgtggaggtattccatcaaaaaagatttgtggagggaagtccaacaaaggtagcaagttaaatttatgcagcagaaaaatacctgccacacatc

SEQ ID NO: 34648 - DNA, 714 bp, Panicum virgatum
  misc_feature: Ceres CLONE 1956873
  misc_feature: Encodes the peptide sequence at SEQ ID NO. 34649
aagtaaatcgcatcttttggagggctcagctgacacgaaggttcctcccggacggacaatgccgagcatccgagctccggcgtccaagcagacagccacgctgcaggtggctgtcaagtgcaggccattgaccgacaccgagcagcggcgctcgcggcatatcatccaggtcatcgatgataagactgtggttgtgctggaccccgatctgtcaaaggattacctggacctaatacagaaccggacgaaggagaggagatacacatttgatcacgtgtacgcacctggatgctccaattcggacgtgtacaagaatatatcctctacaatttctggtgtagtccaaggccttaatgccacagtctttgcttatggttgtactggaagtggcaagacttacactatggttggaacccatagtgatcctggccttatggttcttagcttttgtacaatttttgagctgataaaaaaggacggaggtccagatacatttgaagtctcatgttcatatctggaagtgtacaatgaggttatctacgatttgcttgagaaatcctctggacacctggagcttcgagaagatcctcagcatggcatattagttgctgggttgagaagcattaaggttcattctgcagatagaattcttgagctgttgaacataggcaacagtagacgcaagacagagagcacagaagcaaatgctacctc

SEQ ID NO: 34649 - protein, 218 aa, Panicum virgatum
  misc_feature: Ceres CLONE 1956873
  misc_feature (20)..(218): Pfam Name: Kinesin Pfam Description: Kinesin motor domain
MPSIRAPASKQTATLQVAVKCRPLTDTEQRRSRHIIQVIDDKTVVVLDPDLSKDYLDLIQNRTKERRYTFDHVYAPGCSNSDVYKNISSTISGVVQGLNATVFAYGCTGSGKTYTMVGTHSDPGLMVLSFCTIFELIKKDGGPDTFEVSCSYLEVYNEVIYDLLEKSSGHLELREDPQHGILVAGLRSIKVHSADRILELLNIGNSRRKTESTEANAT

SEQ ID NO: 34650 - DNA, 316 bp, Panicum virgatum
  misc_feature: Ceres CLONE 1956873-R
ggtgcgtgcatcatttttggcctgctgccgacaaccacgtaatgggttgcctgagatctgaagagtagcagatttcagccaaattgttgcctttggccacggccacaagattgatgcctctagacccagctggcattgctcactccaccctgtacagtagatgctaggtctctcatgatctcctctttttctttcttcctttgtagagtggttgctgagggtgaatctgaatttttattttgaaccaagattctgtaaatctcccgcggctttaagcccttcttcagtaaatccaatgaaaaaggctttcaaggcc

SEQ ID NO: 34651 - DNA, 1206 bp, Panicum virgatum
  misc_feature: Ceres CLONE 1956882
  misc_feature: Encodes the peptide sequence at SEQ ID NO. 34652
ctctctccctctccctccctaccagctcccccttctctctcattccccctcctccccggagcgctcgcgcggacccacgaggaggaggaagaggagaagagggagagggagggagccctagccctgccctgcgcgccggcgtcgccagggttagggtctcccccgcgttccttgcgccaccccttcgccggctccccgctctggccgatcccgcccgcccgagcgcccagcggcgcgcgcgccgacccggactccgcggcgcggcgcggcgccggccaatgccgcgtgcctgaccctctgtttggggattccttccgttcggagctggcggcccggcaccgcctgtcacaggagctttgcggcgagatccggcggccggcgagatgcagcacgatcagcggaagaagagttctgcggaggctgaatttttcaccgagtatggggacgcgagtcgatacaagattcaggaagtcattggtaagggaagctacggggtagtatgctctgcaatagatgtgcacacaggagagaaagtagcgatcaagaagatacatgacatctttgagcacatatccgatgctgctcggattcttcgcgagatcaagcttctgagactcctaagacatccggacattgttgagatcaaacatattatgttgcctccatcaagaagggacttcaaagatatttatgttgttttcgaacttatggagtctgatcttcaccaagttatcaaggctaatgatgacttgacaaaggaacattatcagttcttcctctaccaattgctccgtgctctgaaatacattcacacagctaatgtttatcatcgggacttgaagccaaagaatatattagcaaattctaactgcaaactgaaaatttgtgattttggactagcacgagttgcatttaatgataccccaacaacgatcttctggacggattatgttgcaacgagatggtacagagctccggagctctgtggatccttctactcaaagtatacgacagccattgatgtttggagcattggttgcatctttgctgaggtgttaacaggaaagcctttgtttcctggtaaaaatgttgcccaccagttagatcttatgactgatcttctaggcacgccatcaatggatacaatttctcgggtccggaatgagaaaagcaggaggtatctaagcagcatgagaaagaaagatc

SEQ ID NO: 34652 - protein, 274 aa, Panicum virgatum
  misc_feature: Ceres CLONE 1956882
  misc_feature (25)..(270): Pfam Name: Pkinase Pfam Description: Protein kinase domain
  misc_feature: SWISSPROT Homolog: EC 2.7.11.24 Mitogen-activated protein kinase
  misc_feature: Functional homolog of the protein sequence given in SEQ ID NO 50346
  misc_feature: Useful for making plants with altered cell wall content and/or composition
MQHDQRKKSSAEAEFFTEYGDASRYKIQEVIGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFYSKYTTAIDVWSIGCIFAEVLTGKPLFPGKNVAHQLDLMTDLLGTPSMDTISRVRNEKSRRYLSSMRKKD

SEQ ID NO: 34653 - DNA, 656 bp, Panicum virgatum
  misc_feature: Ceres CLONE 1956882-R
  misc_feature: Encodes the peptide sequence at SEQ ID NO. 34654
cgctgcatcagcaggcctacagcacaactgtgtctgatgttgctctggacatgagagcacccccttttcaccatctatcggcagggccgaaaagtgactcttctgataggctaacagcagaaacgaacttgtactcgagatcggtcaatgggatcgctgctactgctgctggagtggcagcaagtgctcacagaaaggttggcgttgttcctttcggcatgtcaaggatgtattagtggctgaatcatcgcgaatcctgcatgccttgatggaactctgctggcctatggtggcacgacactgagaatgaagtggcaagcaaaccttggctgggtgccatgaggtttagagtgcagagcgatccaaggttgactgatctgtaaggtcaggaaacaccatcggcggcatcgaagcatatcaaaatttctgtttaggccatcaacttgtacctgcctggcttgagtagtgtaccctttggttgcacacagaagaagtaaagaagcggggtagtccaacggcttgtaatctgggcaattaggcgccaatttgttttctagagcgaggagaaagaagggaaaggaaggaacgctaacgtttttatatgttgtatagagatgtttctcatatatcaatgtgctacatcagaatgacttcag

SEQ ID NO: 34654 - protein, 77 aa, Panicum virgatum
  misc_feature: Ceres CLONE 1956882-R
  misc_feature: SWISSPROT Homolog: EC 2.7.11.24 Mitogen-activated protein kinase
LHQQAYSTTVSDVALDMRAPPFHHLSAGPKSDSSDRLTAETNLYSRSVNGIAATAAGVAASAHRKVGVVPFGMSRMY

SEQ ID NO: 34655 - DNA, 1303 bp, Panicum virgatum
  misc_feature: Ceres CLONE 1956898
  misc_feature: Encodes the peptide sequence at SEQ ID NO. 34656
acctccacccgtccctctctctctctctccccaccagctcccccctctctctctcttattccccctcctccgcgagcgcgagcgcggaccacgaggaggaggaggaagacgagagggagagatacagagggagggagccctagccctgccccgcgccggcgctgccagggttagggtctccccggccggccgtttcccttccgccgtctcccctcgctctggccgatccacgcgccggcgccctgcctgccgcgcgcgtgcgctcttcgccctcagcccgcggaccgagccaatgccgcgcgcctgaccttcgctttgggaattaaggttccgaggtggccgagcttttcgcggcgctgtaacagccggtgggtggcgaaaggcgcgacctttttttctccccttcgtttgaggagtgcgagatccggtcgccggcgagatgcagcacgatcagcgaaagaagagttctgctgaggcagagtttttcactgagtatggggacgcaagtcgatacaagattcaggaagtcatcggtaaaggaagctacggggttgtatgctccgcaatagatgtccataccggtgaaaaagtagccatcaagaagatacatgacatctttgagcacatatctgatgctgcacggattctccgtgagatcaagcttctgagacttctaagacatcctgacattgttgagatcaaacatattatgctgcctccatcaagaagagacttcaaagatatttatgttgtttttgaacttatggagtccgaccttcaccaggttattaaggctaatgatgacttgacaaaggaacattaccaattctttctctaccaattgctccgtgctctgaaatacattcatacagctaatgtttatcaccgggacttgaagccgaaaaatatattagcaaattctaactgcaaattgaagatttgtgattttggactagcacgagttgcattcaatgataccccaacaacaatcttttggacggattatgttgcaacaagatggtacagagccccagaactatgtggatccttcttttcaaagtatacaccagccattgacatttggagcattggatgcatctttgctgaggtgctaacaggaaagcctttgtttcctggtaaaaatgttgtccatcagttagatttgatgactgatcttctaggcaccccatccatggataccatttctcgggtccgcaatgagaaagcaaggaggtatctgagcagcatgagaaagaaagacccggtctcattttcccagaagtttcaaatgcggatcctttgg

SEQ ID NO: 34656 - protein, 287 aa, Panicum virgatum
  misc_feature: Ceres CLONE 1956898
  misc_feature (25)..(287): Pfam Name: Pkinase Pfam Description: Protein kinase domain
  misc_feature: SWISSPROT Homolog: EC 2.7.11.24 Mitogen-activated protein kinase
  misc_feature: Functional homolog of the protein sequence given in SEQ ID NO 50346
  misc_feature: Useful for making plants with altered cell wall content and/or composition
MQHDQRKKSSAEAEFFTEYGDASRYKIQEVIGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDIWSIGCIFAEVLTGKPLFPGKNVVHQLDLMTDLLGTPSMDTISRVRNEKARRYLSSMRKKDPVSFSQKFQMRIL

SEQ ID NO: 34657 - DNA, 677 bp, Panicum virgatum
  misc_feature: Ceres CLONE 1956898-R
  misc_feature: Encodes the peptide sequence at SEQ ID NO. 34658
cgtgcaaacagtaccactgttcctgatgttgctctggacatgagagcagccccttttcatttatcagcagggcctgcatgtgattcttcagatagattatcaacagagtcaaacttatacacgagatcactcaacggcattgctgccactgcagcaggagtggcagccaacgctcacagaaaggtgggtgttgttccctttggcatgtcaaagatgtattaacggccgaatcatggcatatcctgcatgcctagttagaactatgctgcctgctcgtggcgaaagaatgaaaatgaagtggcggatcaaacctaggttggatgtaccacctttagagtgcagcacaatccaaggtttgctatggtgtcctgctactcatcggtactgcctgacctggaaagacggccgggattgaagcatataagcaacttcattctgtttaggccatcagcatttatctgcttatgcctaagaagtgggccctttggcacactgaaagggggtagtccagtggcttgtaatctgggcagcttgggcgcaatttcttttctagagcgaggagacaaaagggagaggaaggaacactaacgtttttttactgttgtatagaaattttctcatatgtcactgtgttacatgggattgacttgagaaagatacaagaaatttttatgttc

SEQ ID NO: 34658 - protein, 73 aa, Panicum virgatum
  misc_feature: Ceres CLONE 1956898-R
  misc_feature: SWISSPROT Homolog: EC 2.7.11.24 Mitogen-activated protein kinase
RANSTTVPDVALDMRAAPFHLSAGPACDSSDRLSTESNLYTRSLNGIAATAAGVAANAHRKVGVVPFGMSKMY

SEQ ID NO: 34659 - DNA, 693 bp, Panicum virgatum
  misc_feature: Ceres CLONE 1956917-R
  misc_feature: Encodes the peptide sequence at SEQ ID NO. 34660
ccctgttttttcaccctttggaatttttggtgtaaacgagggaacagatcaacaagttcaaggagtgctcaatcttatagatttagcaggcagcgagcgtctcaacaaaagtggtgccactggtgatagactgaaagagactcaggctatcaataaaagcttgtcatgcttaagtgatgtgatcttctcaattgcaaagaaagatgaacatgtcccgtttaggaactcaaagttgacgtacctgctgcagccatgccttggaggggattcgaagacgctgatgtttgtaaatctgtctcctgaagtgtcttccactggagagtcaatttgctcgttgcggtttgctgcgagggtgaactcttgcgagatcgggatccctcggcgccaaactcagatgcggagctcgcaatgatgacatgcggtgatggtggtggcggattgccaagatcaatccatctgttgatggaccattggtggtgtatgtttgtgttgtttgggttgatttactgatgcagttgatcatttgcatcctgtgatgggtgttggtgtgagttgttgggttcatttggactgtggtttgttgattgtgctaacggccggcctactgaatcttaggatctgatttgtacaaacttgtgtgatgacttgtggcaaattattttctaattcgttgtagtcttgatttggcgttgc

SEQ ID NO: 34660 - protein, 136 aa, Panicum virgatum
  misc_feature: Ceres CLONE 1956917-R
  misc_feature (2)..(122): Pfam Name: Kinesin Pfam Description: Kinesin motor domain
PVFSPFGIFGVNEGTDQQVQGVLNLIDLAGSERLNKSGATGDRLKETQAINKSLSCLSDVIFSIAKKDEHVPFRNSKLTYLLQPCLGGDSKTLMFVNLSPEVSSTGESICSLRFAARVNSCEIGIPRRQTQMRSSQ

SEQ ID NO: 34661 - DNA, 799 bp, Panicum virgatum
  misc_feature: Ceres CLONE 1956917
cgccgccgcttaccccttcgtccccaatccaattccaaatccaatcccccccgctcctcctcctcctcctcaaaccctagatcgatcgatccacccacccacccacctatcagcccgccatgtccgcgcgaggggtgcgcccagggatgctgcgccagaaggagaacaccccggtggacgcgcaggccggcaagcgccagcgcaccgccaccggggccgcgaggcagccgctctccgcagccgcacagccgccgccgcctgaggaccagcccatggtcttcgcgggcagggaggacgtcgaggcccttctcaacgagaagatgaagggcaagaacaagatggactataagggaaggaacgaacagatgatggaatacatcaagaagttgcgggcctgcataaaatggttgcttgagagagaagatgcaaaccttgttgaaattgggaacattagtgcccggcttgaggcggaaggaaaagaacactccgagacagtggctgagttgaagaattctattgatgaagcaaggtcaataaatgaggagcttcagaaacagtacacttctctacaagagactctggagaaggtcaaggccgagaaactggatgctctacatgctctagatgaggaaaaggatgcaaggacatcagctgaatcaatgaagaataagcttttggaagatttgaaaagaatcaagttggaggacacccgccttaatgaccagattaagatgcttcaggacacaaacaaaaggcttcaagaatataacacaagtttgcagcaatataatagcaatct

SEQ ID NO: 34662 - DNA, 1360 bp, Panicum virgatum
  misc_feature: Ceres CLONE 1956942
  misc_feature: Encodes the peptide sequence at SEQ ID NO. 34663
atggccgctggccaagtcttcagtctcgccaccgcgctgctctccttcctcctcccctccgtcgctcttgcaaacggcactctcgccagaggcttctccatctccgtccccaccggagaaagcaccaatcccatcctggtgtcgcccaacggcgccttcgcctgcggcttgtacaaggtgggcaccaacgccttcaccttctccatctggttctcatggtcagctggcaggaccatcgcctggacggccaaccgcgacgcgccggtgaacggcaacggctccagggtcgtcttccagaggtccgggagcctggaactccttgactacgacggcacagctttatggagcaccaacacggccgcgatgcacgccgacagcgtggcgctcctggacaccggcagccttgtcatcatggatcaaggcggtaatcccctctggagcagcttcaactcgccgacggacacacttctgccgtcgcagtcgatggccatgaacacacgcctggtctctgcatcggccaatggtttggtctcttccggcttctacaccctttactttgacagtaactacacgttgactcttacctacaatagaacaaatgggatcagtaccaaatattggcctacacacacccagtcatcggctaatggtaacaggaaccaatacagtggtctggacagcaaaggtgcatttgtggctggtgaccagcttaaatttgaagcctctgatcttggtgatggcatcatgaggaggctgacactggattatgatggtaaccttaggatgcacagtctagacattagcagtggcggctggtacatctcttggatgttattcactcgactatgtgaaatacatggcctctgtggcgaaaacagcctgtgcagatacataccggcgctcgagtgttcttgtctcgaaggcttcgaaatgaccgaaccaagtgactggagcaaagggtgcaagcgcagtgtagcgagcaaggacttcacattcacaagtcttcctggaacagatttctggggttatgaagtaaactataacatgtcaatgccattggagaagtgcatgaaaatgtgcttagacgatggtgactgccaggctgttggtgtccggggggatacaggccaatgctatctgaagaccttgcttttcagtggcaaagaattcccggaacccaacaatgatatctatctaaaagttcccaaggtggcattgtcattgccaaatttgccttctagacaaggccttgtttgcaatttgactgaaaaaatggcacctcctatagaaatttctcagaaaaagttcaagtttggctacttccttacttctgcattgacactacttggctgtggaagtc

SEQ ID NO: 34663 - protein, 453 aa, Panicum virgatum
  misc_feature: Ceres CLONE 1956942
  misc_feature (76)..(186): Pfam Name: B_lectin Pfam Description: D-mannose binding lectin
MAAGQVFSLATALLSFLLPSVALANGTLARGFSISVPTGESTNPILVSPNGAFACGLYKVGTNAFTFSIWFSWSAGRTIAWTANRDAPVNGNGSRVVFQRSGSLELLDYDGTALWSTNTAAMHADSVALLDTGSLVIMDQGGNPLWSSFNSPTDTLLPSQSMAMNTRLVSASANGLVSSGFYTLYFDSNYTLTLTYNRTNGISTKYWPTHTQSSANGNRNQYSGLDSKGAFVAGDQLKFEASDLGDGIMRRLTLDYDGNLRMHSLDISSGGWYISWMLFTRLCEIHGLCGENSLCRYIPALECSCLEGFEMTEPSDWSKGCKRSVASKDFTFTSLPGTDFWGYEVNYNMSMPLEKCMKMCLDDGDCQAVGVRGDTGQCYLKTLLFSGKEFPEPNNDIYLKVPKVALSLPNLPSRQGLVCNLTEKMAPPIEISQKKFKFGYFLTSALTLLGCGS

SEQ ID NO: 34664 - DNA, 599 bp, Panicum virgatum
  misc_feature: Ceres CLONE 1956942-R
  misc_feature: Encodes the peptide sequence at SEQ ID NO. 34665
tgagtggattgtgcattgtgatatcaaaccagagaacatactgttagatgaagaattcgagcccaagattgcagattttgggttagtgaaactgttaggtcggggagtcggagcacaaatgctgtcaagagtgcatgggactagagggtacattgcaccagagtgggctctaaatcttccaatcactggcaaggcagatgtttacagctacggagtagtgcttcttgagttagtgatgggtactcggatttccagccaggtggttcagggggcgggcgaggtggaggtggaaatggctgttggacactatgctaaaattcttaaagagaaattggcaagcaaagatcagtcttggctcctggagtttgtcgattgcagattgagtggagaatttgattatttacaagcggcaatgttgctaaagacagcagtttcatgtgtggaagaggagaggagaagaagaccaaatatgagctatgtggtagaaactctgctttcattagtggaggggtaatgtctagtggaggagaaattgtaatgttgtgggagaaaacaatactgtaccgttgcacaataaagcaaacaagagcttatgtagt

SEQ ID NO: 34665 - protein, 170 aa, Panicum virgatum
  misc_feature: Ceres CLONE 1956942-R
  misc_feature: SWISSPROT Homolog: EC 2.7.11.1 Non-specific serine/threonine protein kinase
EWIVHCDIKPENILLDEEFEPKIADFGLVKLLGRGVGAQMLSRVHGTRGYIAPEWALNLPITGKADVYSYGVVLLELVMGTRISSQVVQGAGEVEVEMAVGHYAKILKEKLASKDQSWLLEFVDCRLSGEFDYLQAAMLLKTAVSCVEEERRRRPNMSYVVETLLSLVEG

SEQ ID NO: 34666 - DNA, 1293 bp, Panicum virgatum
  misc_feature: Ceres CLONE 1956948
  misc_feature: Encodes the peptide sequence at SEQ ID NO. 34667
agcgacgcgtgctgcccagctgccttgctcctcctcttcctgcgccagctagctgcgttggccccccagtggagagaggaggactggaggagcctctatagctagtaggagacaggcggagacagagagggggcggagcagcgcagctagagatcgatagcgtcgtcgtcgtggagcgagatcgatggacagcggcagcggggaggcgtggcgcggggcggtgtctccggcggcgcgctacgcggagtccggcggcgccagtctgacgtgggagaacctcacggcggtgctgccgggcggcggcggccgggccaccaagaagctggtgcaggggctgtacggctacgccgtgcccggccgcgtcgtcgccatcatggggccgtccggctccggcaagtccacgctcctcgactcgctctccgggaggctggccaggaacgtggtcctcaccgggaaggtgctgctcaacggcaagaagaggcggcttgactatggtgtcgtggcgtatgtgactcaagagaacatactcctgggcacgctgacggtccgggagacggtgacctactcggccctgctgcggctgccgtcgagcatgcgcaagtcggaggtgcgccgcatcgtggacgacacgctcgacgagatggggctccgggagtgcgccgaccgccacatcgggacctggcacctccgcggcatcagcggcggcgagaagaagcgcctgagcatcgcgctggagatcctcacccgcccgcgcctcctcttcctggacgagcccaccactgggctcgacagcgccgccgccttctccgtcgtgcagacgctgcgccagctcgccgtcgacggcggccgcaccatcgtctcctccgtgcaccagcccagcagcgaggtcttcgcgctctttgacgacctctgcctcctctccagcggcgagtgcgtctacttcggtgatgccaagctggcaacgcagttctttgcggaaacaggcttcccctgccccagccggaggaatccatccgaccatttcctccggtgtgtcaactccgacttcgatgatgtcgcagccaccatgaaaggatccatgaagctgcgagcagaggcagagtttgatcccctgctgaattactccacgtcagagatcagagaacggctagtggagaagtacaggatctccgattatgccttgatggtcaggaacacaatacacgagataaccaagatcgagggtgtggtggaggaggtgatccgtggcagcgaggcgagctggttcaagcagctgcgcacgctgacgagccc

SEQ ID NO: 34667 - protein, 369 aa, Panicum virgatum
  misc_feature: Ceres CLONE 1956948
  misc_feature (58)..(248): Pfam Name: ABC_tran Pfam Description: ABC transporter
  misc_feature: SWISSPROT Homolog: EC 3.6.3.28 Phosphonate-transporting ATPase
MDSGSGEAWRGAVSPAARYAESGGASLTWENLTAVLPGGGGRATKKLVQGLYGYAVPGRVVAIMGPSGSGKSTLLDSLSGRLARNVVLTGKVLLNGKKRRLDYGVVAYVTQENILLGTLTVRETVTYSALLRLPSSMRKSEVRRIVDDTLDEMGLRECADRHIGTWHLRGISGGEKKRLSIALEILTRPRLLFLDEPTTGLDSAAAFSVVQTLRQLAVDGGRTIVSSVHQPSSEVFALFDDLCLLSSGECVYFGDAKLATQFFAETGFPCPSRRNPSDHFLRCVNSDFDDVAATMKGSMKLRAEAEFDPLLNYSTSEIRERLVEKYRISDYALMVRNTIHEITKIEGVVEEVIRGSEASWFKQLRTLTS

SEQ ID NO: 34668 - DNA, 690 bp, Panicum virgatum
  misc_feature: Ceres CLONE 1956948-R
ggctggagtttgagcccatgatgccggggcagccgaagttcaagggcgagtacatcatcaccgagatgatggggctgagcctggaccactccaagtggctggacctcgccatgatcttcgtcctcctcttcgcctaccgcctcaccttcttcatcgtgctcaaggtcaaggaggccgccgcgccgtacatccgcgtcgcctacacgcgcttcaccgtcaagcgcctggagcggcgcgcgtccttcaggaagacgctggccatgacctcgctgtccaagcggcacaaccagccgcaccccatggccagccaggaggggctcaactcgcccatgccgtactgatcgagctgaggaacacgaagagcagccgggagcggagctggtagcaaatggtagcatcaccggttacttgtggatgtgcttacagatatgtttgttccactgtttaggagttggagcgttcattcacaaagataatacccacgatacagtattcaaagcattcgtttcactgtaataactctctgaacacgatacgcatacaagatagtgctgtgcctactcgtttttttgttttaccttctgttttgtaaacatttaattcgtgcaatgatcttggggggaaaaatcatgcaggaaaaaatactctaggatttttttagtttttttttttgtaatgtatgggtatgtg

SEQ ID NO: 34669 - DNA, 782 bp, Panicum virgatum
  misc_feature: Ceres CLONE 1956968
  misc_feature: Encodes the peptide sequence at SEQ ID NO. 34670
acactcacccagagcagcagccagcagcagcagcgcacactgttcttgtgccgaggaattatttattgccaccgcatcgattcttagtaccgggaaattgattacacaatcccctctggttcctccatccaccccatgttcctgaatttctcaggatattttcctccgctccgcgccagggcagcatttgctcgagatttatagcctccccccgcttttgccgctcccttctgcttgtcctcttttcccccactggggaggttagcatccggcacaagcaaagcgccggttcttgttgcagtttctgtgctctccctttttggctgcaagatctgatacaagaggagagggagtgccgggagaggaagggaggttcttgtggaattcttcggcgatgaggcccgacgcgcggctggattcggtggtcttccagctcactcccacccggaccaggttcgatttggtgctgatagcaaatggccggaaggagaagtttgcatctggcttgctgaaaccgtttctggcgcacctgaaggttgcacaggatcagattgccaagggagggtactccatcacgctcgaaccaagctcagggtttgatgcgccatggtttactagaggcactgtggagagatttgtgcgtttcgtgagtactccggaggttcttgagcgagtcacaacactagagtctgagatcctgcagcttgaggatgccatctctatccagagcaatgataatctttgaataaaatctgttgaagaccatggaagaaagttgactg

SEQ ID NO: 34670 - protein, 116 aa, Panicum virgatum
  misc_feature: Ceres CLONE 1956968
  misc_feature: Functional homolog of the protein sequence given in SEQ ID NO 51410
  misc_feature: Useful for making plants with altered cell wall content and/or composition
MRPDARLDSVVFQLTPTRTRFDLVLIANGRKEKFASGLLKPFLAHLKVAQDQIAKGGYSITLEPSSGFDAPWFTRGTVERFVRFVSTPEVLERVTTLESEILQLEDAISIQSNDNL

SEQ ID NO: 34671 - DNA, 406 bp, Panicum virgatum
  misc_feature: Ceres CLONE 1956968-R
aaacccaaaaggcattgtggggggggagcattccttgaatcccaaggtcaaacggtgcagaacattcacggagacgaagcatggcatgagttgacgtgagatagagaactgaatatgctaaatctatcatgcaactttagcccatcaacctcactagaacccggaacatcatctcgataggcttcttgtacaggaaaaggaaaaaggctggtattggagcatttcctgcttcagagattgtgatagaaaatcaagttatcttcaatggcatggcattgtactttcagtttaacataattatttcattctttaattgagggtggcttgtaatagctgtaaacctgttttttttggcgataccgtgctatattgtgggtgtatttatggtatggactgatcggtgctc

SEQ ID NO: 34672 - DNA, 804 bp, Panicum virgatum
  misc_feature: Ceres CLONE 1956975
  misc_feature: Encodes the peptide sequence at SEQ ID NO. 34673
atcccaacagcttcttcccctcaaagaccactccggcgagattcttcccagaccggccggcgaatcacagctcgatcgatcgttctccggcgagccagcaaccactccctgatcggaatggacttcggaggggcgctgcagctgccgccggggttccggttccacccgacggacgaggagctggtgacgcactacctcctgcgcaagtgcggcgggctggcgccggcggcgccggtgatcgcggaggtggacctgtacaagttcgacccgtggagcctgccggagcgggcggccggcggggagaaggagtggtacttcttctcgccgcgggaccgcaagtaccccaacgggtcgcgccccaaccgcgccgccggcaccgggtactggaaggccaccggcgccgacaagcccgtgggcgcgccgcgccccgtcgccatcaagaaggcgctcgtcttctacgccggcaagccgcccaggggcgtcaagaccaactggatcatgcacgagtaccgcctcgccgacgtcgaccgctccgccgccgcccgcaagaagacggccaataacaacgcgctcagggtaattaacttttcttaatctattacctaactaacaaaccaccttgctgcttcctgttccttgtgctcatctccccaccaacgaaacagtcccacaacactggcactttcagttactattagaaaataactacaaataaaaatcatcttttttttcttagcaaaaatgttactaacaagcatgcaactgcatgtggaatgaaatctgtacatagagcaagcacagtat

SEQ ID NO: 34673 - protein, 158 aa, Panicum virgatum
  misc_feature: Ceres CLONE 1956975
  misc_feature (9)..(134): Pfam Name: NAM Pfam Description: No apical meristem (NAM) protein
  misc_feature: The sequence is a functional homolog of SEQ ID NO 890 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 853 in the 10/374,780 US patent application
  misc_feature: The sequence is a functional homolog of SEQ ID NO 854 in the 10/374,780 US patent application
  misc_feature: The sequence is a functional homolog of SEQ ID NO 891 in the 10/374,780 US patent application
  misc_feature: Functional homolog of the protein sequence given in SEQ ID NO 50322
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Functional homolog of the protein sequence given in SEQ ID NO 50324
  misc_feature: Useful for making plants with altered terpenoid content
  misc_feature: Functional homolog of the protein sequence given in SEQ ID NO 50323
  misc_feature: Useful for making plants with altered cell wall content and/or composition
  misc_feature: Useful for making plants with altered lignin content
  misc_feature: The sequence is a functional homolog of SEQ ID NO 851 in the 10/374,780 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Functional homolog of the protein sequence given in SEQ ID NO 50906
  misc_feature: Useful for making plants with modulated water use efficiency
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Functional homolog of the protein sequence given in SEQ ID NO 50326
  misc_feature: Useful for making plants with modulated light quality response
  misc_feature: Functional homolog of the protein sequence given in SEQ ID NO 50845
  misc_feature: Useful for making plants with altered alkaloid content
  misc_feature: The sequence is a functional homolog of SEQ ID NO 1012 in the 11/435,388 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 852 in the 10/374,780 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 612 in the 11/435,388 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: Functional homolog of the protein sequence given in SEQ ID NO 50327
  misc_feature: Useful for making plants with modulated light quality sensitivity
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: Functional homolog of the protein sequence given in SEQ ID NO 50328
  misc_feature: Useful for making plants with modulated nitrogen use efficiency
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 476 in the 10/666,642 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Functional homolog of the protein sequence given in SEQ ID NO 50908
  misc_feature: Useful for making plants with modulated biomass
  misc_feature: Functional homolog of the protein sequence given in SEQ ID NO 50641
  misc_feature: Useful for making plants with altered carbohydrate content
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: Functional homolog of the protein sequence given in SEQ ID NO 50732
  misc_feature: Useful for biocontainment applications
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 854 in the 11/435,388 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 886 in the 10/412,699 US patent application
  misc_feature: The sequence is a functional homolog of SEQ ID NO 582 in the 10/666,642 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 310 in the 10/666,642 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 108 in the 10/666,642 US patent application
  misc_feature: The sequence is a functional homolog of SEQ ID NO 332 in the 10/412,699 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
  misc_feature: The sequence is a functional homolog of SEQ ID NO 240 in the 10/225,068 US patent application
  misc_feature: The sequence is a functional homolog of SEQ ID NO 368 in the 10/374,780 US patent application
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
MDFGGALQLPPGFRFHPTDEELVTHYLLRKCGGLAPAAPVIAEVDLYKFDPWSLPERAAGGEKEWYFFSPRDRKYPNGSRPNRAAGTGYWKATGADKPVGAPRPVAIKKALVFYAGKPPRGVKTNWIMHEYRLADVDRSAAARKKTANNNALRVINFS

SEQ ID NO: 34674 - DNA, 169 bp, Panicum virgatum
  misc_feature: Ceres CLONE 1956975-R
tggcaaacaggcaacgatgtaggcttttttcggcgagtgttgagcggtataattgcaagcaaatttgatgtgctagagtggctatcagggggtctctttctcgtgaccacggaagccggaatttttgtaacgcaattatatcggtaataaattgtcgtaagatgtaatt

SEQ ID NO: 34675 - DNA, 835 bp, Panicum virgatum
  misc_feature: Ceres CLONE 1956987
  misc_feature: Encodes the peptide sequence at SEQ ID NO. 34676
tgcgcgggggaggaggaggaggagatgtggcggctgaagatcgcggacgggggccgggacccctggctgcgcacgaagaacggccacgtcggccgccaggtctgggagttcgacgccgccgccgagcccgaccccgccgtcgacgccgcgcgccgggccttcgtcgagcggaggcacgacctcaagcacagcgccgacctcctcatgcgcctccagttcgctaaagaaaatcctcttaacctggaccttccagcaatcaagctggatgagcatgaagatgttacggaggaagccgtagcaactactttgaaaagggcaatcagccattgttctactctccaggcacatgatggacactggcctggggactatggtggccctatgttccttatgccaggcttgatcattgcattgtatgtgactggagcactaaacactgtcttgtcatcagaacaccagaaagagatccgccgatatctttataatcatcagaatgaagatggcggctggggcttgcatatagagggtccaagcaccatgtttggctcagcactgacatatgttattttgagattgcttggagagggaccggatagtggagatggagccatggagaaaggtcgaaactggattttagaccatggtggagcaacatttataacatcatggggaaagttttggctctcggtaattggtgtgtttgaatggtctggtaacaacccagtgccaccagaagtatggctgctaccatatatcctgccatttcatccagggaggatgtggtgtcattgccgaatggtgtattttgcaatgtgttacatttacaggaagaggt

SEQ ID NO: 34676 - protein, 270 aa, Panicum virgatum
  misc_feature: Ceres CLONE 1956987
  misc_feature (143)..(186): Pfam Name: Prenyltrans Pfam Description: Prenyltransferase and squalene oxidase repeat
  misc_feature: SWISSPROT Homolog: EC 5.4.99.8 Cycloartenol synthase
  misc_feature: The sequence is a functional homolog of SEQ ID NO 6 in US patent 7122717
  misc_feature: The sequence is a functional homolog of SEQ ID NO 4 in US patent 7135624
  misc_feature: The sequence is a functional homolog of SEQ ID NO 15 in US patent 7186884
MWRLKIADGGRDPWLRTKNGHVGRQVWEFDAAAEPDPAVDAARRAFVERRHDLKHSADLLMRLQFAKENPLNLDLPAIKLDEHEDVTEEAVATTLKRAISHCSTLQAHDGHWPGDYGGPMFLMPGLIIALYVTGALNTVLSSEHQKEIRRYLYNHQNEDGGWGLHIEGPSTMFGSALTYVILRLLGEGPDSGDGAMEKGRNWILDHGGATFITSWGKFWLSVIGVFEWSGNNPVPPEVWLLPYILPFHPGRMWCHCRMVYFAMCYIYRKR

SEQ ID NO: 34677 - DNA, 260 bp, Panicum virgatum
  misc_feature: Ceres CLONE 1956987-R
gtcgctctacctgtgccacgcggagggctgtcttgctggctagctacttgcttgaactgtctcgtgaatcagcttctgtgagtttagtagttcgaataattagctacgtcacgtttaggggctgccttcctaatcctaataatgtatattcaatgtggttaacaatgtagctagattcaggtcagttgataggttctgttgctccgtacctggagttgcacggtggacaccttttaggcaagtctggacacagttcttgc

SEQ ID NO: 34678 - DNA, 624 bp, Panicum virgatum
  misc_feature: Ceres CLONE 1957026-R
  misc_feature: Encodes the peptide sequence at SEQ ID NO. 34679
cgcgttcaagtgccttacaatagcaggggtcctgcctgggcatctttcgatggcaaagatcgaaagcagctatcacctggcgacgctctgatctgcagcatatctccttggcctgtgcccacagcctgcctgatggactcaacgaccgatttcctccgcagcatccatgagggcctccactggaacttgaggaaatcccagtcatttgatggcccgcgcgattgatgcaacagtttttgcagttatatcagtccagtgccagaattctaagctgggtagggcactgatggttgtgttctcctctcagaacagaagcatttcctccaagtgcagctaacagcaaggtgagaggataattgtacctacgcgagtgcgttctcctttaccattacatacataatatagaaggttgcgtacatgtagagagtatagtgcagaatccaaatatactactggccacatgtgtgtagactgtagaggcatttgaacttggtaacggctcatgtggcggatggtaccaaatacatactgatctggataaagtatggggatggcagccactcaaaaatgtatgtatacatgtgatgtgcccccatgatggaaatgaaataatttgtgcgagcc

SEQ ID NO: 34679 - protein, 74 aa, Panicum virgatum
  misc_feature: Ceres CLONE 1957026-R
  misc_feature: SWISSPROT Homolog: EC 2.7.1.23 NAD(+) kinase
RVQVPYNSRGPAWASFDGKDRKQLSPGDALICSISPWPVPTACLMDSTTDFLRSIHEGLHWNLRKSQSFDGPRD

SEQ ID NO: 34680 - DNA, 1031 bp, Panicum virgatum
  misc_feature: Ceres CLONE 1957026
gtacactgccccgcccgtccccgggcaagcgaaagctaagagcagagcgggacaagttcctgcgacggcgaggaggactggatcgcagcgtcatgtcgctcgacgagctcgccgacaaggaggcgtcatcccccgaggaaattcagcttgtgcagtcggatgccaagttccggagcttcagcccgccgccgattccaatcccagtcccagctgctccaagcatcagatcattggtcgactcggtttctgacgagagattagatgtcatggcctcacatcaaagtgaaaatggatccatctctacagctagttctactgttagttcactagaagcagagaaagctgcctatgaattccttgctcaaactcctatcaagtcaaccgatgcacaccttgttgagttttcagaggctatgagaactgttgcaaaagccttacgacgagtggctgaaggcaaggctgctgctcaagcagaggcggcagagtggaaacgcaagtatgaattagagatggcccacaagcaacagagtaaaatcaaaggctgtggcagttgtatcagtaatgacttagacaaactggccagtcaactaaccctggacacagctgcatctgatcaattaggatgttgcggaaaacatggtatatgttcgyatgaggttctccaggacaaagttcctggacctatcccaagacctaatcgcaagatggttgggagaaaggcatcatttaaactttcatggggatgtaatggggataaaaatggacagcataagcatgattttgtgtcctttgaaaaaggtgatataacaacagcagaacggagcaataagcagatcttactgaaatgggaatcacaaccacaaacaggactttttataaccaagcctaattccaactctgtgcgtgttctttgtgcagaaatggtcaaatggcttaaggagcataaaaatataaatgtctttgttgagccacgtgttagcaaggagcttctaacagaggattcctcttacaatttcatccaaacatgggat

SEQ ID NO: 34681 - DNA, 940 bp, Panicum virgatum
  misc_feature: Ceres CLONE 1957037
  misc_feature: Encodes the peptide sequence at SEQ ID NO. 34682
tgggcacttcacacttcacttggttcgctacatataagtgccgtgcctctgctccccctcgtcctgtcgtagtgctcgagagctcggtgggtgcagtgcaaaaatacacaccttgccatgcccgctctctgtccggcgccggcgtgggtggcggccgtcgcgctgtgcacgctgcttgcggccgccgcggtcggtctgtggacgctgctgtcctggcccggacggcggcggcgcgcgagcgatgacaacggggcggcggcccggctcccgcccggcagcttcgggtggccggtcgtcggcgagacgctggacttcgtgtcctgcgcctactcttcccgcccggaggccttcgtcgacaagcgccgcctcctgcacgggagcgcggtgttccggtcgcacctgttcgggtcggcggcggtggtgacgtcggacgcggaggtgagccgggccgtgctgcagagcgacgcgcgcgccttcgtgccgtggtacccgcgctcgctgacggagctcatgggcaagtcctccatcctgctcatcaacggcagcctgcagcgccgcgtgcacggcctcgtcggcgccttcttcaagtcgccgcagctcaaggcgcaggtcaccgccggcatgcagcgccscctcgcgcccgcgcttgccgcctggcgcgcccagggccccggcgcgcgcgtccgcatccaggaccaagccaaggcgatagtgttcgagatcctggtgaagggtctgatcgggctggaggcaggcccggagacgcatcagctcaagcagcagttccaggaattcattgtcggcctcatgtcccttccgatcaagctgccggggacgaggctctacagatccctccaggccaagaagaggatggcgaggctgatacagaggatcatacacgagaagaggaggcggctggaagtcctcgacggcgtccagg

SEQ ID NO: 34682 - protein, 274 aa, Panicum virgatum
  misc_feature: Ceres CLONE 1957037
  misc_feature: SWISSPROT Homolog: EC 1.14.13.93 (+)-abscisic acid 8'-hydroxylase
  misc_feature (172)..(172): Xaa is any aa, unknown, or other
MPALCPAPAWVAAVALCTLLAAAAVGLWTLLSWPGRRRRASDDNGAAARLPPGSFGWPVVGETLDFVSCAYSSRPEAFVDKRRLLHGSAVFRSHLFGSAAVVTSDAEVSRAVLQSDARAFVPWYPRSLTELMGKSSILLINGSLQRRVHGLVGAFFKSPQLKAQVTAGMQRXLAPALAAWRAQGPGARVRIQDQAKAIVFEILVKGLIGLEAGPETHQLKQQFQEFIVGLMSLPIKLPGTRLYRSLQAKKRMARLIQRIIHEKRRRLEVLDGVQ

SEQ ID NO: 34683 - DNA, 659 bp, Panicum virgatum
  misc_feature: Ceres CLONE 1957037-R
catgcccatcatggtcaccagcaaggactgactgcccagccgccgcttgcattgtggatgacttcatctgatgcagatttcagatccgccgggatttgcagcaaactctactacacactatcatatcatgtataggctcgaatagcatccatgaaggaagtaccctcttgatctcgaggtggcaagaacatctacacattattgagggtcccggcaaaatgcgttgctgctgtgcatttggatgtggaggtgtacagaaaagagaggaagaggaaggctaggaagcatggttactaatatatgattaattagtgttaagcttagtattagtatagggttatactagccatgacgacccatcatgtaagcatggtgtctattatagagtactgtaataccattcgattttgcaggttattttcgggggggcgtactggttacgtttctgggcgcagctgcagcgtgaggagcaagccaagacagcactttccttgatgagcagaaatatagagactatcgctttggagttcatcaagggaggatggaacactttttatcgtttgctgtaactcctctattttcccatttatgcgaatcctgtaataattggctatgtacgctcttaggcgtagaggccggatgtttttcatccattatct

SEQ ID NO: 34684 - DNA, 698 bp, Panicum virgatum
  misc_feature: Ceres CLONE 1957070-R
  misc_feature: Encodes the peptide sequence at SEQ ID NO. 34685
cactgcatcgcaacaggcagaacatgggccggagatatgttgaggtgtttagatgcaagaagcaggagtactactgcgcaatagccaacgaggtgaaccaaggtgggtactttgagcctgagtaccgccgctccccaccacctccaaggccgaagaagccggctgaagacaagggcagcatggagtacactgaggtgctgaagctccgtgggcttccctactctgcaaccaccgaggacatcattaagttcttcctggaatatgagctgacagaagagaatgtgcatattgcgtaccgctctgatgggaaggctaccggtgaagcctttgttgagttccccacagctgaagttgcaaagacggctatgtgcaaggataagatgaccatcgggacaaggtatgtggagctgttcccatcaaccccagaggaggccaggagggcgaaatctcgaggcaggcaatgaagaaatacttttgctggatgctctggttgtatgcagcagctgtgttcgagtttagctttctatctgaatgcttactgtatcgctgttaggttgtgctagtcagtgtcgtcctgttgctactgctcgtgcggtgacttattttatgcgaaccaaaatgtaactgtcatcctctgttgggtgcacttgtatggcataaatcattcatggattttgctttagtttctgtaagtgtcc

SEQ ID NO: 34685 - protein, 153 aa, Panicum virgatum
  misc_feature: Ceres CLONE 1957070-R
  misc_feature (66)..(136): Pfam Name: RRM_1 Pfam Description: RNA recognition motif. (a.k.a. RRM, RBD, or RNP domain)
  misc_feature: Functional homolog of the protein sequence given in SEQ ID NO 51469
  misc_feature: Useful for making plants with altered alkaloid content
LHRNRQNMGRRYVEVFRCKKQEYYCAIANEVNQGGYFEPEYRRSPPPPRPKKPAEDKGSMEYTEVLKLRGLPYSATTEDIIKFFLEYELTEENVHIAYRSDGKATGEAFVEFPTAEVAKTAMCKDKMTIGTRYVELFPSTPEEARRAKSRGRQ

SEQ ID NO: 34686 - DNA, 1102 bp, Panicum virgatum
  misc_feature: Ceres CLONE 1957070
gacagggtcctcgtcctcgtcgccatctccggttctcacccccggtaccctaaccctagccgcccgaggcggagtcccctctcctgaccgcgacccggcgccctcgcctccgccaccgagccggccgccggtcgatccagatgaacacgcctccgtctagatccaggtatgctcggaccgcatctacgccactcccccttctgccccgtgagtttatcccccttttgctggctacgatgccctagcctgattgccgtgattgctcgcttattccgccgtagaatctgctccctgatgcgttcccctgaatcctagggatgatctgtcccctaaaatctggaacaatccgtctagttcgtcccgaattggttagggttgtttattcggattggttaatagcgattagattgggttttttctggctggattgttgggggttcatttgaaaccccgtgacccacggtaaatccgccgctggcacggaaccaaactgatgccgctagcaatttgtcgactaagatgccaggtactttacgggattttgggctgtaaattttcgtgcatcctcatagcaacccctgggaaattaatgggcactgaaatagtctagcgcgattctgtgccgaataagttttttgtgtgccatgttgattatttagctatatttgattctattcctttacaataagaaaatattagaaataattttgcccctgttgtgactctgtgtgctagtttgtggtatctgaaatagttttgtccttaatctgaattctaactatcctgtacaattgtcatcaaacactcgatatcaacttccagttcagctgcgttccatcaaatttcttctagggtttaaattttcacctcttttttaagggatccccttttttaatgtaaactgaaaattttgtccatgtgttcttgtgtactgtatgtaaagcaatcaaatatgatcataggtaatttagccagagtcataattatagtttcagtgcactgaaacatgccattaaaacgttcagagaaattcgggtcgtagtcacaagttgcttttataaatgttgctcatgtttactttatttgtgttttggctaaaatt

SEQ ID NO: 34687 - DNA, 607 bp, Panicum virgatum
  misc_feature: Ceres CLONE 1957073-R
  misc_feature: Encodes the peptide sequence at SEQ ID NO. 34688
ggccagaatgtgggtggcaacctgtatcccttactgatttgatcacagccgctgctgttaaaaaagtgtacagaaaagcaacattgtgtatccatcctgacaaggtgcaacaaaagggtgcaaatctccagcagaaatatattgctgagaaggtttttgatctccttaaggaggcatggaacaaattcaactctgaagagctcttctaacaagcctcatgaatgaacatacccatcagcacctgcacaaggttactcaagaagaaacacccaagctggagtggcttgcagacgatagggggaaagcgggaagcagactaagcaaaacctcaactatagctgtagttattgtaatcaccattgcttgtttttagtacccccaattttccttcccatttgtatgtgttgattcaattacatctcacagcggcggcggccctagctggacctcatccagtaggtgtatattagtgccctgttttgtactatttatcctaggctgtatgtgccggcagattgggtgcggggcgtgttgaggccagatgttgtgattttggattaggtacagggtttaattaccatggagagctggttttacttatggtcag

SEQ ID NO: 34688 - protein, 68 aa, Panicum virgatum
  misc_feature: Ceres CLONE 1957073-R
  misc_feature: SWISSPROT Homolog: EC 2.7.11.1 Non-specific serine/threonine protein kinase
PECGWQPVSLTDLITAAAVKKVYRKATLCIHPDKVQQKGANLQQKYIAEKVFDLLKEAWNKFNSEELF

SEQ ID NO: 34689 - DNA, 644 bp, Panicum virgatum
  misc_feature: Ceres CLONE 1957073
gcccgcgtcagagagagaactctctctctcaacatctcctgccctctatcgccggtgacatctccggcggcgctgcgtctccggcgacccccgccgccaccgctccccatttctccgattgccgcatcaagcacggtaccccccgccttgaccccgcgcggctgcccctgccgagatccatccacccagtgtcctcggcgctccccacgcgccgatcggcgggcaggggaggccccgtggccgcgcgctcgagcgccagatccagcgatccgccttccgccgggcccgggatggacgacttccagggcctgctggcccgggacttcggtctccgcccgcaagggaaggacgcgcccatgtcggccacccggtcctcggggccttccggatccgcctgggccagcaccagatccgcctcggcgtccgcagcccccgccgcgccctcgtacgacgacctcttcgggcctgctgcgtcggccccgccgccgaccaagcccgccccgtcgccgtcggcctcctttgactccatcttcgactcgtacaaggagccctcgcccgccgcgccgccgcccaagccgaagcactcgtccatgccggtgtacgacaagccggtctacgacgatgacatcttcgacggggtccct

SEQ ID NO: 34690 - DNA, 1354 bp, Panicum virgatum
  misc_feature: Ceres CLONE 1957081
  misc_feature: Encodes the peptide sequence at SEQ ID NO. 34691
agccgggagtttctccctcgtgtcctcttcctctccttcacttcctccttccgacctcccccgtgctcgcgcgagacctgggccgccgccgcttccctcccgtccacacctcacgctcccgcctcaaccgcgccgccaccgccgccgcctaatcctgccttcgcctccgcgcggctcggagccctcgttcccgcggggatcgtccgaccgtcctcccacctccgcccgcgtgggctcttcttcgggatctcgtcggtccgggcggcgcggggctagggattcaggcccatggcgtggcggcgcgtccttacccagatcgcaaagcaccgacccacaaaagcaatctacaatgagctagttgcttccacccctttgggcactcttagaagtgaagtcactgcaggtgcaagaattagaaacttacaagagaggaatcagtcaagctatattggtagccttgcacgccgtgtgcgagacctagactcaccaagcgaaacttctctgcttaaagaaatttacagaagtgacccagaacgtgtcatacaaatatttgaaagtcaaccttcactgcattccaatccagcagcactttcggagtatgtaaaagctctcgtaagggttgataggttggatgagagcaccttgcttaaaacattgcagagaggtgttgctgcttctacaagaggggaagaaagctttagtagcattccagcattagttggtgctggccaagcgacaaaagatggagtttttggcactgcaaatgcacctattcatatggttacagcagaaacaggtcaatttaaagatcagctttggcgtaccttccgaagcattgcactaactttccttcttatttcgggcattggggctctcatcgaggatagaggaatcagcaaaggccttggtctgaatgaagaggttcaaccaagcatggagtctaatacaaagttcagtgatgtaaagggtgttgatgaagcaaaatatgaacttgaggaaatagttcattacctccgagatcccaagcgcttcacgcgtcttggtggaaaacttccaaaaggtgtcttgcttgttggccctcctggcacagggaaaaccatgctagcgagggctattgctggtgaagctggtgtacctttcttttcttgcagtggaagtgagtttgaggagatgtttgtgggagttggagctcgaagagtgcgcgacctttttgctgcagcaaaaaagcgttctccttgtataatattcattgatgaaattgatgcaattggtgggagcaggaatccaaaggatcaacagtatatgaagatgaccttgaatcagttgcttgttgagttggatggctttaagcaga

SEQ ID NO: 34691 - protein, 355 aa, Panicum virgatum
  misc_feature: Ceres CLONE 1957081
  misc_feature (258)..(355): Pfam Name: AAA Pfam Description: ATPase family associated with various cellular activities (AAA)
  misc_feature: SWISSPROT Homolog: EC 3.6.4.3 Microtubule-severing ATPase
MAWRRVLTQIAKHRPTKAIYNELVASTPLGTLRSEVTAGARIRNLQERNQSSYIGSLARRVRDLDSPSETSLLKEIYRSDPERVIQIFESQPSLHSNPAALSEYVKALVRVDRLDESTLLKTLQRGVAASTRGEESFSSIPALVGAGQATKDGVFGTANAPIHMVTAETGQFKDQLWRTFRSIALTFLLISGIGALIEDRGISKGLGLNEEVQPSMESNTKFSDVKGVDEAKYELEEIVHYLRDPKRFTRLGGKLPKGVLLVGPPGTGKTMLARAIAGEAGVPFFSCSGSEFEEMFVGVGARRVRDLFAAAKKRSPCIIFIDEIDAIGGSRNPKDQQYMKMTLNQLLVELDGFKQ

SEQ ID NO: 34692 - DNA, 660 bp, Panicum virgatum
  misc_feature: Ceres CLONE 1957081-R
aatttcttggagaatgcatacaataatgcaaagactattctcacgaaacacaataaggagctccatgctctagctaacgcacttctagagcatgagactctcacaggagcccagataaagaacatattagcccaggtaaataacaagcagcaacaggagcatgccattgaagcaccacagaagaaccctgccgctccagcttcccctgcatcaccagctgcatcagccgcagcagccgctgctgcagccgcacagcaggcggcagccaaagccaagggggtagctggtattggatcttagcgcatcgagcacccaccatttgcattgtgtatatttcaccaacctagcaagctgttcctgcacttgacggtcaagaggatcatctaaactgcagcagcaatagaacatactgatgatgtgtaagctactgtttatgtgccttgagcgcagaacaaaagaggaaaactctacacgttgtagtaggcacatttagctggtgcttgaatcagttttgtacccacatcgaaaacgatttctgttgtttagaccccaataattgatgcctttgatctgcctgccttatgtacctaacagaggatcataaattgcaacacattctgaataaggatgtcatgtgtgctctaccatccggtagctgat

SEQ ID NO: 34693 - DNA, 539 bp, Panicum virgatum
  misc_feature: Ceres CLONE 1957083-R
  misc_feature: Encodes the peptide sequence at SEQ ID NO. 34694
aagatgcgcaaccataccattacaaacaaaatgacgggtgttgggaacacgctaaagaggcattatgagacatacttgctggaatatgaacttgcgcatgatgatgttgatggagagtgttgcttgctttgccacagtagcgctccaggtgattgggtgaactgtgggttgtgtggagagtgggcccattttggttgtgacacacggcaagggctgggcactttcaaggactatgcgaagactgatgggttagaatacatctgtccccactgtagcgttgcaaaatataagaagccaccgatgaatggaagtgtaggcaatggattcatgaatctgacatctaaaccacacactgtttaacctattatcttggtcattttcaccttctaattttttagccttattgatggcatggttgagaatagaatagtggccaaacaagtgtaggattgatctgtattaacctggttcacttaggctccagagttatttatagcttgtataactgctgacaactatgaaaaatttctaatttagtc

SEQ ID NO: 34694 - protein, 119 aa, Panicum virgatum
  misc_feature: Ceres CLONE 1957083-R
  misc_feature (40)..(94): Pfam Name: PHD Pfam Description: PHD-finger
  misc_feature: SWISSPROT Homolog: EC 2.1.1.43 Histone-lysine N-methyltransferase
KMRNHTITNKMTGVGNTLKRHYETYLLEYELAHDDVDGECCLLCHSSAPGDWVNCGLCGEWAHFGCDTRQGLGTFKDYAKTDGLEYICPHCSVAKYKKPPMNGSVGNGFMNLTSKPHTV

SEQ ID NO: 34695 - DNA, 1189 bp, Panicum virgatum
  misc_feature: Ceres CLONE 1957083
agtagtaacgacgcacctctcatcgccgccaagcccagaaaaggaggaggcgcaggaaagtcgggaacctcgcatccagcgatcggtgcgcggaggctcgatccgcggcgaggagaatccgcaaccccaatccgagcgggttgagcggtggcatgaactgagccggaggcgttatctgtgcagccatgtctcaggtccagagcgcatcgcggcagaactccacgctcctcgctgtgctgtgcgggaagtttgccgagaagcagcggactccagctcggctgggaccggaggcgaagagggtgcggctgttgtacccgttcccggagctcgtctcctctgggaggctggaggtgcacacactgatcaatcccacggtagagcaatttagagaggtgcaacatgtggtgcagcccaacttgatgtatattcagggccagcagctagagaatgagaaggagattggtacgcttgcgtggggcgatacggatttgtctgacccacaggcattttgcttactcatcagcccaccatttccagccatagtttatctggaagttcccataggggaaaagcttgcccagtcacttcattcaaaggggataccctatgtaatatattggaggaattcattctcgtcttatgtagcatctcattttcgccatgctttgatgtctgtcattcaaagttcctgcagccatgcgtgggatgcatttcaacttgcacatgcctcttttcgactatactgtgtaagaaatgaccatgtgcaaagtgttaagcttggccctcgtcttctagggaatgccccaaaggtaaatatcatccttcctgagaatgaaatgggtgagcaagaaggttgctccgaagcctctccagctataaaagtatatgatgaagatgtgaacatgaaatttctcgtctgtggagtgccatgcaccctggatgcatgtttgttggcctcagtggaggatggtttaaatgctctgctgaatattgagattcgtgggagtaaacttcagaaccgagtcagtgctcctcctccacctcttgaagctgaaactcttccacatggggttgttacaatgcgttgcgatatcacaactctctgttcgtctcatgtgtcacttcttgtttctggcagtgctcaaacatgttttgatgatcagcttctggagagtcacaatcaagaatg

SEQ ID NO: 34696 - DNA, 680 bp, Panicum virgatum
  misc_feature: Ceres CLONE 1957088
  misc_feature: Encodes the peptide sequence at SEQ ID NO. 34697
gttccaatgcagattgatgggagcagccagccaagatcactcatgggcttgattgagtaattcctccctttcctccatgtcaatcttgtaatagccccaaccacactcgcatttgcaagcagcaacaatggcgctgcagttcctgctgcgttccatggggttcttggcgatcttggcgtgcctgagcttggcaatgccggcggcagctgctgctgctgccaccgtgccgcagccggagcccgaggtgaagccgagcgacacggacgcgctcaccatcttccgccacggcgccgacgcgcacggcatcctggccgccaactggagcaccggtgacgcctgcgccggccgctggacgggcgtcggctgctccgccgacggccgccgcgtcacctcgctcgcgctcccgtcgctggacctgcggggcccgctcgacccgctctcccacctcgccgagctccgcacgctcgacctccgcgggaaccgcctcaacggcacgctcgacgcgctcctccgcggcgtccccaacctcgtgctgctctacctctcccgcaacgacatctccggcgccatccccgacgccgtcgcccggctcccgcggctcgtccgtgtggacctcgctgacacagcctgagcgggcccatcccggcggcggcgctaggcaagctcacaggcctcctcac

SEQ ID NO: 34697 - protein, 167 aa, Panicum virgatum
  misc_feature: Ceres CLONE 1957088
  misc_feature: SWISSPROT Homolog: EC 2.7.11.1 Non-specific serine/threonine protein kinase
MALQFLLRSMGFLAILACLSLAMPAAAAAAATVPQPEPEVKPSDTDALTIFRHGADAHGILAANWSTGDACAGRWTGVGCSADGRRVTSLALPSLDLRGPLDPLSHLAELRTLDLRGNRLNGTLDALLRGVPNLVLLYLSRNDISGAIPDAVARLPRLVRVDLADTA

SEQ ID NO: 34698 - DNA, 562 bp, Panicum virgatum
  misc_feature: Ceres CLONE 1957088-R
  misc_feature: Encodes the peptide sequence at SEQ ID NO. 34699
cagctttggcgtgctcgtgttggaggcgctgaccggcaaatcgcccgcggcgcagcacccgcaccccttgccggacggcagggacaagaagagcagcgcgatggcggcggcgagcctgccggactgggtgcggtcggtcgtgcgggaagagtggacggcggaggtgttcgacgtggagctgctccggtaccgggacatcgaggaggagatggtggcgatgctgcacgtggcgctggcgtgcgtggcgccgcagccggagcagcggccgtcgatgcgcgacgtggtgaggatgatcgagagcgtgccggtggaccagtcgccgatgccggaggaggacagggacgtctctgtgacctcgccgtccatcggcatcaccaccgacgacgggggtgccaggctcagctactagttgtgttcaggcagcctcaccgttggtctgtctgtttgttgactgtctgtaatgcagtagtatttgggccatccatggtttggtataacattgtgatttgtgaattgtgatgctcaaggccatacaatttatttgggccgtccgatttgttgg

SEQ ID NO: 34699 - protein, 135 aa, Panicum virgatum
  misc_feature: Ceres CLONE 1957088-R
  misc_feature: SWISSPROT Homolog: EC 2.7.11.1 Non-specific serine/threonine protein kinase
SFGVLVLEALTGKSPAAQHPHPLPDGRDKKSSAMAAASLPDWVRSVVREEWTAEVFDVELLRYRDIEEEMVAMLHVALACVAPQPEQRPSMRDVVRMIESVPVDQSPMPEEDRDVSVTSPSIGITTDDGGARLSY

SEQ ID NO: 34700 - DNA, 635 bp, Panicum virgatum
  misc_feature: Ceres CLONE 1957109
  misc_feature: Encodes the peptide sequence at SEQ ID NO. 34701
aagagagcagaagagaacaggatagaatcgaaagaacccttgcccagttgctgcccctcccctaccctttgtcatcagctgagtagggcaccatcaccgcgtcgggcgacctcgtcccgctctcctacatcgccggcctcatcacgggccgccagaactccgtcgcggtcgcccccgacggcaggaaggtggacgccgccgaggcgttcaagatcgccggcatcgagcacggcttctttgagctgcagcccaaggaagggctcgccatggtcaacggcacagccgtgggctccggcctcgcgtcgaccgtcctcttcgaggccaacgtgctcgccgtcatggccgaggtcatctccgcggtgttctgcgaggtcatgaccggcaagccggagttcaccgaccacctgacccacaagctgaagcaccaccccggacagattgaggctgccgccatcatggagcacatcttggaaggcagctcctacatgaagctggccaagaagctcggcgagctcgacccgctgatgaagccgaagcaggacagatacgcgctccgcacctcgccgcagtggctcggcccgcagatcgaggtcatccgcttcgccaccaagtccatcgagcgcgagatcaactcc

SEQ ID NO: 34701 - protein, 122 aa, Panicum virgatum
  misc_feature: Ceres CLONE 1957109
  misc_feature: SWISSPROT Homolog: EC 4.3.1.5 Phenylalanine ammonia-lyase
  misc_feature: Functional homolog of the protein sequence given in SEQ ID NO 50787
  misc_feature: Useful for making plants with altered cell wall content and/or composition
  misc_feature: Useful for making plants with altered lignin content
MVNGTAVGSGLASTVLFEANVLAVMAEVISAVFCEVMTGKPEFTDHLTHKLKHHPGQIEAAAIMEHILEGSSYMKLAKKLGELDPLMKPKQDRYALRTSPQWLGPQIEVIRFATKSIEREIN

SEQ ID NO: 34702 - DNA, 851 bp, Panicum virgatum
  misc_feature: Ceres CLONE 1957116
  misc_feature: Encodes the peptide sequence at SEQ ID NO. 34703
aacggttgacccgggctccgagaaggcgagaacaccaacgcctggcagtctccaacagagcagacgccagagggagccgtggcagcatccatggccgccgccccgccgctccgggctctcctcctgctgctctgcgccgccttctccgtccacgtggcagcggcgcacggggcgagcgccggcggccacgggctcggcgtcaactacggccgggtggcggacgacatcccctcgccgcggcggtccgtggagctgctccgcgcggcgggcgccgggtccgtcaagatctacgacgccaacccgggcgtgctccgcgcgctggcgggcgcgcgctggcccgtctccatcatggtgcccaacgagatcatcccggacatcgccgcctcgcccgccgccgcggaccgctgggtcgccgacaacctggtcccgtactacccggcgacgcgggtcaagttcctgcttgtggggaacgagatcctctccgactactccatcgccaactccacctggacgcgcctcgtcccggcgatggagaacatccacctcagcctccgcaagcggggcatcagcagcgtcaagatcggcaccacgctcgccatggacgcgctcgccgacggcgccttcccgcgcccgccgtccgccgcggccttccgccccgacatcgccgagtccgtcgtgcgcccgctgctgcacttcctgaacgggaccaactcctactacttcgtcgacgcctacccctacttcgtctgggcgggcaacaacctcaccgtctcgctcgactacgcgctcttccagggcggacacgcccgctacgttgagccggggcaccgggctgacatacaccaacatgc

SEQ ID NO: 34703 - protein, 253 aa, Panicum virgatum
  misc_feature: Ceres CLONE 1957116
  misc_feature (35)..(253): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
MAAAPPLRALLLLLCAAFSVHVAAAHGASAGGHGLGVNYGRVADDIPSPRRSVELLRAAGAGSVKIYDANPGVLRALAGARWPVSIMVPNEIIPDIAASPAAADRWVADNLVPYYPATRVKFLLVGNEILSDYSIANSTWTRLVPAMENIHLSLRKRGISSVKIGTTLAMDALADGAFPRPPSAAAFRPDIAESVVRPLLHFLNGTNSYYFVDAYPYFVWAGNNLTVSLDYALFQGGHARYVEPGHRADIHQH

SEQ ID NO: 34704 - DNA, 1275 bp, Panicum virgatum
  misc_feature: Ceres CLONE 1957148
  misc_feature: Encodes the peptide sequence at SEQ ID NO. 34705
ctcttactccctgctcgccagcagtggcgaactggcgagcctccagctcccctgcaactacacccggccttctcctcagctccgcccaacaatcccgtcgctgtgttctcctcagcggcgcggcgaggctttcgcgtcgcctgggcaccgccgggcctccggcttcaccgtccctcgccgccgctcgaggcgcgcgccagatgctcgccgtattgccacaatgacctacgcgtcgtacctagcctcctgctcccgcgcctcgccagcgccggcagcggcggcgtgcccgtgccatgcgcaaccgcggccacggcggcgtcggacccgtccggtgcacctccgggcgtacgccgcctccgaccaccaggagcggctcctcaccgccctgcgcgagcaggcggaccccgaggcggcgctccggatgctgaactcggcgctcgcgcgggaggacttcgccccgagcggcgccgtctacgaagagatcatccggaagctcgggtccgccggcgcgttcgacctgatgaaggggcttgtccgggagatgcggcgggaagggcacgaggtcaaggttggcgtcgtgcactcgttcgtggagggctacgcgcggctgcggcggttcgacgacgccgtcgacctggttctgaaccagctcgatctcttcggcgtccaggcggacaccgtggtgtacaaccacctcctcaatgttctcgtggaggggagcaagatgaagctcctggagtcggtctacaacgagatggctgctcggggcatccaacctgatgttgtgacattcaataccctgatcaaggggctgtgccgggcacatcaggtcaggactgcggtcttgatggtggaggagatgccgagccatggtgtggcgcctgatgagaccacattcaccaccttgatgcaaggctttgttgaggagggaagcattgaggcggctttgagggtgaagacaaagatgttggagacgggatgctctccaacaacggtaacagttaatgttctgattaatgggtactgcaagctggggcgagtggaagatgctcttggatacatacagcaagagattgccgatgggtttgaacctgatcaggtcacatacaatacttcagttcatgggctgtgccaaaacggacatgtcagtcatgccttgaaaatcatcgaccttatgattaaggagggccatgatcctgatgttttcacctacaatactgttattaattggcttctgtaaaaatggagagtttgatggggctaaaggaaattgta

SEQ ID NO: 34705 - protein, 339 aa, Panicum virgatum
  misc_feature: Ceres CLONE 1957148
  misc_feature (189)..(223): Pfam Name: PPR Pfam Description: PPR repeat
  misc_feature (294)..(328): Pfam Name: PPR Pfam Description: PPR repeat
  misc_feature (259)..(293): Pfam Name: PPR Pfam Description: PPR repeat
  misc_feature (224)..(258): Pfam Name: PPR Pfam Description: PPR repeat
  misc_feature (154)..(188): Pfam Name: PPR Pfam Description: PPR repeat
MTYASYLASCSRASPAPAAAACPCHAQPRPRRRRTRPVHLRAYAASDHQERLLTALREQADPEAALRMLNSALAREDFAPSGAVYEEIIRKLGSAGAFDLMKGLVREMRREGHEVKVGVVHSFVEGYARLRRFDDAVDLVLNQLDLFGVQADTVVYNHLLNVLVEGSKMKLLESVYNEMAARGIQPDVVTFNTLIKGLCRAHQVRTAVLMVEEMPSHGVAPDETTFTTLMQGFVEEGSIEAALRVKTKMLETGCSPTTVTVNVLINGYCKLGRVEDALGYIQQEIADGFEPDQVTYNTSVHGLCQNGHVSHALKIIDLMIKEGHDPDVFTYNTVINWLL

SEQ ID NO: 34706 - DNA, 684 bp, Panicum virgatum
  misc_feature: Ceres CLONE 1957163-R
  misc_feature: Encodes the peptide sequence at SEQ ID NO. 34707
agaaaaagaagctgtacgagacacaaattgaacagctatcaaattttcaattgcgagttcatgaccagattataatgcttgaaagtgcaaaggcaactaccgatactgttgatgttttgcgctctggatcatctgctgtcaaagctattcagcaatcactgtacatcgatgacattgagaacgccattgatgcggcaaacgaacagacagaaaatatgaggcagatacaagaggcacttgcaacaccagttggcgcttctgctgattttgacgaggatgagctagaagcagagctggaagatctggaggaggaagagctcgaggaagaggagttgcctgcacctccagcgaggatatctgcgcatgtggaaccattagcaaagcaaacatcatcttctatgcagagcagtgatttgagtgaactgaccaaacttcaggcagagatggcagtttagctgtagcttctagcttggccgacattgggagggattggcccgacattgcgatccctctgttgcaccgatatcctggtgcttacttgtatgagtgatgtaaattcaggttgttatcagagcgatggcatcagcaattatttgtatctgtgtgatgacatcagcaattaacagcttgtgttactcctgtagctttctgtgctaatcactgttcctgctgtgttatctatgc

SEQ ID NO: 34707 - protein, 150 aa, Panicum virgatum
  misc_feature: Ceres CLONE 1957163-R
  misc_feature (1)..(119): Pfam Name: Snf7 Pfam Description: Snf7
KKKLYETQIEQLSNFQLRVHDQIIMLESAKATTDTVDVLRSGSSAVKAIQQSLYIDDIENAIDAANEQTENMRQIQEALATPVGASADFDEDELEAELEDLEEEELEEEELPAPPARISAHVEPLAKQTSSSMQSSDLSELTKLQAEMAV

SEQ ID NO: 34708 - DNA, 1151 bp, Panicum virgatum
  misc_feature: Ceres CLONE 1957163
tgtcaagcagcagtttcctctcaaaaaaagaaaaaaaagagagaaaaggcagcaacagttctccgcaccgcaggcggcaggctgacagccagcgccaccgcccaccgggcaccggctcgacggtttcagctccactgcggccagcttctgcgcgactccgctcccagcctccaaggcaggcaaggcaagtgctggtcgcccaacgcggggcccgccgcgccggccgctggagctggtagagaggctggcgcgggccgctgtgcagctgctcggctaggtgcttctgttgatctggtcagtggggaatactattctatagttatgcgcgtgcatttccagtgacccgtgatgaggaaccggttccagtccagtagacctctagtacacgctcatgattctgaccaggtccctttgcgctcttgaagttgaaaccctctaaaaaggaaggggaatctataaactgtagatatctcatatcccatcttttgcggttaatgaatgggaaaaagggggaactgaaattggcctcccatctgcaagccctttcgcaaaagctggatgctttctgaatggaggcatgggttaagaatacctcggccctttattctccactttttaggtatatctgaattttgcaatgcgaatttaatttttttactcactccaaaggcaaaacaaagatgatagcaaatgcatggcagctcaactacttgtcctgaaaggaaaaggggggatgatttacctcggaactctgtctcatgtaagaagcatcaagtgttatgatgtaggattcacagttgtttgctaaccatatagtagatgctgacagcagcaacatgccaaattatagataggttgcaagacccacctaatccaacatacctgctacatatttcttccacatgccgattttgtttttttctgtcgttagtagatatcttccgcggctgataggattgtcacttcccattcttaagatagcgacatgattgaaatgtcctttcttcttttacatgagcagagaggtccttctctcttcttcattacaaatggttgcccctacatattcttcctactattctcaaggaatctattctgagaacctcttccctcactttccccttcacccttgagaggcaatctccaattca

SEQ ID NO: 34709 - DNA, 1271 bp, Panicum virgatum
  misc_feature: Ceres CLONE 1957169
  misc_feature: Encodes the peptide sequence at SEQ ID NO. 34710
aacgggagcagcccgctgccaaggccaaaaccccgcaccacctccctcccctgctgcaccccgctgccgcgcactccattcccatcgcaccactcccctccccttttccatcccctccacgaaacccactcgcttttggagcaaatctttctctcgcgctgacgtccccgccgttgccctctagctagcgcccatccagctcgcggtcaggcaggcctcggccctcggctcgctcgtccctcgtcaccaaccttggaaggctctctgtagcaggctcgcccaacgcaatggcaggcggcaatggcgccgccgcccgtctcctcttgtacttcgccggcctgcttatcgtgccgctgctcgtggccggcgacgacccctaccggttcttcacgtggacggtgacctacggcgacatctacccgctcggcgtcaagcagcaggggatcctgatcaacaaccagttcccggggccgcagatcgaggcggtcaccaacgacaacctcatcatcaacgtcttcaacaagctcaacgagccgttcctcctctcctggagcgggctccagcagcggcggaactcgttcgaggacggcgtggccggcacgacgtgccccatcccgccgggcgccaacttcacctacatcatgcaggccaaggaccagatcggcacctactactacttcccctcgctcgccttccacaaggccgccggcggcttcggcggcatccgcgtcctcagccgccctcagatccccgtccccttcccgccgccggccgccgactacaccgccctcatcggcgactggtacagggccaaccacaccgacctgaggtacgttcttgacagcggcaaggcgctcggcttccctgacggcctgctcatcaacggccggggccccaacggctacaccttcaccgtgcagcccggcaagacgtaccgcttccggatcaccaacgtgggcctggccacctccctcaacatccggttccagggccacaccatgaagctcgtcgaggtggagggctcccacaccatgcagaccacctactcgtccctcgacgtgcacctcggccagtcctactccgtgctcctcaccgccgaccagcccgccttcgactacgccatcgtcgtctccacgcgcttcaccaccaggatcctctccaccaccgccgtccttcactacgccaactccgccggcaaggcgcccgggcccctccccggaggccccaccatccagatcgactggtctctcaaccaggcccgctccatcagg

SEQ ID NO: 34710 - protein, 327 aa, Panicum virgatum
  misc_feature: Ceres CLONE 1957169
  misc_feature (163)..(301): Pfam Name: Cu-oxidase Pfam Description: Multicopper oxidase
  misc_feature (37)..(153): Pfam Name: Cu-oxidase_3 Pfam Description: Multicopper oxidase
  misc_feature: SWISSPROT Homolog: EC 1.10.3.3 L-ascorbate oxidase
MAGGNGAAARLLLYFAGLLIVPLLVAGDDPYRFFTWTVTYGDIYPLGVKQQGILINNQFPGPQIEAVTNDNLIINVFNKLNEPFLLSWSGLQQRRNSFEDGVAGTTCPIPPGANFTYIMQAKDQIGTYYYFPSLAFHKAAGGFGGIRVLSRPQIPVPFPPPAADYTALIGDWYRANHTDLRYVLDSGKALGFPDGLLINGRGPNGYTFTVQPGKTYRFRITNVGLATSLNIRFQGHTMKLVEVEGSHTMQTTYSSLDVHLGQSYSVLLTADQPAFDYAIVVSTRFTTRILSTTAVLHYANSAGKAPGPLPGGPTIQIDWSLNQARSI

SEQ ID NO: 34711 - DNA, 708 bp, Panicum virgatum
  misc_feature: Ceres CLONE 1957169-R
  misc_feature: Encodes the peptide sequence at SEQ ID NO. 34712
acgtggtgcagtcgtggcacatcgacggctacgccttctgggtcgtcggaatggacggaggaaaatggtcggcggcgagcaggcagggctacaacctgagggatggcgtctcccggtacactgtccaggtttaccccaggtcatggacggcgatctacatgcccctggacaacgttggcatgtggaacgtccggtcggagagctgggccaggcagtacctggggcagcagttctacctccgcgtctggacgccgtcgacgtcgttgcgcgacgagttcccgatccccaagaacgctctcctctgcggccgggcggccggccgccggaccaggccgctctgactcgcgccggcggcggcggaccggggcttgtcatgagaggatgacatgcttacacattggtctggagagagtaggcacaggagattttatttactctgaagaattgaaggctccaagaagtgtgtggcctgaatggaggtctgaaacgttgcctgaaagcatatgccagtgacagtcagattagaccgtgtaatactactgttatagtgttgggttaatgggttttgtctgcattttgcttgagtgattcctttgcgcaacgcaattgttttagtgagggggttacatggctacaaacgacatattctgtagcacgcatgttgctacgctgatcaggttcttaataaagtatcatatgttctggatc

SEQ ID NO: 34712 - protein, 112 aa, Panicum virgatum
  misc_feature: Ceres CLONE 1957169-R
  misc_feature (1)..(87): Pfam Name: Cu-oxidase_2 Pfam Description: Multicopper oxidase
  misc_feature: SWISSPROT Homolog: EC 1.10.3.3 L-ascorbate oxidase
VVQSWHIDGYAFWVVGMDGGKWSAASRQGYNLRDGVSRYTVQVYPRSWTAIYMPLDNVGMWNVRSESWARQYLGQQFYLRVWTPSTSLRDEFPIPKNALLCGRAAGRRTRPL

SEQ ID NO: 34713 - DNA, 673 bp, Panicum virgatum
  misc_feature: Ceres CLONE 1957170
  misc_feature: Encodes the peptide sequence at SEQ ID NO. 34714
tgactccattggtcgtcagatctctcttcagcaaactgccgccgccctcgccgtctccggggtctcgtctcgagcttgccatggaggaccagagccccaagcctatccgttgcaaagcggcggtgtgcagaggtcccggcgagccgctcaccatcgaggagatcgtcgtcgatcccccgaaagcgtacgaggtccgcgtcaagatcatctgcacctcgctctgccacaccgacatcaccttctggcgcaccgagtttgcgacaacttttccaagaatcttaggccacgaagcctacggggtggtggagagcgtgggggagtatgtggagggcatcgccgccggcgacgcggtggtgccgacgttcatggggcaatgcgacacctgcctgggctgcgcgtccgagcacaacaacctctgcaccatggtgccgttcatctttggccccgggatgcggcgcgacggcaccacccgattttgggatgcccagggaaaccccctgcacgacctggtctccgtgtccagcttcagcgagtacaccgtcgtggatgtcacccaggccgtcaaaatcgacccctctgtgccgcccaagatcgcctgcctcctcggttgcggagccagcaccggggtaggagctgcatggaaggtggccaaggtggaaccaggctcatcgat

SEQ ID NO: 34714 - protein, 197 aa, Panicum virgatum
  misc_feature: Ceres CLONE 1957170
  misc_feature (35)..(163): Pfam Name: ADH_N Pfam Description: Alcohol dehydrogenase GroES-like domain
  misc_feature: SWISSPROT Homolog: EC 1.1.1.1 Alcohol dehydrogenase
MEDQSPKPIRCKAAVCRGPGEPLTIEEIVVDPPKAYEVRVKIICTSLCHTDITFWRTEFATTFPRILGHEAYGVVESVGEYVEGIAAGDAVVPTFMGQCDTCLGCASEHNNLCTMVPFIFGPGMRRDGTTRFWDAQGNPLHDLVSVSSFSEYTVVDVTQAVKIDPSVPPKIACLLGCGASTGVGAAWKVAKVEPGSS

SEQ ID NO: 34715 - DNA, 1259 bp, Panicum virgatum
  misc_feature: Ceres CLONE 1957172
  misc_feature: Encodes the peptide sequence at SEQ ID NO. 34716
atactactcatactcatactcgtacctcttgttcttaacaaataactaaaattctcttgtcgagcgagatcttatctcgtcatcccccctcttcaaacgaccctctcccccccccgccaacccctcgtcggtcgatcttcctcatctcttctctcctccttccgctcgccgtcctgtctcgtcccagcaacgcctaggctttctttcgatcgaaccggccataacaaactatagccatgggtcagactctatcggagcccgttgtcgaaaagacttcggagaagggtgaggatgagcgcctcatctacggtgtttcggccatgcaaggctggcgcattagtatggaggatgctcacaccgcagtactcgacctcgactcagccaagtctcactccagcaagctgtccttcttcggtgttttcgacggacacggtggtgacaaggtggcactatttaccggccaaaacattcacaacattatcttcaagcaggacaccttcaagtctggtgactatgctcagggtctgaaggacggtttcctcgcgaccgatcgcgctattctcaacgacccaaagtacgaagaagaggtttccggttgcacagcctgtgtcagcttgatcgctggcaacaagctctatgttgccaacgctggtgattcgagaggtgttcttggtatcaagggtcgtgccaagcctctatctcaggaccacaagccccaactcgagaacgaaaagaaccgaatcacagctgccggtggctttgtcgacttcggccgagtgaacggaaacctcgccctctcgcgtgctattggtgattttgaattcaagaagagtgctgagttgtcccccgagaaccaaattgtcacagcctaccccgatgttgagcaacatgatcttacagatgaggatgaattcctggttattgcttgtgatggtatctgggattgccaatcctctcaagccgtggttgagttcgtccgacgaggcatcgctgccaagcaggagctcgacaagatttgtgagaacatgatggacaactgtcttgcctccaactccgagaccggtggcgttggctgcgataatatgaccatggtcatcatcggcttcctcaacggaaaaaccaaggaagagtggtacgaggagatcgcccgccgggtcgccaacggagatggcccatgtgctcctcccgagtacgccgaattccgaggacctggagtccaccacaactttgaggatagcgacagtggctatgagatggat

SEQ ID NO: 34716 - protein, 340 aa, Panicum virgatum
  misc_feature: Ceres CLONE 1957172
  misc_feature (22)..(277): Pfam Name: PP2C Pfam Description: Protein phosphatase 2C
  misc_feature: SWISSPROT Homolog: EC 3.1.3.16 Phosphoprotein phosphatase
MGQTLSEPVVEKTSEKGEDERLIYGVSAMQGWRISMEDAHTAVLDLDSAKSHSSKLSFFGVFDGHGGDKVALFTGQNIHNIIFKQDTFKSGDYAQGLKDGFLATDRAILNDPKYEEEVSGCTACVSLIAGNKLYVANAGDSRGVLGIKGRAKPLSQDHKPQLENEKNRITAAGGFVDFGRVNGNLALSRAIGDFEFKKSAELSPENQIVTAYPDVEQHDLTDEDEFLVIACDGIWDCQSSQAVVEFVRRGIAAKQELDKICENMMDNCLASNSETGGVGCDNMTMVIIGFLNGKTKEEWYEEIARRVANGDGPCAPPEYAEFRGPGVHHNFEDSDSGYEM

SEQ ID NO: 34717 - DNA, 449 bp, Panicum virgatum
  misc_feature: Ceres CLONE 1957172-R
ccagctttctgggaagtttaaagggcaagtggtagatggtggtcatgagagggggttgtgatattctcctgttaagtcttgcatctcaacttgtcggtgtattggtgtcaaacctggatctggatcgtgcgctcttcatcgacttgccgaggcgcatcacgagaagagcgagactcggaaaggatatcatgttctgggctgaggcggatacaaggaaagagagaaagaaagaaagaagagcgagagaaacctttttttgatgtttacgcacgcatgggattcccattttcttcacgtcgccatgagatcatccgtctcattccaaatttccgttgcgaatgccagtcgctgggatgatatgctcgagtatggttggattgcttttagaggggtcaagaggcagtatagcatatacaggacactaactgacggtccatttttgttttttc

SEQ ID NO: 34718 - DNA, 1262 bp, Panicum virgatum
  misc_feature: Ceres CLONE 1957177
  misc_feature: Encodes the peptide sequence at SEQ ID NO. 34719
gtccctgtccctccactcctcccgtcgagcacttggcactgccaatggcggctcccgcccgcgcccttccgatgcgcgccagcctcctcctctcctcgtgagatcgacgcgcctcctccgcgtgctccattctccctcctcgttcgtttcttcggccccgagccatcgcccgttcgcccccgcatctcgtcgtgctccgggttcttggcctccgccgttcttggcctggcgcgcgccccggtgcccgtgccgctgaatccgactgacccgtgcggacccttcttgtgggcgggatccagcaggcggttagcgggagcgggagcggcgccacacaccgggggacgcgcaatggcggccgtggtgactcctatctgcacgtggctcgtagccgcatgcttgtccgcggcatgcgacgccgacgagcataagcagaagcattgctttcctggtggaagcggcgcggggggcggcgccatgttcgcccagggccgtgagcgccgccgcctcggtgcgcggcggcgcggcgcggcgcgctctggaatggccatggctgttgccctacaagctgaaagaagtgttatcgaaaagaagaaacctgatatcaaacaaaggagggtggttgtcactggcatgggtgtagtgacaccattgggccatgatcccgatgtgttttacaacaaccttcttgatggagttagtggaatcagcgagatagagaggtttgactgctccaacttccccacgagaattgcaggagaaataaaatccttttctactgatggttgggtagcacctaagcttgctaagcggatggacaagtttatgctatatttgataactgctggaaagaaggcattagaaaatggtggactcactgaagaactcaggaatgagttggacaaaaccagatgtggtgttctcattggttctgcgatgggcggcatgaaggttttcaatgatgcgattgaagcactgagggtttcttacaagaaaatgaacccattttgtgttccctttgctactacaaacatgggctctgcaatccttgcaatggatctgggatggatgggaccaaactattctatttccactgcttgtgctaccagtaacttctgtatcctcaatgcagcaaaccacatcagaagaggggaagctgatgttatgctctgtggtggatctgatgcacctcttatcccaattggattgggaggttttgtggcctgcagggctctttcacagagaaacagtgatccaacaaaagc

SEQ ID NO: 34719 - protein, 304 aa, Panicum virgatum
  misc_feature: Ceres CLONE 1957177
  misc_feature (88)..(304): Pfam Name: ketoacyl-synt Pfam Description: Beta-ketoacyl synthase, N-terminal domain
  misc_feature: SWISSPROT Homolog: EC 2.3.1.41 Beta-ketoacyl-acyl-carrier-protein synthase I
MAAVVTPICTWLVAACLSAACDADEHKQKHCFPGGSGAGGGAMFAQGRERRRLGARRRGAARSGMAMAVALQAERSVIEKKKPDIKQRRVVVTGMGVVTPLGHDPDVFYNNLLDGVSGISEIERFDCSNFPTRIAGEIKSFSTDGWVAPKLAKRMDKFMLYLITAGKKALENGGLTEELRNELDKTRCGVLIGSAMGGMKVFNDAIEALRVSYKKMNPFCVPFATTNMGSAILAMDLGWMGPNYSISTACATSNFCILNAANHIRRGEADVMLCGGSDAPLIPIGLGGFVACRALSQRNSDPTK

SEQ ID NO: 34720 - DNA, 766 bp, Panicum virgatum
  misc_feature: Ceres CLONE 1957177-R
  misc_feature: Encodes the peptide sequence at SEQ ID NO. 34721
gggtagccagggaggaaatcaactatgtgaatgcacacgcaacgtctacacaatcgggtgacttgaaggagtacgaagctattgtgcgttgtttcggccagaatcctcaactaagggtgaactcaacaaaatcaatgactggccatcttataggagcagctggtggaattgaagcagttgcttctatacaagctataagaactggttgggtccatccaaatctgaatttagaaaatccagagaatattgtggatgtgggcgtcttggtaggaccacagaaggagagatgtgaagtgaatgtggcactatccaactcattcggatttggtgggcacaactcatcaattctctttgcacccttcaagtgaacatggccgacaaactaccatcttcgtccaacggcttcatacatctagacctgcatatagaagactagtggactctgtggcttcctatacactacacatactacatggaggtccaagctgaggggagaacgctataactatttgaaaacatcaggcccatgcaaggttcaactatatcacaaaattgcaaatatatggtatctatcaaacgacttgctgtatctggccggtgttttcaccttcaccgtgtctgcccagtcagtagatgatccttttccctgcggaggtgatgggattttatgttgtattgatgttgtgaacaatgtcggttattagccatgaattgctggtttccctgtaagaattgcttggcattttcactttggtcgtttttctgc

SEQ ID NO: 34721 - protein, 121 aa, Panicum virgatum
  misc_feature: Ceres CLONE 1957177-R
  misc_feature (2)..(77): Pfam Name: Ketoacyl-synt_C Pfam Description: Beta-ketoacyl synthase, C-terminal domain
  misc_feature: SWISSPROT Homolog: EC 2.3.1.41 Beta-ketoacyl-acyl-carrier-protein synthase I
VAREEINYVNAHATSTQSGDLKEYEAIVRCFGQNPQLRVNSTKSMTGHLIGAAGGIEAVASIQAIRTGWVHPNLNLENPENIVDVGVLVGPQKERCEVNVALSNSFGFGGHNSSILFAPFK

SEQ ID NO: 34722 - DNA, 604 bp, Panicum virgatum
  misc_feature: Ceres CLONE 1957186
  misc_feature: Encodes the peptide sequence at SEQ ID NO. 34723
cctcctccgtcctcccccccccaccccccacctcgcgtctctctcgcccacacgcggagcggcagccgcgggagccccacccgcccacgccgccggccatgtcggtggagacggagcggagctccaccgagtcctccgccgcctcgggcctcgacttcgaggacaccgcgctcacgctcaccctccgcctcccgggctccgcgtcctcgtcctcgtcctcctccgccttccccgaccccgaccgcaagcgcgcctcctccgacgccgacgccggccgctcctccccgctcgccgccgcgtcctccgatgctcccccggcacccaagtacggcccgccttccccaccgataatcttaggccacgcacctgtctcctttttccaggaaaaaggtggttgatttggcgagaggttagcgtcagcctgactgttgcttgcttgcttccgcctctgcctctctcttctggtggccagggcgcgggtggtggggtggccgccggtgaggtcgtaccgcaagaacgcgctcgccgacgtcgcgggctccagcaaggccaagcaggccgccaagttcgtcaaggtggccgtcgacggcgcgccctacctgcg

SEQ ID NO: 34723 - protein, 99 aa, Panicum virgatum
  misc_feature: Ceres CLONE 1957186
  misc_feature: The sequence is a functional homolog of SEQ ID NO 738 in the 10/374,780 US patent application
MSVETERSSTESSAASGLDFEDTALTLTLRLPGSASSSSSSSAFPDPDRKRASSDADAGRSSPLAAASSDAPPAPKYGPPSPPIILGHAPVSFFQEKGG

SEQ ID NO: 34724 - DNA, 588 bp, Panicum virgatum
  misc_feature: Ceres CLONE 1957192
  misc_feature: Encodes the peptide sequence at SEQ ID NO. 34725
ttttgagaagaaaaataatgaaacaattctagtgtttgacttgggaggtggtacctttgatgtatctgtattggaggttggagatggtgtgtttgaggtgctttccacatcaggtgacacacatcttggcggtgatgacttcgataagagaatagtagactggcttgctagcaactttaagaaagatgaaggcatcgatcttcttaaggacaaacaagcccttcagcggcttactgaggcagcagagaaagctaagatggaactgtcaacgctgacacaggcaaacattagcttgccgttcattactgctactgctgatgggccaaaacacattgaggcaaccctctccagagccaaatttgaggaactatgttcagacctcatcgacaggcttaaaactcctgttaataatgcattgagagatgccaagttatcggtcagtgatcttgatgaagtgattcttgtgggtggatccacccgaatccctgcagtgcaagaacttgtgaggaagcttaccgacaaggatcctaatgttacagtaaaccctgatgaggttgtttctcttggggcagctgtgcagggtggggt

SEQ ID NO: 34725 - protein, 195 aa, Panicum virgatum
  misc_feature: Ceres CLONE 1957192
  misc_feature (1)..(195): Pfam Name: HSP70 Pfam Description: Hsp70 protein
FEKKNNETILVFDLGGGTFDVSVLEVGDGVFEVLSTSGDTHLGGDDFDKRIVDWLASNFKKDEGIDLLKDKQALQRLTEAAEKAKMELSTLTQANISLPFITATADGPKHIEATLSRAKFEELCSDLIDRLKTPVNNALRDAKLSVSDLDEVILVGGSTRIPAVQELVRKLTDKDPNVTVNPDEVVSLGAAVQGG

SEQ ID NO: 34726 - DNA, 585 bp, Panicum virgatum
  misc_feature: Ceres CLONE 1957194
  misc_feature: Encodes the peptide sequence at SEQ ID NO. 34727
acgctcgatctctcgagcacagagcactgcaccctctcatccgccggtgcttgctcctcctccccacttcagctagtagcctcttcttgagagaatcatcaggaagaggccgggatatcgagggatcgagcaagatgatgagcggcaaggctctccttgtcgccgtgctcttggtgggcgtcgcctcccggtgctccggcagcaggggcctgcagggggatcacatcgctgagcagaagtacggtggcggtgggtacggtggcggcggcggcggatatggtggtggcggtgggtacggaggcggcggtggtggtggcggcggcggctacacgcccggctactccggcaccggaacctgcgactactgaaagagccacccggacgcgatcatctcgtgcatcgggtcgctgggcagcatcctggggtcctttggcgacgtgtgcagcgccttcttcgggagcaagctgcagacgctgcaggacgcgctgtgcaacacgcgcaccgactgctagggcgacttcctcaccgagggcgccgccgcctacctcaactgcatcgcctcgccggaacacgcctgcgtcacgc

SEQ ID NO: 34727 - protein, 77 aa, Panicum virgatum
  misc_feature: Ceres CLONE 1957194
  misc_feature (1)..(73): Pfam Name: GRP Pfam Description: Glycine rich protein family
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Functional homolog of the protein sequence given in SEQ ID NO 50210
  misc_feature: Useful for making plants with altered lignin content
  misc_feature: Useful for making plants with modulated biomass
  misc_feature: Useful for making plants with modulated nitrogen use efficiency
MMSGKALLVAVLLVGVASRCSGSRGLQGDHIAEQKYGGGGYGGGGGGYGGGGGYGGGGGGGGGGYTPGYSGTGTCDY

SEQ ID NO: 34728 - DNA, 1276 bp, Panicum virgatum
  misc_feature: Ceres CLONE 1957201
  misc_feature: Encodes the peptide sequence at SEQ ID NO. 34729
cttgtcgccattaacgaccgcttccacttccccccgctcccttcctcgcccgcccgccaccgcgtggattcgcggctacaaatcccgccccgccgccggggcatccggatccgccaccgcccaccgccgtgtgctgctcgcgctgtcgacggaccgagacaggggggggggacgatggtgcggctcccgtacgtgaccgcgctcaccacgctcttcagctacggcctcctcttcgccttcggccagctgcgcgacttcttccgcaggatcctcgacgcccgcaagcccagcaacctcaagggttacgcgccgatatgcttgggcctcgaggatttctacacgcgccgtctctatctccgcatccaggactgctttggccggccaattgcaagtgcgccagatgcttggtttgatgtggttgagcgttactcaaatgactgcaacaagacactccagtatgttattactccctcccttcttaaatatatgacgtttaggacaagcaaattagttcatttttgaactaaataggttgtcctaagcgacatatatttaaaaacggaggtaatacttacattccatcccataagtgaataccattcacacattgtcttggcatgggtgtgaacatctgattcagtgtatctttgatgcagtcgaaccgcaaaaacatccaaatgccttaatttgggttcctacaactaccttggttttgctgcagctgatgagtactgcacccctcgtgttattgagtcactgaagaagtactctgcaagcacgtgcagtgttcgagttgatggaggtaacactaagttgcacactgagcttgaagaactggttgcgagatttgttggcaagcctgcagcagttctttttggcatgggctatgtgacaaattctgctatcattcctgctctaattgggaagggaggcctgataataagtgattcattgaaccataattctatagtcaatggagctaggggttcaggggccaccgttcgtgtttttcaacataacaatcctgctcatttggaagaggtattgagagagcagattgcgggagggcagcctcgtacacacagagcatggaagaagattgttgtgattgttgagggaatttatagcatggagggggagctatgcaaactcccagaggttatttctgtatgcaagaaatacaaggcttacacatatttagacgaggcacacagtattggagcagttgggaaaacagggagaggtgtatgcgagctactgggagtggatccagctg

SEQ ID NO: 34729 - protein, 132 aa, Panicum virgatum
  misc_feature: Ceres CLONE 1957201
  misc_feature: SWISSPROT Homolog: EC 2.3.1.50 Serine C-palmitoyltransferase
MGYVTNSAIIPALIGKGGLIISDSLNHNSIVNGARGSGATVRVFQHNNPAHLEEVLREQIAGGQPRTHRAWKKIVVIVEGIYSMEGELCKLPEVISVCKKYKAYTYLDEAHSIGAVGKTGRGVCELLGVDPA

SEQ ID NO: 34730 - DNA, 758 bp, Panicum virgatum
  misc_feature: Ceres CLONE 1957201-R
  misc_feature: Encodes the peptide sequence at SEQ ID NO. 34731
aacagcaatttctttcggtcagagcttcagaaaatgggttttgaggttcttggggataatgactcacccgtcatgcctatcatgctttacaatcctgctaaaattcctgcattttcaagggagtgcctgaggcaaaatgttgctgttgttactgttgcatttcctgccactccacttctacttgcaagagctaggatatgtatctcagcttcccactccagggaagatctcattaaaggattagaggtgatcagcaaagttggtgatctcgtgggtatcaaatacttcccggttgagcaagaaaagactgcagttgttgagaaacagaagaagatccaatgaacagtgccaggtgcaaacaatctgctgctacagtgctagtttactgggccatcctggtgtgcacccgtaccgtatgcctttggcccctctgcggtctgtgcacctctgggtccttttttcttgcccttttgtttctgaagaaattttagatgattttgtacagtatgtatcatccaccgtagttcggcacataacacacagatagacattgttttatcaaatttagaaaaaaacagtttttagatctctgaaaccttgagaggtgagactatgagtgaaatcatgtatctatttgcagttttattatcgataaattcagtttgttttgaattggataatgatggctccaagtttgtgtaaccaagtaataaacccagagtacaaaaatgcaaaagcagcagagttgaatctgaatc

SEQ ID NO: 34731 - protein, 113 aa, Panicum virgatum
  misc_feature: Ceres CLONE 1957201-R
  misc_feature: SWISSPROT Homolog: EC 2.3.1.50 Serine C-palmitoyltransferase
NSNFFRSELQKMGFEVLGDNDSPVMPIMLYNPAKIPAFSRECLRQNVAVVTVAFPATPLLLARARICISASHSREDLIKGLEVISKVGDLVGIKYFPVEQEKTAVVEKQKKIQ

SEQ ID NO: 34732 - DNA, 666 bp, Panicum virgatum
  misc_feature: Ceres CLONE 1957217
  misc_feature: Encodes the peptide sequence at SEQ ID NO. 34733
gctagctgatatctttgttgctagctttgaaataagctttgaggagcagctttccatgctggattcagttgacttgaaagttagactttcaaaggcaactgaacttgtggacagacacctgcagtcgattcttgttgctgagaaaataacgcagaaggttgaggggcagttgtcgaagtcgcaaaaagaatttctactgcgccagcagatgagggctatcaaagaggaacttggtgataatgatgatgatgaagacgacgtggttgcactggaaaggaagatgcagaacgcaggaatgcctgctaatatttggaagcatgctcaaagggagttgaggcgcctacgaaagatgcaacctcagcaaccaggatacagtagctctcgagcttacttagaacttcttgccgaccttccttggcaaaaggtcagtgaagaaagggagctcgaccttagagctgcaaaagagagtcttgactgggatcattatgggctaacaaaagttaagcaacggattattgagtatctggctgttcgtaagcttaaacctgatgccaggggtccagtgctgtgttttgtggggccacctggtgttgggaagacatctttggctttctccattgcaaaggccctgaacaggaagttcataagaatctctcttggtggtgt

SEQ ID NO: 34733 - protein, 221 aa, Panicum virgatum
  misc_feature: Ceres CLONE 1957217
  misc_feature: SWISSPROT Homolog: EC 3.4.21.53 Endopeptidase La
LADIFVASFEISFEEQLSMLDSVDLKVRLSKATELVDRHLQSILVAEKITQKVEGQLSKSQKEFLLRQQMRAIKEELGDNDDDEDDVVALERKMQNAGMPANIWKHAQRELRRLRKMQPQQPGYSSSRAYLELLADLPWQKVSEERELDLRAAKESLDWDHYGLTKVKQRIIEYLAVRKLKPDARGPVLCFVGPPGVGKTSLAFSIAKALNRKFIRISLGG

SEQ ID NO: 34734 - DNA, 1142 bp, Panicum virgatum
  misc_feature: Ceres CLONE 1957223
  misc_feature: Encodes the peptide sequence at SEQ ID NO. 34735
gacgcgcccctccccgcccaaacattttccgccgccgcctccacgcgctcccaaaacatttccaccggccgcctcccgcctgcgcgccccttccctccagttccgagacccgcgtatttacctggcgccagagccccgcgccccaagtgctcaagctttcaagtctctcggcgccgcatctgcctctcgccctccgccggctccccccctgtccctctacggccgtagcagcccttcccgagggtggttccggagggagaggctctgtgatctcgtctctcgtggccggagaggatggagggcctgaggcggttcctgaacccgctggtgctcaacctgcagaagatggagctggagctcacctgccccgtctgtctgaagttgctcagcgcgcctacaatgctaccgtgctaccacacatcctgcagcaactgtgctgccacacggacttcgaacggttatagctgtgccatttgcaaatcggcatatcattgtcaagatttaaggccagcttctcaccttgaggcgatagtggggattcacaagagcctctgctctacagtcagcaccatgattcaggaacaggatgctcaagttcacattcctgttgcaaagacagcgtcccatggaacaccagaatcaggaaatagaagtggggtcgagaaatctgaccagatgaaatcgtacaaccctgtcgcttcaaagttaatatataaccaatcagctggacctgcgtttgggaacatggatggtgttcaaacaagagatcctgcatttgagaacaaaactgctgatgcagctgttgcaccaacagtccttgtacaaaaggggcattctgggtcacaatcttctgatggccctggggatttggattgtgatagcaatgatcttgaaggagaactgataacaagcaggtcacctcttcaaactgcactgaaaagagaggcaaatgtaatggatgaccataccagagaattgaagaagcaaaaatcaaatgatcaggttcaaagacaaacaaccatggccagtgcttggaaatgtgaattttgtcattcttcccaagtcgcagagtgtactggccctttgtcacattatctacgtggggagcccttaaaggctgaccaagcttggaaatcaaatgt

SEQ ID NO: 34735 - protein, 282 aa, Panicum virgatum
  misc_feature: Ceres CLONE 1957223
  misc_feature (24)..(61): Pfam Name: zf-C3HC4 Pfam Description: Zinc finger, C3HC4 type (RING finger)
MEGLRRFLNPLVLNLQKMELELTCPVCLKLLSAPTMLPCYHTSCSNCAATRTSNGYSCAICKSAYHCQDLRPASHLEAIVGIHKSLCSTVSTMIQEQDAQVHIPVAKTASHGTPESGNRSGVEKSDQMKSYNPVASKLIYNQSAGPAFGNMDGVQTRDPAFENKTADAAVAPTVLVQKGHSGSQSSDGPGDLDCDSNDLEGELITSRSPLQTALKREANVMDDHTRELKKQKSNDQVQRQTTMASAWKCEFCHSSQVAECTGPLSHYLRGEPLKADQAWKSN

SEQ ID NO: 34736 - DNA, 473 bp, Panicum virgatum
  misc_feature: Ceres CLONE 1957223-R
gccacttcatgccagcatacaagattaaccttgaaagatttgattgctgcagcaggggggtcgattttggagaagagcgagctttctagtacatccttgattctctacagcgtagagccgccacaagggaacaatctagacacccttaatgagatcatcaagaaaagagaagctgaggctgaagaattggcagccacagtcggctgcaaagcttttcctcatacatggctcctggattctattgcatcctgcacaatcctcagttgactgtgtgacactgtacttaggttcaaacataggaatgtagtttctgctttctttttcccttttaaaaagaggagattagaatgtgattcacatgctgtcttgttgatccaaagtatcttcagagttttgattttgatgttgtaacatgacatgagactgcaattgaattcgaataaagttgtgtacctcagtcatgttactgtcag

SEQ ID NO: 34737 - DNA, 549 bp, Panicum virgatum
  misc_feature: Ceres CLONE 1957236
  misc_feature: Encodes the peptide sequence at SEQ ID NO. 34738
gaacatatctgaagcagacagctatttcagtatccgccatggccatctttggagctcctgttcttgtagccctcgcagtggcttgtgcaggcctcctgtggttgagatcacggagctcctcgaaggagatgagggacatccccggcacgatgggctggcctgtcatcggcgagaccgtctccttcatctccgacttctcgagcccggccggcatcctgagcttcatgcgtgacaggcagaaaaggttcggcaaggtgttcaagacgtacgtgctggggaggatcacggtgttcatgacggggcgcgatgcggccaagatcctgctgtccgggaaggacggcgtggtgagcctgaacctgttctacacgggcaagcaggtgctgggcccgacgagcctgctgaccaccaacggcgaggagcacaataagctgctgcggctcatcggcgagccgctctccatcgacgcgctcaagaagcacttcgacttcatcaacgagctggccgtgcagacgctggacacgtggctcggaaagaaggtcctcgtgctca

SEQ ID NO: 34738 - protein, 170 aa, Panicum virgatum
  misc_feature: Ceres CLONE 1957236
  misc_feature: SWISSPROT Homolog: EC 1.14.13.93 (+)-abscisic acid 8'-hydroxylase
MAIFGAPVLVALAVACAGLLWLRSRSSSKEMRDIPGTMGWPVIGETVSFISDFSSPAGILSFMRDRQKRFGKVFKTYVLGRITVFMTGRDAAKILLSGKDGVVSLNLFYTGKQVLGPTSLLTTNGEEHNKLLRLIGEPLSIDALKKHFDFINELAVQTLDTWLGKKVLVL

SEQ ID NO: 34739 - DNA, 1926 bp, Panicum virgatum
  misc_feature: Ceres CLONE 1957244
  misc_feature: Encodes the peptide sequence at SEQ ID NO. 34740
gatttggccgcgcggtgtcccactaatcagccagccatcggtagtgaaaggttaactggattcagctcccaccacggcgccgccgccgccacctccatgccccacccggcggccgccgcagctccccatcggtggcgaccatcgcacgcgcagccgctctctcccccgccgctcggctgctcctccgccagcgcatggcttcctccgccgccgccttcgccgccgcccacctcgccctgccctccccctcctcgtcttcctccgacgactccgacgacgccgacgaagctaggatccttccgccctcgcccgcgctggagccggaggcagcctccccgcccccgcccccgcagccgccgcagccgcagcagcagccggcgcggcggtggctggacctggagcgcgactgcaacatggcaatgaaggcgctggcgcgcgcgggggacgtcgcgcaggtggccgacctcttcgccgagctcgcgcgctccgcctcggccgccggcgcggcgccgggcgtcctctgctacaacacgctcctcaacgcgctcgcggaggacggccgcgcggcggaggcccgcggggtgttcgacggaatgctcgcggccggagtggcgcccaccgcgtcgtccttcaacatcctcgtcaagctctacgcgtggcggaccgccgagttccacctcgcctacgacgagatccgcgggatgcggggccacggggtggcccccgacgtcggcacctactccacgctcgtcaccgggctgtgccgcgtggggaggctcgacgaggcgtggggcgtgctcgactggatgctgcaggaggggtgccgcccgatggtgcacacctacacgcccatcttgcagggttattgccgcgaaggccatattgaggaggctaggaagctcatggactttatggagggtgccggttgcccacccaattctgtcacttacaatattctgatcaaggcattgtgtgacgatggcagattcgatgaggtcgagcaggttttggttgagattaaaactaagggcctcaagcccagttcagtgacctataatacatatatggatgctctcagcaagaaaggcatgggtgagaaggcacttcagctggttgaggaaatgcaatgtgaaggtttgaaactcacagcttttactttgagcattgtcataaactgctgttgttggaactcgaagttttcacaagtcattcccttattagagaggagcacagagttagattggtgtgctgctgttgttgcatacaacactgtgatgagcagactatgtgacacaggcagatggttggctcttctggagctcttggcgtacatgatcaagaaagacatcatcccaaacacgcgtacgttcaacattttcattaatagtctttgcaccagggggaagctttccgtagtaaagaatctggttttcaatcatgggtttcctgcaaatgttgtgacatacaatacacttatccattggtcttactaccaagggaaggctagtgatgcagagaacatgtttgagtacatgacagaagtagccaatattgctccggatgaagtcacctataccataatggttgatggattttgccgacaaggagaatttgataaggctactgattgttttaaagaatctctcaagaatagactgtcaaaggatcttcttactgcccttttaaataggcttggtcacaaggaaagaatcttgaacatacttgatatattcgaggaaattgaaagacgaggttttgtccatgatcacatgatatttgagggtacaattagatcattttgtaggtttggttttcgtcagtatacaaagatgtttaatctggaatttcttcttgatggaatgttgggacctggaaaggaactataccctgcccataagggtcaaggaaagagataaatgatcacag

SEQ ID NO: 34740 - protein, 500 aa, Panicum virgatum
  misc_feature: Ceres CLONE 1957244
  misc_feature (177)..(211): Pfam Name: PPR Pfam Description: PPR repeat
  misc_feature (142)..(176): Pfam Name: PPR Pfam Description: PPR repeat
  misc_feature (212)..(246): Pfam Name: PPR Pfam Description: PPR repeat
  misc_feature (385)..(419): Pfam Name: PPR Pfam Description: PPR repeat
  misc_feature (107)..(141): Pfam Name: PPR Pfam Description: PPR repeat
  misc_feature (36)..(70): Pfam Name: PPR Pfam Description: PPR repeat
  misc_feature (282)..(316): Pfam Name: PPR Pfam Description: PPR repeat
MAMKALARAGDVAQVADLFAELARSASAAGAAPGVLCYNTLLNALAEDGRAAEARGVFDGMLAAGVAPTASSFNILVKLYAWRTAEFHLAYDEIRGMRGHGVAPDVGTYSTLVTGLCRVGRLDEAWGVLDWMLQEGCRPMVHTYTPILQGYCREGHIEEARKLMDFMEGAGCPPNSVTYNILIKALCDDGRFDEVEQVLVEIKTKGLKPSSVTYNTYMDALSKKGMGEKALQLVEEMQCEGLKLTAFTLSIVINCCCWNSKFSQVIPLLERSTELDWCAAVVAYNTVMSRLCDTGRWLALLELLAYMIKKDIIPNTRTFNIFINSLCTRGKLSVVKNLVFNHGFPANVVTYNTLIHWSYYQGKASDAENMFEYMTEVANIAPDEVTYTIMVDGFCRQGEFDKATDCFKESLKNRLSKDLLTALLNRLGHKERILNILDIFEEIERRGFVHDHMIFEGTIRSFCRFGFRQYTKMFNLEFLLDGMLGPGKELYPAHKGQGKR

SEQ ID NO: 34741 - DNA, 1218 bp, Panicum virgatum
  misc_feature: Ceres CLONE 1957275
  misc_feature: Encodes the peptide sequence at SEQ ID NO. 34742
atctcaactcgcacaaagctaagcaagcttgcattgtgatcgatcgatagagcagagtgagtgagagtgacagtgaggtagctaggattatacaggaagaacactgcaggatgtgtggcatccttgccgtgctgggatgcggcggcgaggcgccgcaggccaagcgtgctcgtgtgctggagctgtcccgtaggctcaagcaccggggccccgactggagcggcctccgccaggtgggcggcgactgctacctctcccaccagcgcctcgccatcatcgacccggcctccggcgaccagccgctctacaacgaggaccagtccgtcgtcgtcgccgtcaacggcgagatctacaaccacgagcacctcagggcccaactcgcagctgccggacacagcttcaggaccggcagcgactgcgaggtcatcgcgcacctctacgaggagcatggcgaaggcttcgtggacatgcttgacggcgtcttctccttcgtcctggtcgacaccccccacgacggcggccacagctctttcatggccggccgcgacgccatcggcgtgacgcccctctacatcgggtggggaatcgacggctccgtgtggatatcctccgagatgaaggccgtgcacgacgagtgcgagcacttcgacatcttccccccgggacacctctactcatcgtccagctccggcttcaggagatggtacaaccctccatggtacgacgaggccatcccctccgctccctacgacccggcggcgctccggcgagccttcgagacggccgtcaccaagaggctcatgaccgacgtccccttcggcgtcctcctctccggcggcctcgactcgtcccttgtggcggccgtcgcagtccgtcacctagcggggaccaaggcggccgccatgggctggggcaccaagctccactccttctgcgtggggctcgctggttcccccgacctcaaggccgccagggaggtagccgactaccttggcaccctccaccacgagttccacttcaccgtgcaggacggcatcgacgccattgaggacgtgatctaccacacggagacctacgacgtgaccaccatcagggccagcacgcccatgttcctcatgtcgcgcaagatcaagtcactgggcgtcaagatggtcatctccggcgagggctccgacgagatcttcggtggctacctctacttccacaaagcccccgaca

SEQ ID NO: 34742 - protein, 369 aa, Panicum virgatum
  misc_feature: Ceres CLONE 1957275
  misc_feature (217)..(369): Pfam Name: Asn_synthase Pfam Description: Asparagine synthase
  misc_feature (2)..(169): Pfam Name: GATase_2 Pfam Description: Glutamine amidotransferases class-II
  misc_feature: SWISSPROT Homolog: EC 6.3.5.4 Asparagine synthase (glutamine-hydrolyzing)
MCGILAVLGCGGEAPQAKRARVLELSRRLKHRGPDWSGLRQVGGDCYLSHQRLAIIDPASGDQPLYNEDQSVVVAVNGEIYNHEHLRAQLAAAGHSFRTGSDCEVIAHLYEEHGEGFVDMLDGVFSFVLVDTPHDGGHSSFMAGRDAIGVTPLYIGWGIDGSVWISSEMKAVHDECEHFDIFPPGHLYSSSSSGFRRWYNPPWYDEAIPSAPYDPAALRRAFETAVTKRLMTDVPFGVLLSGGLDSSLVAAVAVRHLAGTKAAAMGWGTKLHSFCVGLAGSPDLKAAREVADYLGTLHHEFHFTVQDGIDAIEDVIYHTETYDVTTIRASTPMFLMSRKIKSLGVKMVISGEGSDEIFGGYLYFHKAPD

SEQ ID NO: 34743 - DNA, 575 bp, Panicum virgatum
  misc_feature: Ceres CLONE 1957275-R
  misc_feature: Encodes the peptide sequence at SEQ ID NO. 34744
atcctgtacaggcagaaggagcagttcagcgatggtgttgggtacagttggatcgacggcttaaaggcacacgcggcatcaaatgtgactgataagatgctgtcgaacgccaagttcatcttcccccacaacaccccgacgacgaaagaggcctactactacaggatgatcttcgagaggctgttcccggagaagccggcgatcctgacggtgcccgggggccccagcgtggcgtgcagcacggccaaggctatcgagtgggacgcgcagtggtcggcgaatccggacccctccgggagggcggcgctgggtgtccatctctccgcttaccaatctgaatctggtggatctgagtccggcgagcagcatgtactcccggagaccatcgcggcaggagccaacaagcccaggaccatcaagcttgcaactacgacaccgcatggagtggccatagagggctagctatatgtcgtctactatacctagcttaatttgctgaaataatccggcgggatggacgtgttcgctttgttgtttgatgaatgaaatcagagaggcagagatgtacgcttctg

SEQ ID NO: 34744 - protein, 153 aa, Panicum virgatum
  misc_feature: Ceres CLONE 1957275-R
  misc_feature: SWISSPROT Homolog: EC 6.3.5.4 Asparagine synthase (glutamine-hydrolyzing)
ILYRQKEQFSDGVGYSWIDGLKAHAASNVTDKMLSNAKFIFPHNTPTTKEAYYYRMIFERLFPEKPAILTVPGGPSVACSTAKAIEWDAQWSANPDPSGRAALGVHLSAYQSESGGSESGEQHVLPETIAAGANKPRTIKLATTTPHGVAIEG

SEQ ID NO: 34745 - DNA, 538 bp, Panicum virgatum
  misc_feature: Ceres CLONE 1957293
  misc_feature: Encodes the peptide sequence at SEQ ID NO. 34746
agaaaagtcgcattccgttcgattcttcgttcctccccgacataactcgccgccgccgccggggagatctcgctccccttcccttcgctctcgttgtgaaggaagcaagcaaagagggaggcatgacgtggttccgcgccgcctcgggcgctgcccgcctcgccctccgccgcagcctcgccacccgcgccccgccagccgccgccaccacccgatgcggccgcggcttccactccaccgccctgcggcctcgctccgccgcccccgcgccccgcgccgtcccgctctcccgcctctccgacagcttcctcgacggcaccagcagcgtctacctcgaggagctccagcgcgcctgggaggccgacccctcctccgtcgacgagtcgtgggacaacttcttccgcaacttcgtcgcccaggcctccccctccgccggcgtctccggccagaccatccaggagagtatgcagctcctcctcctcgtcagggcctaccaggtcaacggccacatgatggccaagctcgaccccctcggcct

SEQ ID NO: 34746 - protein, 138 aa, Panicum virgatum
  misc_feature: Ceres CLONE 1957293
  misc_feature: SWISSPROT Homolog: EC 1.2.4.2 Oxoglutarate dehydrogenase (succinyl-transferring)
MTWFRAASGAARLALRRSLATRAPPAAATTRCGRGFHSTALRPRSAAPAPRAVPLSRLSDSFLDGTSSVYLEELQRAWEADPSSVDESWDNFFRNFVAQASPSAGVSGQTIQESMQLLLLVRAYQVNGHMMAKLDPLG

SEQ ID NO: 34747 - DNA, 138 bp, Panicum virgatum
  misc_feature: Ceres CLONE 1957293-R
aagacaccaagaacaaaggcagagcaccggcagcggcaacagccacaggcccccagccggggcaagcacaggagcagccagagccgggaaagaaggcacggcagccggagccgaacaagccccccggaggggaagcag

SEQ ID NO: 34748 - DNA, 1140 bp, Panicum virgatum
  misc_feature: Ceres CLONE 1957294
  misc_feature: Encodes the peptide sequence at SEQ ID NO. 34749
aattattaatttgatttttgtattcaattcttatttcaaatgcgagcatctgcacaacctcaaggcgccagcttccatcaaaacctgatgagaagccctgaacccactggctctgtccgccgcccctcctctatcgacagagctggccgttctgtcacctccaacaaccaactcgaacttccctatgtggacccacaagctaggttttcaatttcctatgtacccggaatgagtgagcatgtggttaacactggtaagacactacctgaagcccaattgaaagtcgttctattggcatgcgaagtcgaaagattgaacactttgaactacaacctcgtcaaggagaacgagatcctcaagacccagaacaggaagaccgatcgtgaagctgacttggagaccaagcttgccatcgtgctggctgaaaacgagaagctcaaccagatcgtcgaggaacttcattccgtttacgctcgtgaaagagagtctttgagcaacgaagactacgagagacgtatcaatgaacttcttcatgaagtggaggacttgaaggccaagtcaggtaccgccgtcgaacacggtcatgacgcccacctcagaaccattgaagacctccacagagaaagagaagccctcaaggaacaactcggcagacaaggcagagacctcgaagcccttagagccagacttaacgccatccaggtcggcccagctgatactaagcttcttcaagaacagatcaccaacttgaagatcgagaacgccaagtacaagagcgagctcgataccctacacttgaagtacggaaacgctgatgccttgcaacaaagattgaaccagtatgaatctaagctcagagttatcttggccgagaacgacaagctcaacaacttactcgttgagaagtccagagaactccacgagctccaaagagtcaaggaaacccctgttcaccacggcgagactgccaagagagctgcccttccaactgaaagccatcacaatgaattggctgagagacttcaaagagaaaaatgatgacttgaagagagctgctgctcaacatcacgattatgttcacagagttacttctgaagaacgagagacttaatggtttggtcgtcgaattgagaaacgaaa

SEQ ID NO: 34749 - protein, 269 aa, Panicum virgatum
  misc_feature: Ceres CLONE 1957294
  misc_feature: SWISSPROT Homolog: EC 2.7.11.1 Non-specific serine/threonine protein kinase
MSEHVVNTGKTLPEAQLKVVLLACEVERLNTLNYNLVKENEILKTQNRKTDREADLETKLAIVLAENEKLNQIVEELHSVYARERESLSNEDYERRINELLHEVEDLKAKSGTAVEHGHDAHLRTIEDLHREREALKEQLGRQGRDLEALRARLNAIQVGPADTKLLQEQITNLKIENAKYKSELDTLHLKYGNADALQQRLNQYESKLRVILAENDKLNNLLVEKSRELHELQRVKETPVHHGETAKRAALPTESHHNELAERLQREK

SEQ ID NO: 34750 - DNA, 566 bp, Panicum virgatum
  misc_feature: Ceres CLONE 1957295
  misc_feature: Encodes the peptide sequence at SEQ ID NO. 34751
gcagaaaaacaaaaaccctacacagcaggaacgacatcaaacttaaaatggctttcttcgtcgtgtgcatttcctcgcttctgatcatctctatctcttcctatgtgttccagctgctcgccgaccgccgccgccagcttcctcctggccccacaccgctcccattcatcggcaacctcctcgacgtcgcgagcgagctgccacaccgctccctggcacgcctcgccagacgccacggccccctcatgacggtccgtctaggcacgctagtcgccgtcgtcgcctcatctccgtccaccgcccgcgaggtcctccagacgcacaacggcagcctcaccggccgcagcccgccggacgcatggctcgccttgggccacgctgccaactccgtcttcgtcatcccgccgggccgcatgtggcgcgcgctgcgcaggatcgggacggagcacctgctctcagcgaggcagctcgacggcacgcggctgcggccggtgctgcgggacgccgtcctcgaccttgtccgccgcgtgtcggggatggcggtggcggggcggccccgtggaggt

SEQ ID NO: 34751 - protein, 172 aa, Panicum virgatum
  misc_feature: Ceres CLONE 1957295
  misc_feature: SWISSPROT Homolog: EC 1.14.13.21 Flavonoid 3'-monooxygenase
MAFFVVCISSLLIISISSYVFQLLADRRRQLPPGPTPLPFIGNLLDVASELPHRSLARLARRHGPLMTVRLGTLVAVVASSPSTAREVLQTHNGSLTGRSPPDAWLALGHAANSVFVIPPGRMWRALRRIGTEHLLSARQLDGTRLRPVLRDAVLDLVRRVSGMAVAGRPRG

SEQ ID NO: 34752 - DNA, 694 bp, Panicum virgatum
  misc_feature: Ceres CLONE 1957300
  misc_feature: Encodes the peptide sequence at SEQ ID NO. 34753
cttttcatctacatagtaatagttttgtctgatctagtttccgatctgatttttgaaactgtattgttagtgcctagtattttgattgtggagcactgatagtgttcttctggcctcctctagtatgttcatagtctgtgtgtgttcttctggcctcctctagtatgttcatagtctgtgtgtgttcttctggcctcctctagtatgttcattctgtgtctctacaatagatcattacttgtgtctgtgtctctacagtactttctggtacgccacttcatcaagtaattagtagttgttttgatgaatgatgatactgaccgtcgacttttattgtttgattactcgttctcccaatatatattgtttctaattgttgattcatctgtcgactctcatgcagcggttagtcttcacctgcagccatgggtaaggagaagtcccacatcaacatcgtagtcattggccacgtcgactctggcaagtcaaccaccaccggccacctgatctacaagcttggaggtatcgacaagcgtgtgatcgagaggttcgagaaggaggctgcggagatgaacaagaggtccttcaagtacgcgtgggtgcttgacaagctcaaggccgagcgtgagagaggtatcaccattgatatcgccctgtggaagtttgagaccaccaagtactactgcaccgtcat

SEQ ID NO: 34753 - protein, 89 aa, Panicum virgatum
  misc_feature: Ceres CLONE 1957300
  misc_feature (5)..(88): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTV

SEQ ID NO: 34754 - DNA, 1820 bp, Panicum virgatum
  misc_feature: Ceres CLONE 1957301
  misc_feature: Encodes the peptide sequence at SEQ ID NO. 34755
acataacagatgatcaaagcacttcttgtcctcgcttgcttggtcgtcgcttttgcatcaaaagacgagcgccatgttcttggtcatcgaaccaccaccaacttcccaacaaactgggttatggttgaaaaagctgatccaacatcacaggtcaccttcattgtcgctcttcaccaacaaaacgttgacctcctcgaacaaaccttctgggaagtttctgatccagatcacccaaactatcgtaacttcatgacgaccgctgaaatcactcaaatggttgctccaccaaagaaagttcaacaaaaagtcttagaatggttagtcaaacataatgttgtcactctcgaaaacagaggagattctatccttgctactgcttccgttcaagacgcagctaagctttttgatactgaatttcattcattcagaagagctgatggtaagaccttgatccgtcaaactggaaaattttccatcccaaagaaatatgctgaatacgtcgatatggttttcggactctctgagttcccatctccaaagaccgttcaaaaagtcactgcaccaaacaccgcagtcactgtctctcctcaaaccatccaacttatgtatggaaccaccacttcctacgttaaaggaaactcatctgcttgtgttattgaattcgaagagcagaactacgcaccaagtgatttggcccaattcgcaagtaactttaaagttaatattccggcattgactccaaaccacatcatcggacaaaacgatccaacctctcctcaaattgaagctactcttgatattcaatacatcttggctgttgctcaacaagctcaaggatggttctggttagaaggagactccgtctggttatacggatttgctactcacatggttgcaaccgcaaacgtccctcttgtcagctcaatctcttatggttggaatgaagaagaccaatgcgaaaacggaattggagctcaagaatgtaatgctcttggagttgactccaaaggatacgttcgacgtgttaacattgaattccaaaaactcggtcttcgtggacttactctcttctctgcatctggagattctggagctaatggaagaactgacccagattgttcagagactcaccttaacccaccttaccctgctgcttcaccattcatcacctctgttggagcaactcaaatcactgatgcatctggaaaagcaaacttaccaggaggaggaccacctggatgtcaaggacttaactgtgcttccggaggaactgaaaccgcagtctcctacaatcaagcaagattcgcatccggaggaggattctcatgggttgctgctactcctgcttaccaacaagctgctgttactgcttacctcaactctggagttaaattaccgcctgctggttactttaacccacaaggacatggatttccacatgtctccgcacttggatctcaagtcttgattcaaactggaggatctgttcaaccagtcggaggaacatctgcttcatcaccaatctttgctggagttgttactctcttgaacgactacgttaacactaagaccggaaagcctcttggattcatctcccctcttttattcaagatgcaagctgaaatgccatccgctttcactgatatcactgttggagataacatctgtactgaaaatggttgttccagctcctgtactggatttgtttgcgcaaagggatgggatccagtcactggattaggaactccagtctaccctaacatgcttaaatacgttcaaaaattcttcaacattaaagatgaataaacaaattttagccc

SEQ ID NO: 34755 - protein, 598 aa, Panicum virgatum
  misc_feature: Ceres CLONE 1957301
  misc_feature: SWISSPROT Homolog: EC 3.4.21.103 Physarolisin
MIKALLVLACLVVAFASKDERHVLGHRTTTNFPTNWVMVEKADPTSQVTFIVALHQQNVDLLEQTFWEVSDPDHPNYRNFMTTAEITQMVAPPKKVQQKVLEWLVKHNVVTLENRGDSILATASVQDAAKLFDTEFHSFRRADGKTLIRQTGKFSIPKKYAEYVDMVFGLSEFPSPKTVQKVTAPNTAVTVSPQTIQLMYGTTTSYVKGNSSACVIEFEEQNYAPSDLAQFASNFKVNIPALTPNHIIGQNDPTSPQIEATLDIQYILAVAQQAQGWFWLEGDSVWLYGFATHMVATANVPLVSSISYGWNEEDQCENGIGAQECNALGVDSKGYVRRVNIEFQKLGLRGLTLFSASGDSGANGRTDPDCSETHLNPPYPAASPFITSVGATQITDASGKANLPGGGPPGCQGLNCASGGTETAVSYNQARFASGGGFSWVAATPAYQQAAVTAYLNSGVKLPPAGYFNPQGHGFPHVSALGSQVLIQTGGSVQPVGGTSASSPIFAGVVTLLNDYVNTKTGKPLGFISPLLFKMQAEMPSAFTDITVGDNICTENGCSSSCTGFVCAKGWDPVTGLGTPVYPNMLKYVQKFFNIKDE

SEQ ID NO: 34756 - DNA, 603 bp, Panicum virgatum
  misc_feature: Ceres CLONE 1957314
  misc_feature: Encodes the peptide sequence at SEQ ID NO. 34757
atgttcttttgtgtattgtaactggtcgttactcttcacgactttatattgcttatgctcccctcgttgtgcttggcacacttctagcagcattggtacctgttgttggttttaatgcagtaatgacatcagagcactttgcatcatttctggtgtttataatcctccatgtggttgctctggtttattacataaaagggcttttaactcctcggctgttcaaagtggccatgacatttgttgtaacagttggtttggccgtttgttttgctgttgcagcaattctcattgcattggtggcatctagcccaacaaaaggttggagtggtcgcagtttgagtctacttgacccaacctatgcaagcaagtacatccctattattgctagtgtgagcgaacaccaaccaccaacctggccttcttattttatggatatcaatgtgctagccttcttaattcctgctgggatcatatcatgcttcttaccattatctgatgcaagctcatttttggtcttgtacttggtaacttcagtgtatttctctggagtaatggtccgacttatgctcgtccttgctcacgctgcatgcattttgtctggga

SEQ ID NO: 34757 - protein, 200 aa, Panicum virgatum
  misc_feature: Ceres CLONE 1957314
  misc_feature: SWISSPROT Homolog: EC 2.4.1.119 Dolichyl-diphosphooligosaccharide--protein glycotransferase
  misc_feature: Functional homolog of the protein sequence given in SEQ ID NO 51470
  misc_feature: Useful for making plants with altered carbohydrate content
VLLCIVTGRYSSRLYIAYAPLVVLGTLLAALVPVVGFNAVMTSEHFASFLVFIILHVVALVYYIKGLLTPRLFKVAMTFVVTVGLAVCFAVAAILIALVASSPTKGWSGRSLSLLDPTYASKYIPIIASVSEHQPPTWPSYFMDINVLAFLIPAGIISCFLPLSDASSFLVLYLVTSVYFSGVMVRLMLVLAHAACILSG

SEQ ID NO: 34758 - DNA, 1043 bp, Panicum virgatum
  misc_feature: Ceres CLONE 1957315
  misc_feature: Encodes the peptide sequence at SEQ ID NO. 34759
tcttcagttcttcagagttgtccttcgcgcgcgcatggccatgagccacctgctcgtcctcgtcctcgtccttgctcttctctcagcgttggctccccgatcctccgccgccagcgggagcacgctgacgcagtccggggccctcgccggggaccagacgctggcatcgcccggcgacgccttccggctgggcctcttccccgccagcaaccgctccaggtggtttcttggcatctggttcaccgtctcgccggacactgtcgtctgggtcgccaaccgcgaccgcgcgctgaccaccccttccggcgtgctcgaggtcagcgaccagggagccctcgtcctccgcgacggcgcgagcaacaacgacaccgtctggtcgtcgtccgccgtgctgtggcagagcttcgagcacccgaccaacacgttcctcccggagatgccggtcgggcggagcctccggaccggcgccgagtggtccttctcgtcgtggcgcggcgccgacgacccgtccccgggcggcttccgctacgtcatggccgccgcgcgcggcggcggcgcggcgccggagctccacgtctggagcggcggccgcaagacttaccggacggggccctggaacggcgtgcggttcagcggcatcccggagatgaccaccttcgagaacatgtccgagttccggttcacggacaccgccgacgaggtctcctacatgttccgcaaccgcgacggctcgccgctgtcgcgggtgctcctcaccgagtccggcgtgatgcagcgcatggtctgggacggcgccgccgggtcctggagtaatttctggtcgggcccgcgcgaccagtgcgacaactacggcaggtgcggcgccttcggcgtctgcgacgtcgccgacgccgtggtctgcgactgcatcgccgggttcgcgccgaggtcgccggcggagtggtacatgcggaacacgtccggcgggtgcgcccggaggacgccgctccagtgcggcggcggcgacgggttcggcgtcctgcgcggcgtgaagctgccggaca

SEQ ID NO: 34759 - protein, 336 aa, Panicum virgatum
  misc_feature: Ceres CLONE 1957315
  misc_feature (177)..(303): Pfam Name: S_locus_glycop Pfam Description: S-locus glycoprotein family
  misc_feature (73)..(159): Pfam Name: B_lectin Pfam Description: D-mannose binding lectin
MAMSHLLVLVLVLALLSALAPRSSAASGSTLTQSGALAGDQTLASPGDAFRLGLFPASNRSRWFLGIWFTVSPDTVVWVANRDRALTTPSGVLEVSDQGALVLRDGASNNDTVWSSSAVLWQSFEHPTNTFLPEMPVGRSLRTGAEWSFSSWRGADDPSPGGFRYVMAAARGGGAAPELHVWSGGRKTYRTGPWNGVRFSGIPEMTTFENMSEFRFTDTADEVSYMFRNRDGSPLSRVLLTESGVMQRMVWDGAAGSWSNFWSGPRDQCDNYGRCGAFGVCDVADAVVCDCIAGFAPRSPAEWYMRNTSGGCARRTPLQCGGGDGFGVLRGVKLPD

SEQ ID NO: 34760 - DNA, 327 bp, Panicum virgatum
  misc_feature: Ceres CLONE 1957315-R
  misc_feature (173)..(173): n is a, c, t, g, unknown, or other
  misc_feature (175)..(175): n is a, c, t, g, unknown, or other
  misc_feature (234)..(234): n is a, c, t, g, unknown, or other
cacgggagaagagggaaggaggccggagccgcgaccccgccgacccggcgacccgcggcggcagcacgagcggcgagcaggggcaggcggcggcgcgcgcccaggaggcgccgccccgcgcgcaggagggcccgagccagcggccgccgagggcggacgccacccccaagcgncngcagcagaaggcgccggcgcggccgcagcggcccgaggggggcacgccgacgaggagcnacccgggcgccgccgccgccgcccccgccgcgcaagcagagcccaccggcggcaacgagcggaccgccacgagccccgaaggccgaaaggggg

SEQ ID NO: 34761 - DNA, 649 bp, Panicum virgatum
  misc_feature: Ceres CLONE 1957327
  misc_feature: Encodes the peptide sequence at SEQ ID NO. 34762
  misc_feature (548)..(548): n is a, c, t, g, unknown, or other
atattccaagccgagcagagcacgattctcgctgtcgacaatttgaatggagctaaagttcttgggaggatcataagggttgaccatgtgagcaagtacaagaagaaggaggaggaagatgaggaggagcggcagcagaagagagaggcccgtggagtctgctacgcgttccagaaaggcgagtgcaatcgcggagcttcctgcagatattcgcatgatgagcagagaaatgcaaacactggttggggttctaaagaggatagcggtgcacgatgggagcatgacaaactccatgatgtaccaaagagtcgtggcatctgctatgctttccagaaaggcgagtgcaaccgtggagcatcctgcaaattttcccatgatgagcagaaaaattcaaatactcgtcggagttctagggatgatgaatcatccagatcagagcggtatgtagagcgagattctagaagtaggcatgatgatagaagaccagaagatcgggacatatacaggcatgacaagtcacctgaaagatcaagaggtgagaggcatangaacgatgacaggtattctcaaggaagagaagaaagatcagaaagacgcagatacgatgatatggatcgcaagcggtcaaggtacgatgaaaatagtgaaa

SEQ ID NO: 34762 - protein, 216 aa, Panicum virgatum
  misc_feature: Ceres CLONE 1957327
  misc_feature (102)..(127): Pfam Name: zf-CCCH Pfam Description: Zinc finger C-x8-C-x5-C-x3-H type (and similar)
  misc_feature (49)..(74): Pfam Name: zf-CCCH Pfam Description: Zinc finger C-x8-C-x5-C-x3-H type (and similar)
  misc_feature (183)..(183): Xaa is any aa, unknown, or other
IFQAEQSTILAVDNLNGAKVLGRIIRVDHVSKYKKKEEEDEEERQQKREARGVCYAFQKGECNRGASCRYSHDEQRNANTGWGSKEDSGARWEHDKLHDVPKSRGICYAFQKGECNRGASCKFSHDEQKNSNTRRSSRDDESSRSERYVERDSRSRHDDRRPEDRDIYRHDKSPERSRGERHXNDDRYSQGREERSERRRYDDMDRKRSRYDENSE

SEQ ID NO: 34763 - DNA, 1238 bp, Panicum virgatum
  misc_feature: Ceres CLONE 1957357
  misc_feature: Encodes the peptide sequence at SEQ ID NO. 34764
aaattatcaaaatctttaaattttttgcaatcaagagcaaatgagttacatgcttcaacccagtatcctccttcttagagaaggaactgatacctctcaaggtagagctcagattatcagtaacatcaatgcctgccaagctgtcgttgagattgtgaagagcactctcggacctagaggtatggataagctcatcactggaggcggtggcgttaccatcagtaacgatggcgccactattgtcaagttattggacatcattcaccccgctgccaagactttggttgatatctcaatttctcaagacaacgaagtcggtgacggaactacttctgttattttgttggccggtgaactcatgagagaaagcaaaaactttatcgacgaaggaatggctcctcaagtgatcatcaagggtttgaaggaaggcttgagaattgctcttgctaagttgaacgaaatggctattagcattgaagataagactgatgctgaaagaagagatattttgaagaagtgcgctggtacctctcttaactccaagcttctcgccagttacaaggaattcttctctgagctggccgtcggagccgtcgaaaagctcgacaaaaacctcctcgataaggatttgatcggtatcaagttggtcaccggtggttctattaccgactctttcttgatcgacggtgttgccttcaagaagaccttctcttatgctggttttgaacaacaacccaagaagttcaccaaccccaagatcgttcttttgaatatcgaacttgaaaagaagagcgaaaaagaaaacgccgaaatcagaattgaaaagcccgaagactaccaagctttggttgatgccgaatgggacattatctacaagaagctcgatcaattggttaaggtcggtgccaacatcgtcctctccaagctccccattggtgatttggccactcaatatttcgctgatagaaatatcttttgtgctggtcgtgttccccaagaagatttgcaaagattggttaaagctactggtgctcaagtccaaactaccgttaacggaatcactcctgatgttttgggtacttgtggggaattcgaagaagtccaagttggtgctgagagattcaacatctttaaagactgccctgaaagcaagactgccactcttgtcatcagaggaggtgctgaacaattcgttcaagaagccgaaagatctcttaatgatgctattatgatcgcca

SEQ ID NO: 34764 - protein, 399 aa, Panicum virgatum
  misc_feature: Ceres CLONE 1957357
  misc_feature (35)..(399): Pfam Name: Cpn60_TCP1 Pfam Description: TCP-1/cpn60 chaperonin family
  misc_feature: SWISSPROT Homolog: EC 2.7.1.68 1-phosphatidylinositol-4-phosphate 5-kinase
MSYMLQPSILLLREGTDTSQGRAQIISNINACQAVVEIVKSTLGPRGMDKLITGGGGVTISNDGATIVKLLDIIHPAAKTLVDISISQDNEVGDGTTSVILLAGELMRESKNFIDEGMAPQVIIKGLKEGLRIALAKLNEMAISIEDKTDAERRDILKKCAGTSLNSKLLASYKEFFSELAVGAVEKLDKNLLDKDLIGIKLVTGGSITDSFLIDGVAFKKTFSYAGFEQQPKKFTNPKIVLLNIELEKKSEKENAEIRIEKPEDYQALVDAEWDIIYKKLDQLVKVGANIVLSKLPIGDLATQYFADRNIFCAGRVPQEDLQRLVKATGAQVQTTVNGITPDVLGTCGEFEEVQVGAERFNIFKDCPESKTATLVIRGGAEQFVQEAERSLNDAIMIA

SEQ ID NO: 34765 - DNA, 562 bp, Panicum virgatum
  misc_feature: Ceres CLONE 1957357-R
agtggaaagcaacaactcgttgttaacgcttttgccaaggctcttgaagtcattcccagaactattgccgataatgctggtttggatgctattgctgttttgaataaactcagacaaaagcacgcccatgaaggaaaatggttcggtgttgatattaactctgctaatggatttttggatgcttatgaaagtttcatttgggaacctctcatcattaaaatcaatggtttaagtgctgctactgaagctgcatgcacaattttatcaattgatgaaactgttagaaatcccaagtctgaagaagctcaaagaatgaagaaggctggaggtatgccaagaaaggctggtggtatgcccggtatgcctggaatgcccggaatgcccaatttgcccggtatgagacttaaataatagggagtgttgattgaattaaataatactttatctttacatatatatgttgttattgttgtaactcagtctcaatgtgattaacaaatatatatatacctcaaaacatttttatatcttggtcgtaaaaaaaactccatttaaaaattcc

SEQ ID NO: 34766 - DNA, 638 bp, Panicum virgatum
  misc_feature: Ceres CLONE 1957360
  misc_feature: Encodes the peptide sequence at SEQ ID NO. 34767
aacctcggaatctcccctctaccccgggacaggggcaccctatatagaccccgccgcccggcccccgatccgcacccaccgccttcacccgtgccccccaccatcccgggggcgccggtcgtcggcgggctcatcaagttcatgcgcgggcccatccccatgatccgggaggagtacgcccgcctcggcagcgtcttcaccgtccccatcctcagccgccggatcaccttcctcatcgggcccgaggtctccgcgcacttcttcaagggcaacgaggccgagatgagccagcaggaggtgtacaggttcaacgtgcccacctttgggccgggggtcgtcttcgacgtcgactactccgtcaggcaggagcagttccggttcttcaccgaggccctgcgtgccagcaagctccgcagctatgtcgaccagatggttgctgaggctgaggagtacttctcaaagtggggagaaagtggtaccgtgaatttgaagtatgagttggagcaccttatcatactgacagctagtcgatgcttgctgggaagggaggtgcgagagaagctctttgatgatgtatctgctctcttccatgaccttgacaatgggatgcagcccgttagtgtcatcttcccctacct

SEQ ID NO: 34767 - protein, 212 aa, Panicum virgatum
  misc_feature: Ceres CLONE 1957360
  misc_feature: SWISSPROT Homolog: EC 1.14.13.70 Sterol 14-demethylase
NLGISPLPRDRGTLYRPRRPAPDPHPPPSPVPPTIPGAPVVGGLIKFMRGPIPMIREEYARLGSVFTVPILSRRITFLIGPEVSAHFFKGNEAEMSQQEVYRFNVPTFGPGVVFDVDYSVRQEQFRFFTEALRASKLRSYVDQMVAEAEEYFSKWGESGTVNLKYELEHLIILTASRCLLGREVREKLFDDVSALFHDLDNGMQPVSVIFPY

SEQ ID NO: 34768 - DNA, 617 bp, Panicum virgatum
  misc_feature: Ceres CLONE 1957365
  misc_feature: Encodes the peptide sequence at SEQ ID NO. 34769
ctcctccccttggtccccccgagttgttcttggtaggcaagggaaaaacaagaacaaaaggtttccttggggatggcgaactccgggttctcgtggaccctgccggacccccccaagctccccaaggggaagcccggggccctcctcctgctggacggatggggcgaagcccacccccaccaataccattgcctccctgtccctcaaacccccctcatggattccctcaagaatggtgctccaaaaaggtggaaactcctgaaggctcctggaactgctgtgggtctcccctctgaagatgatatgggcaacagtgaagttggcccccatgctcttggaactggtcccattttccccccaggcgctaaactcgtggacccagctcttgcctccggaaaaatttatgaaggtgatgggttccactacctcaaagaatcttttgaaaatggtacccttccccttattgggttggtgagtgatggtggcgtccactcccctcttgacccactgccgctacttctgaaaggtgccagtgagaagggaacaaaaagaatccgtgtacacctccttaccgatgggcgtgatgttttggatggcagcagtgttggttttgtaga

SEQ ID NO: 34769 - protein, 181 aa, Panicum virgatum
  misc_feature: Ceres CLONE 1957365
  misc_feature (18)..(181): Pfam Name: iPGM_N Pfam Description: BPG-independent PGAM N-terminus (iPGM_N)
  misc_feature: SWISSPROT Homolog: EC 5.4.2.1 Phosphoglycerate mutase
MANSGFSWTLPDPPKLPKGKPGALLLLDGWGEAHPHQYHCLPVPQTPLMDSLKNGAPKRWKLLKAPGTAVGLPSEDDMGNSEVGPHALGTGPIFPPGAKLVDPALASGKIYEGDGFHYLKESFENGTLPLIGLVSDGGVHSPLDPLPLLLKGASEKGTKRIRVHLLTDGRDVLDGSSVGFV

SEQ ID NO: 34770 - DNA, 516 bp, Panicum virgatum
  misc_feature: Ceres CLONE 1957377
  misc_feature: Encodes the peptide sequence at SEQ ID NO. 34771
tccatccacgaggaatcccccagcgcgcgcgcgggcaccaagccaccaccaaccatggcggccgcctcgctcaagctggcctcccccaaacccctcgcccccgcgccgctcctccgcgggcgcggcgcgggggaggggcgtccggggcgcggcgcgccggggcgcggttggcgcccgggtcgcggggcggcccggcgccggggcgggcgccgcgggcatcggcgcggtcggcaaggggctggatgcgctgatcggcgggagcgagggggatgaggatgacacagaggggacgctgcggcggcggagtgtaagcaagagctaggttcagtgagggttccttctggtcctcctcagggccaagggcgagacctaccaagagatagtggggctggcgaaggcgatgctgagctgctgcgtccgggtcgacgggctggacgacgccgtagacattgtcgggactggcggcgacggcgctgacaccgtcaacatctccaccggttccaccatcctcgccgc

SEQ ID NO: 34771 - protein, 38 aa, Panicum virgatum
  misc_feature: Ceres CLONE 1957377
  misc_feature: SWISSPROT Homolog: EC 2.4.2.18 Anthranilate phosphoribosyltransferase
MLSCCVRVDGLDDAVDIVGTGGDGADTVNISTGSTILA

SEQ ID NO: 34772 - DNA, 660 bp, Panicum virgatum
  misc_feature: Ceres CLONE 1957378
  misc_feature: Encodes the peptide sequence at SEQ ID NO. 34773
aaggagcagattccttcctccccccccccccccccccattcccctcctcgtcgaaaccctagccccgcctagccgccggcggtggtggccgcctgtccaactcccagcccgctgtacacactctccccgccgcgcgctccctcccggagccgtcgcgccctaccgatcgatcggcctcgcccgaccgccgccggatcccgatcggccggccgccatgtcgaaggccagggtctacaccgacgtcaacgtgctgcgccccaaggattactgggactacgaggcgctcaccgtccaatggggtgagcaggatgactatgaagttgtcaggaaagttggtagaggaaagtacagcgaagtctttgagggcatcaatgttaacaacaatgagaaatgcatcatcaagatcctgaagcctgtgaagaaaaagaagatcaaaagagaaattaaaatccttcagaatctttgtggaggccctaatattgtgaagctgcttgatattgttagggatcagcactcaaaaactcccagcttgatctttgaatatgtcaacaacacagatttcaaagtgctttacccaacattgacagattatgacattcgctattacatctatgagttactcaaggcattagattactgccattcacaaggtatcatgca

SEQ ID NO: 34773 - protein, 148 aa, Panicum virgatum
  misc_feature: Ceres CLONE 1957378
  misc_feature (34)..(148): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 1 in US patent 7038110
  misc_feature: Functional homolog of the protein sequence given in SEQ ID NO 50314
  misc_feature: Useful for making plants with modulated flowering time
MSKARVYTDVNVLRPKDYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIM

SEQ ID NO: 34774 - DNA, 659 bp, Panicum virgatum
  misc_feature: Ceres CLONE 1957399
  misc_feature: Encodes the peptide sequence at SEQ ID NO. 34775
atcccctttccaggccgtggcggtggttggctcggtgtcctcgtctcctctcgtcttccccgtcattttgcaaatcaacgaacccaaaagaacagggagagggagcgagctcggacctcggaggccacccgcgacgagatgccggggctcagggcgccgtccgactacgcggacgagccgccgcgccgccctgccctcacgatcaactccaaggagccgtttaatgctgaccctcaccggccggcactatgcacatcttaaattaccccggtggatttcttctaccagaggaatcatggacccattccaaaagtcgaggacctctcaagatacagtgtttaaatttcgggtcttggcaactggcctattcgactatccatggctgacatttgggctcttccaaagtacaatgtcactgcaactttacagtgtgctggacacaggacaactgcaatgagtaaggtacggactgtgagaggtgttggttgggacatatctgctcttggaaatgcaacttggggaggagcaaaactatctgatgtccttgagttagctggaatacccaaactcagttcggttacgtctttaggagggaactatgttgagtttgttagtgtagacaagtggaaagaggaaaaaggtggtccttatactgcatc

SEQ ID NO: 34775 - protein, 93 aa, Panicum virgatum
  misc_feature: Ceres CLONE 1957399
  misc_feature (1)..(93): Pfam Name: Oxidored_molyb Pfam Description: Oxidoreductase molybdopterin binding domain
  misc_feature: SWISSPROT Homolog: EC 1.8.3.1 Sulfite oxidase
MADIWALPKYNVTATLQCAGHRTTAMSKVRTVRGVGWDISALGNATWGGAKLSDVLELAGIPKLSSVTSLGGNYVEFVSVDKWKEEKGGPYTA

SEQ ID NO: 34776 - DNA, 651 bp, Panicum virgatum
  misc_feature: Ceres CLONE 1957402
  misc_feature: Encodes the peptide sequence at SEQ ID NO. 34777
ccaaataaccagagagcgatcagctgccgtgtgtgcagtgcgttcttcttgctcctccgactccgatcctctcgtcgcctagcactagcagcatatcaaaccctttcttctcaaaatcatttcgttcttgagtccgttatagttgcctgccgtcttcttcaattcgagtgcaacaagaaaccggaagcttttgtttctttctgcacaatttagcaggctagggttagggcttttttttccttgaacttgtacgtgttgtgtctgagaccgatcggttgatcgatctgagtagtatggaagggtcagcagcagcaggaggaggaggaggaggaggagttgcagggggagggtcgaagaaggaggagagcttgccgccggggttcaggttccacccgacagacgaggagctcatcacgtactacctgcggcagaagatcgccgacggcagcttcacggcgagggccatcgccgaggtcgacctcaacaagtgcgagccgtgggatctcccggaaaaggcaaagctcggtgaaaaagagtggtatttcttcagcctaagggacagaaagtacccaaccggtgtgcgaacaaatcgcgcaactaatgctggttactggaagacaacaggcaaggataaagaaatctacaccgggg

SEQ ID NO: 34777 - protein, 119 aa, Panicum virgatum
  misc_feature: Ceres CLONE 1957402
  misc_feature (26)..(119): Pfam Name: NAM Pfam Description: No apical meristem (NAM) protein
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 476 in the 10/666,642 US patent application
  misc_feature: Functional homolog of the protein sequence given in SEQ ID NO 50640
  misc_feature: Useful for making plants with altered lignin content
  misc_feature: Functional homolog of the protein sequence given in SEQ ID NO 50639
  misc_feature: Useful for making plants with altered terpenoid content
  misc_feature: Functional homolog of the protein sequence given in SEQ ID NO 50327
  misc_feature: Useful for making plants with modulated light quality sensitivity
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: Functional homolog of the protein sequence given in SEQ ID NO 51291
  misc_feature: Useful for making plants with altered cell wall content and/or composition
  misc_feature: The sequence is a functional homolog of SEQ ID NO 854 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 612 in the 11/435,388 US patent application
  misc_feature: Functional homolog of the protein sequence given in SEQ ID NO 50322
  misc_feature: Useful for making plants with modulated oxidative stress sensitivity
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: Functional homolog of the protein sequence given in SEQ ID NO 50641
  misc_feature: Useful for making plants with altered carbohydrate content
  misc_feature: The sequence is a functional homolog of SEQ ID NO 853 in the 10/374,780 US patent application
  misc_feature: Functional homolog of the protein sequence given in SEQ ID NO 50845
  misc_feature: Useful for making plants with altered alkaloid content
  misc_feature: Functional homolog of the protein sequence given in SEQ ID NO 51018
  misc_feature: Useful for biocontainment applications
  misc_feature: The sequence is a functional homolog of SEQ ID NO 851 in the 10/374,780 US patent application
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 1729 in the 11/479,226 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Functional homolog of the protein sequence given in SEQ ID NO 50906
  misc_feature: Useful for making plants with modulated water use efficiency
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Functional homolog of the protein sequence given in SEQ ID NO 50326
  misc_feature: Useful for making plants with modulated light quality response
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Functional homolog of the protein sequence given in SEQ ID NO 50908
  misc_feature: Useful for making plants with modulated biomass
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 890 in the 10/374,780 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 1012 in the 11/435,388 US patent application
  misc_feature: The sequence is a functional homolog of SEQ ID NO 854 in the 11/435,388 US patent application
  misc_feature: The sequence is a functional homolog of SEQ ID NO 891 in the 10/374,780 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 108 in the 10/666,642 US patent application
  misc_feature: The sequence is a functional homolog of SEQ ID NO 332 in the 10/412,699 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 1452 in the 10/666,642 US patent application
  misc_feature: The sequence is a functional homolog of SEQ ID NO 158 in the 10/225,066 US patent application
  misc_feature: The sequence is a functional homolog of SEQ ID NO 226 in the 10/666,642 US patent application
  misc_feature: The sequence is a functional homolog of SEQ ID NO 242 in the 10/714,887 US patent application
  misc_feature: The sequence is a functional homolog of SEQ ID NO 242 in the 11/435,388 US patent application
  misc_feature: The sequence is a functional homolog of SEQ ID NO 280 in the 10/374,780 US patent application
  misc_feature: The sequence is a functional homolog of SEQ ID NO 68 in the 10/225,068 US patent application
  misc_feature: The sequence is a functional homolog of SEQ ID NO 886 in the 10/412,699 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: Functional homolog of the protein sequence given in SEQ ID NO 50328
  misc_feature: Useful for making plants with modulated nitrogen use efficiency
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
  misc_feature: The sequence is a functional homolog of SEQ ID NO 344 in the 10/666,642 US patent application
  misc_feature: The sequence is a functional homolog of SEQ ID NO 582 in the 10/666,642 US patent application
  misc_feature: The sequence is a functional homolog of SEQ ID NO 852 in the 10/374,780 US patent application
  misc_feature: The sequence is a functional homolog of SEQ ID NO 240 in the 10/225,068 US patent application
  misc_feature: The sequence is a functional homolog of SEQ ID NO 368 in the 10/374,780 US patent application
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
MEGSAAAGGGGGGGVAGGGSKKEESLPPGFRFHPTDEELITYYLRQKIADGSFTARAIAEVDLNKCEPWDLPEKAKLGEKEWYFFSLRDRKYPTGVRTNRATNAGYWKTTGKDKEIYTG

SEQ ID NO: 34778 - DNA, 541 bp, Panicum virgatum
  misc_feature: Ceres CLONE 1957402-R
acctggccgagctcgcgcgcttcgcccgcggcacgccggggctgcacccgcacatccagccgcaccccgggacggcggcggcgtacatcaaccccgccgccgtggcgccgccgttcacgctctccggaggcctcagcctcaacatcggcgcctccccggccatgccgtccccgccgctccacgggatgtcgatggcgatgagccaccagcagatcgggccgagcggtgccggcaccgcgggtaaccatcatcaggtgatggcaagtgatcaccagcagcagatggcgccggcggggctcggcgggtgcgtgatcgggcccggggcggacgcagggttcggcgcggacgcggccggggcgcggtaccagagcttggacgtggagcagctggtggagaggtactggcctgccggctaccaggtgtagtagctgctgtatcacagtggcttttgactgcctgcaatggcaagcaaaattgttggtctttatcatgcatgtaggaagacaagatttgaggtaatctagtgatccttcgtcgttgt

SEQ ID NO: 34779 - DNA, 1187 bp, Panicum virgatum
  misc_feature: Ceres CLONE 1957418
  misc_feature: Encodes the peptide sequence at SEQ ID NO. 34780
acctccagccctcccacctccattgccgccgccgctcctctcggccgagctcgacggcggtcggcggtactcctctcccatcccgcccccagcctccctttctccgcagggcgccagcatcacctccgcgaccacccgaacagcgcagcgcgtgcctgctgggcgttcgtggttcacccctcctcctcgtatctgtttctctcccccgttcccttctctctcagtctgcctcctgtcttggtcttcctttcctggcggcgacgactaggcgagcagcggcgccatttggtcttcgcagggccttttgtgttccgtccaactgagcggtcatgcgccaaccaaggtccgggccggggaagaggcggggccgcggtccgcggatacccgcgacgacgcttcggaagcagcacgcctcgttggcgaacgtcgaccagatcacgggcgccaagattcccaagagcttcgttttctcccgcggcaagctcccctccacgctccgccacctccagcaggacctccgcaaggtcatgctcccctacactgctctcaatctcaaggagaaaaagaggaataacctcaaggacttcgtcaatgttgccggtcctttgggagtgacacatttcttgatcctctcgaacccgaagagccttccacacttgcgcttttccaaatcgccacagggcccaaccttcactttccagatagaggagtacgcactcgcagcagacattgcaaactcccagaagcggccaaggtgcccaccagggatattccagaactcaccactggtcgtactgagtgggttttcaggtcttggcaacccttttgagagtttggttgaatacttccagcacatggtccccgctgttgacccgagcactgtcaaactggcagcatgtcaaaggattctgttgttaaaatatgataaagagaaggaggttattgatttccggcattactccatcaagctccagcctgttggggtcagtcgcaggattagaaagctcatgcagaacaatcaagtacctgatctaagagaccttaaagatgttagtgattatgtgacaaaagctggatatggatcagaaagtgaagcagatgatgaaacagcaacagtaagcttaccgaatgacattgacaaattaaaccaggcatcaaggaaaagcgctgtcagactccaggagatc

SEQ ID NO: 34780 - protein, 285 aa, Panicum virgatum
  misc_feature: Ceres CLONE 1957418
  misc_feature (45)..(285): Pfam Name: Brix Pfam Description: Brix domain
  misc_feature: Functional homolog of the protein sequence given in SEQ ID NO 50739
  misc_feature: Useful for making plants with modulated biomass
MRQPRSGPGKRRGRGPRIPATTLRKQHASLANVDQITGAKIPKSFVFSRGKLPSTLRHLQQDLRKVMLPYTALNLKEKKRNNLKDFVNVAGPLGVTHFLILSNPKSLPHLRFSKSPQGPTFTFQIEEYALAADIANSQKRPRCPPGIFQNSPLVVLSGFSGLGNPFESLVEYFQHMVPAVDPSTVKLAACQRILLLKYDKEKEVIDFRHYSIKLQPVGVSRRIRKLMQNNQVPDLRDLKDVSDYVTKAGYGSESEADDETATVSLPNDIDKLNQASRKSAVRLQE

SEQ ID NO: 34781 - DNA, 614 bp, Panicum virgatum
  misc_feature: Ceres CLONE 1957418-R
gttgaggctgggctatgttcaggagatgtcttatacccttggcctgtggcaaagggatctgtgggaaagaaagggaaagaaactgaggaagagatagaaggacaagaagaaactgaggatgagctggaggatgggtcagaggacgagatggaggaatagcactttagatgacctaatcgaaacactgctcaattcaggcatctgcctacaaggatagtcaacagtgtgaagtcaccgctctattttaacaacactaaggagagcaccccagatgaaaacgaatgtggtgaatgcagaagcaggtgtggtgacagtcctggatgtttcatgctgtcaaacgggctctgtgtgttgtagcatgattcattcataccagttttgtgactcggtgcaggcactatctgcaggcttgcaacaaagttgaacattatcctgcggatagttgcagtttatagagatttttgagttttgttgggaattccaaatttccagttgtatcggtatgttctcccacaaggcctgggcacgctggtagtcggattgacgtgatgggaagcaatgttctttcttacctcctgttttattcgtaaagtgtatgtatatccttccctgct

SEQ ID NO: 34782 - DNA, 1244 bp, Panicum virgatum
  misc_feature: Ceres CLONE 1957442
  misc_feature: Encodes the peptide sequence at SEQ ID NO. 34783
cagctcttgcgatcctcaagggccagcccacagcacgcgaccccaagctagccaggaatcgcttcccacccagtccggccaggccaccaccgctctgctctctccctgtcggcaaatccgccctccctccctcccgcccgctcgcaagctcgcaatccccctccctccaaagggatcgattcgccaaatcagttgcgcttcttgctgagcagccggtgagagcaaatgctggtccgggagggagcggcggtcgtcgtcggcgggcacgcgggaggattcccttgccccctggcggtctgccgaggtagtgggcgtccgagctggagcacctgagatgttgctcgctcgcctggcctgatctcggccgaaagctcccgggttttttgttctcggagagggagggggcggcgccgcttttggtctctctgattattgcttcctccgccgattcgattcctcgcgggggctcctctcctccaccggtgggtgggtggatcctttacctccgtgtccgggcattcgtgctccgctccttgggcctgtaagttgtctgccgaatcccaaatcttcagaggttctggtggtgatttctgcaaggggggcgagtgagcagtgggagatcaaatcttggcgatggtgtcgagatcctactccaacctcctggagctcgcctccgggggcggcggcggcggcggcggggagccgctgccgtcgctggggcgccgccgggtgccgcgcgtcgtcacggcgtccggcattgtgccgggcctcgacgcctccgacgacgacgacgacgccgcgtccgcggcctccgaccactcctctcacgcgccgcgggagcgcgtcatcatcgtcgccaaccagctccccgtgcgcgccgcgctgcgcccgggcgccggcgccggcggcggcgccgggtgggacttcgagtgggacgaggacagcctcctgctgcaggtcagggacagcctccgcgcgcaccacggccgcggggacgtcgacttcgtctacgtcggcggcctccgcgacgacgtgccccccgccgaccacgaccacgtcgcgcacctcctcctcgagggcttccgctgcgtgccaaccttcctgcccgccgacctccgctccaggttctaccacggcttctgcaagcagcagctctggccactgttccattacatgctgccgctgtcgccggagctcggcggccgcttcgaccgcctgctctggcaggcctacgtctccgtcaa

SEQ ID NO: 34783 - protein, 203 aa, Panicum virgatum
  misc_feature: Ceres CLONE 1957442
  misc_feature: SWISSPROT Homolog: EC 2.4.1.15 Alpha,alpha-trehalose-phosphate synthase (UDP-forming)
  misc_feature: Functional homolog of the protein sequence given in SEQ ID NO 50801
  misc_feature: Useful for making plants with altered carbohydrate content
MVSRSYSNLLELASGGGGGGGGEPLPSLGRRRVPRVVTASGIVPGLDASDDDDDAASAASDHSSHAPRERVIIVANQLPVRAALRPGAGAGGGAGWDFEWDEDSLLLQVRDSLRAHHGRGDVDFVYVGGLRDDVPPADHDHVAHLLLEGFRCVPTFLPADLRSRFYHGFCKQQLWPLFHYMLPLSPELGGRFDRLLWQAYVSV

SEQ ID NO: 34784 - DNA, 644 bp, Panicum virgatum
  misc_feature: Ceres CLONE 1957442-R
  misc_feature: Encodes the peptide sequence at SEQ ID NO. 34785
gagactgcaattgtttggagctatgaggatgctgatccagatttcggctcttgccaggccaaggagctccacgaccatctggagagtgtcctctcaaacgagcccgtctcggtgaaagctggcctgaaccatgtcgaggtgaagccacagggcgtgagcaagggcctggtggcgaagcggatcctatcgacgatgcaggagcgcggcgacctgccggacttcatcctgtgcgtaggcgacgaccggtccgacgaggacatgttcgaggtgatcaccgcggcggtggcgcggggccccgcctccctgcacccggaggcggaggtgttcgcgtgcacggtggggcgcaagcccagcaaggccaagtactacctggacgaccccgcggacatcgtgcgcctcgtccagggcctcgccaacgtctccgacgaccaggcctcgttgcacggcagcagcagcggcgccaccctgcccgatgacgaagcggccaccgccaccatccggaggtgaaaccgcacctgcccgcccgtgcgcaggtcagctcaagtaggcggcggtatgctcgcttggtcccagatgtacattgttctaggaacgaatgaactcgcgcaagtgcgtgctgtgcttgcgtgtgcgctgctttgtcg

SEQ ID NO: 34785 - protein, 168 aa, Panicum virgatum
  misc_feature: Ceres CLONE 1957442-R
  misc_feature (1)..(128): Pfam Name: Trehalose_PPase Pfam Description: Trehalose-phosphatase
  misc_feature: SWISSPROT Homolog: EC 3.1.3.12 Trehalose-phosphatase
  misc_feature: Functional homolog of the protein sequence given in SEQ ID NO 50801
  misc_feature: Useful for making plants with altered carbohydrate content
ETAIVWSYEDADPDFGSCQAKELHDHLESVLSNEPVSVKAGLNHVEVKPQGVSKGLVAKRILSTMQERGDLPDFILCVGDDRSDEDMFEVITAAVARGPASLHPEAEVFACTVGRKPSKAKYYLDDPADIVRLVQGLANVSDDQASLHGSSSGATLPDDEAATATIRR

SEQ ID NO: 34786 - DNA, 665 bp, Panicum virgatum
  misc_feature: Ceres CLONE 1957445
  misc_feature: Encodes the peptide sequence at SEQ ID NO. 34787
gggcaagtgttcttcggaatgactgggcgtaaagggcatccttttgctcaattttctctgcccaagtcccaatccttcccaatccggcgccccctcccgccatttcactccccgctccgcagcccgaaacaacacccccccccccccccccaaatccactcccaaaccctaaccctaccggcgcccccgtcggaccgacgatgccgaaggccggtggcggcgcggcggacgaggaggagttccgcgccgaggtggaggagcgcctcatcaacgaggagtacaagatctggaaaaagaacacacccttcctgtacgacctcgtcatcacgcacgcgctcgaatggccttccctcaccgtgcagtggctccccgaccgcaccgagccggcggggaaggaccactccgtccagaagatgatcctcgggacgcacacctccgacaacgagccaaactacctcatgctcgcgcaggtccagctgcccctcgatgacgccgaggccgacgcgcgccactacgacgacgaccacgccgacatcggtgggtttggcgccgcatcaggcaaggtgcaaatagttcagcaaataaatcatgatggagaagtcaatccagctcgttatatgccccaaaattcatttataattgctaccaagacagttagcgcagaa

SEQ ID NO: 34787 - protein, 154 aa, Panicum virgatum
  misc_feature: Ceres CLONE 1957445
  misc_feature: SWISSPROT Homolog: EC 2.3.1.48 Histone acetyltransferase
MPKAGGGAADEEEFRAEVEERLINEEYKIWKKNTPFLYDLVITHALEWPSLTVQWLPDRTEPAGKDHSVQKMILGTHTSDNEPNYLMLAQVQLPLDDAEADARHYDDDHADIGGFGAASGKVQIVQQINHDGEVNPARYMPQNSFIIATKTVSA

SEQ ID NO: 34788 - DNA, 1058 bp, Panicum virgatum
  misc_feature: Ceres CLONE 1957447
  misc_feature: Encodes the peptide sequence at SEQ ID NO. 34789
cccattccacgctgcttcggcgcccggcaccaacctccccccccccccccccctccccacttcgccggcggcgggtggagtcgggttggagcagccgccttttaccagatactacccaaactatccatccggcgaccatggggcacggcgtcagctgcgcccgcaccggtgacgagcacgactacttccgcgcggtgcagctcggggacctcgacgccctggccgcgctcctcgccgccgacacctccctcgctcgccgcgccaccctctacaaccgcctctccgcgctccacatcgccgccgccaatggacgcctcgaggtgctgtccatgatcttggatcacggggtgccgccggacgtggtgaatcggcacaagcagactccgctgatgctcgcggcgatgcacggcaagattgactgcgtgctcaggctcctccaggccgacgccaatatcttgatgttcgattctgtgcacgggcggagctgtctgcaccacgctgcctacttcggccatgtggactgcctgcaggccatcctctcggcggcgcagacgacgccggtggccgactcatggggtttcgcccggttcgtcaacgtcagggacgaccacggcgccacgccgttgcatctcgcggccaggcaggggcggccagggtgcgtgcagatgttgctggagaaaggcgccattgtatccgctttgacaggctcatacgggttccctggtagcacatcgttgcatctggctgctcgcagtgggaacctggattgcatccggaaactgcttgcctggggagcagatcgtctccaaagggactcggcagggagaattccctatgctgttgcactgaagcgcaactacgaagcatgtgcggctttgctaaacccttcatcagctgagcccatggtgtggccttccccacttaagttcatcagcgagctcgatccggaagcaaaggctctcctggaagcagccctgatggaagccaacagggagagggagaagaagatcttgaagggcacaaagtactctctgccatcgccttcgcattgcgacgcc

SEQ ID NO: 34789 - protein, 306 aa, Panicum virgatum
  misc_feature: Ceres CLONE 1957447
  misc_feature (158)..(190): Pfam Name: Ank Pfam Description: Ankyrin repeat
  misc_feature (195)..(227): Pfam Name: Ank Pfam Description: Ankyrin repeat
  misc_feature (46)..(78): Pfam Name: Ank Pfam Description: Ankyrin repeat
  misc_feature (79)..(111): Pfam Name: Ank Pfam Description: Ankyrin repeat
  misc_feature: SWISSPROT Homolog: EC 2.1.1.43 Histone-lysine N-methyltransferase
MGHGVSCARTGDEHDYFRAVQLGDLDALAALLAADTSLARRATLYNRLSALHIAAANGRLEVLSMILDHGVPPDVVNRHKQTPLMLAAMHGKIDCVLRLLQADANILMFDSVHGRSCLHHAAYFGHVDCLQAILSAAQTTPVADSWGFARFVNVRDDHGATPLHLAARQGRPGCVQMLLEKGAIVSALTGSYGFPGSTSLHLAARSGNLDCIRKLLAWGADRLQRDSAGRIPYAVALKRNYEACAALLNPSSAEPMVWPSPLKFISELDPEAKALLEAALMEANREREKKILKGTKYSLPSPSHCD

SEQ ID NO: 34790 - DNA, 587 bp, Panicum virgatum
  misc_feature: Ceres CLONE 1957450
  misc_feature: Encodes the peptide sequence at SEQ ID NO. 34791
aattgcaaacccgcgcttgccttgccgccgtcgagccgcccgccggccttcaccctcgtcaccggcgaaacccccggcggtggtgttaccagcagacagcagtatagtgtgcggtttcagttcgggaggcggagatggggaagaagcagcacagcaaggaccgtatgttcatcacgcggacggagtgggcgaccgaatggggcggcgccaagcagaaggaggtcgccgcgccgttcaagcgcctccccttctactgctgcgcactcacgtttcttccatttgaggatccagtgtgcactgttgatggaagcgtcttcgatttaatgagcataatcccataccttaaaaagtttggtaaacatccagtaaccggagcaccgctcaagcaggaagatctgattcctctcacgttccacaagaactcagatggagagttccagtgtcccgttctgaacaaagtttttaccgaattcactcacattgttgctgtaaaaactactggaaatgtcttctgttatgaggcagtccaagaacttaacatcaaacctaagaattggagagagttgctaactgatgagcccttcact

SEQ ID NO: 34791 - protein, 150 aa, Panicum virgatum
  misc_feature: Ceres CLONE 1957450
  misc_feature: SWISSPROT Homolog: EC 5.2.1.8 Peptidylprolyl isomerase
MGKKQHSKDRMFITRTEWATEWGGAKQKEVAAPFKRLPFYCCALTFLPFEDPVCTVDGSVFDLMSIIPYLKKFGKHPVTGAPLKQEDLIPLTFHKNSDGEFQCPVLNKVFTEFTHIVAVKTTGNVFCYEAVQELNIKPKNWRELLTDEPF

SEQ ID NO: 34792 - DNA, 624 bp, Panicum virgatum
  misc_feature: Ceres CLONE 1957474
  misc_feature: Encodes the peptide sequence at SEQ ID NO. 34793
ggtttgcgagggggttgctccggtccggcgggaggggggagatggcggcggagcgggctcaggggacggtgaagtggttcaacgggaccaaggggttcggcttcatcagccccgacgacggcggccaggacctcttcgtccaccactcctccgtcaaggccgacggcttccccaacctcaaggacggtgacgccgtcgagttcaccgtcgacgccgacatagccgaagcaccagcgcttgagcgtagttcaggagcgaggattggagtgatgtccgctgaggaggctgccgctgccgcgaccgaggtccccgagaccgaggtcgagtccgaggccccggccgccgaggaggcggaggccaagcccgccaaggccaagaaggcgccgaaggagaagaaggcgcccaaggagaagaaggcccccaaggagaagaaggagaagaagcccgccgcggcgaggaagacggccgcccacccgccgtacgccgagatgatctcggaggcgatcgcggcgctcaaggagaggaccgggtcgagctcggtggccatcggcaagtacgtggaggagaagcacggcgcgaagctgccgcccaacttccgcaagctgctggccgggcagctcaaga

SEQ ID NO: 34793 - protein, 194 aa, Panicum virgatum
  misc_feature: Ceres CLONE 1957474
  misc_feature (5)..(69): Pfam Name: CSD Pfam Description: 'Cold-shock' DNA-binding domain
  misc_feature (143)..(194): Pfam Name: Linker_histone Pfam Description: linker histone H1 and H5 family
MAAERAQGTVKWFNGTKGFGFISPDDGGQDLFVHHSSVKADGFPNLKDGDAVEFTVDADIAEAPALERSSGARIGVMSAEEAAAAATEVPETEVESEAPAAEEAEAKPAKAKKAPKEKKAPKEKKAPKEKKEKKPAAARKTAAHPPYAEMISEAIAALKERTGSSSVAIGKYVEEKHGAKLPPNFRKLLAGQLK

SEQ ID NO: 34794 - DNA, 644 bp, Panicum virgatum
  misc_feature: Ceres CLONE 1957477
  misc_feature: Encodes the peptide sequence at SEQ ID NO. 34795
tcccctcccgttccccaattcgaaatcgagtcgggcgtgcgtgcgtgcgcgagcgattcgcccgcacaactcccccccccccccccgctcctcaccccaccccgccgccgccagctcgccccctagggttccgccgcgatgtctctccggccgagcgagcgggagcagatgcggaagggcaactacaagcagtcggtggacgcggacgagagccgccgccgccgcgagaatcagatggtggacatccgcaaggccaagcgcgaggagagcctccagaagaggcgccacgtcgggttccccgcctccgtcgccggcgccgcgccggcgggacactcctcggcgctccagcagaagctcgagggcttgccggcgttggtgcaggcggtgctctccaacgaccccaacgtgcagctggaggccaccacgcagttcaggaagctgctctccatcgagcgtagtcctccaattgaagaggttatcagcacaggagtggtgcctcggtttattgagttcctcacacgtgaggaccatccccaactccagtttgaggctgcttgggcgctcaccaacattgcatctggcacatcagagaataccagagtggtggttgagagtggtgctgtgcccatctttgtcaagctcct

SEQ ID NO: 34795 - protein, 168 aa, Panicum virgatum
  misc_feature: Ceres CLONE 1957477
  misc_feature (4)..(97): Pfam Name: IBB Pfam Description: Importin beta binding domain
  misc_feature (106)..(147): Pfam Name: Arm Pfam Description: Armadillo/beta-catenin-like repeat
MSLRPSEREQMRKGNYKQSVDADESRRRRENQMVDIRKAKREESLQKRRHVGFPASVAGAAPAGHSSALQQKLEGLPALVQAVLSNDPNVQLEATTQFRKLLSIERSPPIEEVISTGVVPRFIEFLTREDHPQLQFEAAWALTNIASGTSENTRVVVESGAVPIFVKL

SEQ ID NO: 34796 - DNA, 996 bp, Panicum virgatum
  misc_feature: Ceres CLONE 1957494
  misc_feature: Encodes the peptide sequence at SEQ ID NO. 34797
atttcctcctccgtcccggcctgaacacgacgcctcgccgccttgccttcccacccggccatccggcgagccaccggcgccgcgccacccacctcccaaccccacctccagaaggagcgcccaggctccttccgccggactcggcgcttgagccccgacggaagcggcctgacccgcccaccgccccggtaaaaccctactgcttccactgacccgtctgaggccaccgacgtcggctccgatggcgtccttcccgccgccgcacgcgcttcctccagccccaacagcaccctaccccgcaactctaccgcctctgcaccagcagcagccggggcccgctccggcgggggcggcgacgttgctggtgcggcacctcccggaggcgatcacgcaggagatgctctcccgcctcttctcccactacggggccacgtccgtgcgcccttgtgccggtggaaagctgaggaattgtgcatttgtagattttagggacgaggccgcggccaatcacgcacattcgttactgaacaggttgaggttcctcgggaaagtgttaatagttgagagagcaaatcagccaaacacaaataatgcacatgttaagcctcaggaccaattagtgcatggggtgtcccaggtaccaagtattggttcccagaatcagaataatccttcatcaactgctgaaccaattgctccaaagcttggtgtggattattcatttcctccgcaccttgagtatgcatatccaccaccagatggaaacatattgacaaatattgtcaatgccctcattgccgtccctcgattctacacacaggtgttgcacttaatgaacaagatgaaccttccagctccatttcggatggcgttgcctactccaccgctaccatcacaagtgcctgctccccctcatcctctgccaccaccgcaaccagaagaacctcgcacagcagatttgtctagtgatgagtctgagttggaatcctccgatga

SEQ ID NO: 34797 - protein, 251 aa, Panicum virgatum
  misc_feature: Ceres CLONE 1957494
  misc_feature (40)..(107): Pfam Name: RRM_1 Pfam Description: RNA recognition motif. (a.k.a. RRM, RBD, or RNP domain)
MASFPPPHALPPAPTAPYPATLPPLHQQQPGPAPAGAATLLVRHLPEAITQEMLSRLFSHYGATSVRPCAGGKLRNCAFVDFRDEAAANHAHSLLNRLRFLGKVLIVERANQPNTNNAHVKPQDQLVHGVSQVPSIGSQNQNNPSSTAEPIAPKLGVDYSFPPHLEYAYPPPDGNILTNIVNALIAVPRFYTQVLHLMNKMNLPAPFRMALPTPPLPSQVPAPPHPLPPPQPEEPRTADLSSDESELESSD

SEQ ID NO: 34798 - DNA, 518 bp, Panicum virgatum
  misc_feature: Ceres CLONE 1957494-R
  misc_feature: Encodes the peptide sequence at SEQ ID NO. 34799
tgttcaagaattacactccaggaaatcctgccgctgttttgtacattaagaacttggcaaaggatgtcactcatgatgacttcttctatgtctttgggtctcttttcgaaagtatggacagtgtaagatcgggtctaagtatcaagttaatgcaggagggacggatgcgtggtcaagcctttgtgacatttcctactgttgaactcgctcaagaagctctgaatctagctcatggctacgtgttcaaaggaaaaccaatgatcatacaatttggtagaaatcctactgctaataaagcttcatagggcagtttgtgtttttctctcctgattttgacagttttcagaagttggtacgaactggaaagtgtgaatcagaggctgtaggtatctgttgttggttggattggttgattgattccacccatagtgtaatggataattgcttgctagatgtttggtgaagaacacggagattcagttttccgaccattgaaatttttttcttttggatattac

SEQ ID NO: 34799 - protein, 100 aa, Panicum virgatum
  misc_feature: Ceres CLONE 1957494-R
  misc_feature (13)..(88): Pfam Name: RRM_1 Pfam Description: RNA recognition motif. (a.k.a. RRM, RBD, or RNP domain)
FKNYTPGNPAAVLYIKNLAKDVTHDDFFYVFGSLFESMDSVRSGLSIKLMQEGRMRGQAFVTFPTVELAQEALNLAHGYVFKGKPMIIQFGRNPTANKAS

SEQ ID NO: 34800 - DNA, 1160 bp, Panicum virgatum
  misc_feature: Ceres CLONE 1957507
  misc_feature: Encodes the peptide sequence at SEQ ID NO. 34801
agaacaagccggcagcgggagcggacgggcctaagcctaagcgggcgcagccgccggtggccgtagcaataaactatccccgcccccaccggctctcggcatcgccactacgctagcttcgtcaacacagcgaccgccccacctccgagttctaccgccgttcccggccaaatcggaggagcttccagtccacgaatccacggctccttcccggaggcaatcttgcgccgattggctgtcccgccgagtcctgcgttcttgcgggttggggggtcagatcaatctggcctcttcttgatcggattccagtggtcggcgcccccagctcgcgatctttcctgccggtttcgttatccgctagtcaacttggccggccggttttggtctctgactccgagggctgttcggcttcgtgctgccaccgtcgctttagttcgtcagtctccgccaagatttcggcgatcttccaatcaaggcccgcccaagatttgattgaagctttaccagttcttggattcgtttcttgggggcaagaagccggttcttgtgtcgtctctggtgctgcaagtatgttctgtggcacaccgggtctctagtaaagagttcgtctgttgttagtttagggacttccagcctcgttcctggaaagttgctctcggcccctgcggcgatggcttctagcaccagcgagatgcccgaggcaaaggcgaagctgaagaggtccgggagtatgggaagcaatgatacatatgtgcgagctgacaagattgatcttacgagccttgacatccagcttgagaagcaactcaccaagacctggggtaaggccagcctcaagtcccaggggcccaaggaggagtgggagattgatcttgcaaagctggagatccgctatgtcatcgcgcaggggacttatggcaccgtgtatcgtggcacctatgacggtcaggatgttgcagtgaagcttttggattggggagaggatggttttgctacagaagctgaaactgccactttgcgaacatcatttaagcaggaggttgctgtttggcataagctcagccatcctaatgtgacaaagtttgttggtgcatctatggggaccacagatcttaagattccctgcaacaaattcaacggtgatgcacgcactaacttgc

SEQ ID NO: 34801 - protein, 163 aa, Panicum virgatum
  misc_feature: Ceres CLONE 1957507
  misc_feature: SWISSPROT Homolog: EC 2.7.11.1 Non-specific serine/threonine protein kinase
MASSTSEMPEAKAKLKRSGSMGSNDTYVRADKIDLTSLDIQLEKQLTKTWGKASLKSQGPKEEWEIDLAKLEIRYVIAQGTYGTVYRGTYDGQDVAVKLLDWGEDGFATEAETATLRTSFKQEVAVWHKLSHPNVTKFVGASMGTTDLKIPCNKFNGDARTNL

SEQ ID NO: 34802 - DNA, 703 bp, Panicum virgatum
  misc_feature: Ceres CLONE 1957507-R
  misc_feature: Encodes the peptide sequence at SEQ ID NO. 34803
gctcgtgtcgaggctcagaatccaaaagacatgactggtgcgacaggcacacttggttatatgcccccagaggtacttgatggtaaaccatacaacaggaagtgtgatgtttacagttttggcatttgcctgtgggaaatctattgctgtgacatgccgtatccagaccttagttttgccgatgtctcatctgctgttgtccatcagaatttgcgcccagacattcctcgctgctgtccaagcgcatttgctaatgttatgcggaaatgctgggatgcaaaccctgataaacgccctgatatggatgaggtggtacagcttttagaggctcttgacacgagcaagggtggtggcatgataccagatggtcaatcatctggatgcttatgcttcaccaaggctcgtggtccatagttcttttcatgataccttcttccctcagctacattttgcccatgtaaatgaatggggcatgacatgcttcctgttgccacctgcttagtcggtgctgtcagacgttcatggtagtggtgccacctttatgcgtcgactacaggcctaaagctctctcgtatgacctttggggtcaaatgctttttttctatacaagcggtatgatgtaattgtgattctaaagagatttcagggtatacggagttacactcttgaaaatgctaccttcccgtgtccattttggatccac

SEQ ID NO: 34803 - protein, 137 aa, Panicum virgatum
  misc_feature: Ceres CLONE 1957507-R
  misc_feature (1)..(108): Pfam Name: Pkinase_Tyr Pfam Description: Protein tyrosine kinase
  misc_feature: SWISSPROT Homolog: EC 2.7.11.1 Non-specific serine/threonine protein kinase
ARVEAQNPKDMTGATGTLGYMPPEVLDGKPYNRKCDVYSFGICLWEIYCCDMPYPDLSFADVSSAVVHQNLRPDIPRCCPSAFANVMRKCWDANPDKRPDMDEVVQLLEALDTSKGGGMIPDGQSSGCLCFTKARGP

SEQ ID NO: 34804 - DNA, 1728 bp, Panicum virgatum
  misc_feature: Ceres CLONE 1957532
  misc_feature: Encodes the peptide sequence at SEQ ID NO. 34805
agcccgagtcccgacacctcctcagtccgcacatgaagcgcctcgctcgctgagaaaggagcaggcggcgaccagcagcgcttctcgccggcggccttcccggcagtgcgctccccgcgactcctagactaccgctgctgcccgccgtcagccatctctgacgccttcccagcaattctgcccgcccctaccgcctccgcccccgcgcctctcgagtctcagacgtcgacgatggagggctgcctcctcgacaagtccctgaacccaaacaagctcctcaaggagcaatttgtgagcaacctgacggggtcctccatgtcagagatcgcggtgctctccaccatcgtgccggcattggtggttctcaggaagtggagcagcagagataatactaggagggatgcagcgaagaaaaatgatgataaagttcttcctgttcgtaaagattggatgcagtacgtctctacactggttgtagattatctcactgttgtattgccagttcttttggttttcacagtcttagctgaatgggcttatacatgtgctatttctctcataatcctgatatctgtctacatcatgtttaaaaggtctcagtctcatcttaaagctggactcagccaatcgccttcactcagagcagatatatcttcttaccgagtgtcagtggttctggtgacatgtttgtgcatactagctgtggacttcaaaatctttccaagatgctatgccaaggttgaaacatatggtagtggcatcatggatcttggagtaggatcttttctagtggctaatgcactggtatctagacaagcacgaaacataacctcaatgagtttcaggtcagcactgagttccataagtccactggtatttcttgggtttgctcgcattatctcaacattgggtgttgattatcaggttcatgtaggagaatatggtgttcattggaacttctttttcacccttgctgctgtttctatccttacatccattgtcaggattcatccaaaacattgtggcctagttggtctgcttatccttgcaggataccagatttggctatcttctggattgaatgagtacctcatttctgataaaagaagtgctgatataatcagccagaataaggaaggcgtttatagcatacttggatactggggtatgtttctaattggtgtttctctgggttactatctattcgttgacactaaatcaaaaggcaagagcaggaacactcaagtggtaaaagtctgggttcttgctgcatctttttggattttggcaatcatccttgatagctatattgagagagtttctcggagaatgtgcaacttcgcttatgttatgcttgttttcggtcagaattttcaggttttatctatcctcacattagcagggttcatttcatatgaaaagaacttgattcttgaagatgcattcaatcaaaatatgcttggttcattccttctggcaaatatcctaactggtctggtaaatctctcagttgacacactctttgcctcttcgctcactgccttcatgattctgtcagtatacacctttactttatgcgtggttactggccttgcccatttttttggtgttagaatgaaattctggtgaattgtaatataatctagcatttgaatggtatatgtattcattaactttcctgcaagctagtcgctcgcttgaaataaaaccaaatatttttatgagaag

SEQ ID NO: 34805 - protein, 465 aa, Panicum virgatum
  misc_feature: Ceres CLONE 1957532
  misc_feature (299)..(424): Pfam Name: GWT1 Pfam Description: GWT1
MEGCLLDKSLNPNKLLKEQFVSNLTGSSMSEIAVLSTIVPALVVLRKWSSRDNTRRDAAKKNDDKVLPVRKDWMQYVSTLVVDYLTVVLPVLLVFTVLAEWAYTCAISLIILISVYIMFKRSQSHLKAGLSQSPSLRADISSYRVSVVLVTCLCILAVDFKIFPRCYAKVETYGSGIMDLGVGSFLVANALVSRQARNITSMSFRSALSSISPLVFLGFARIISTLGVDYQVHVGEYGVHWNFFFTLAAVSILTSIVRIHPKHCGLVGLLILAGYQIWLSSGLNEYLISDKRSADIISQNKEGVYSILGYWGMFLIGVSLGYYLFVDTKSKGKSRNTQVVKVWVLAASFWILAIILDSYIERVSRRMCNFAYVMLVFGQNFQVLSILTLAGFISYEKNLILEDAFNQNMLGSFLLANILTGLVNLSVDTLFASSLTAFMILSVYTFTLCVVTGLAHFFGVRMKFW

SEQ ID NO: 34806 - DNA, 564 bp, Panicum virgatum
  misc_feature: Ceres CLONE 1957550
  misc_feature: Encodes the peptide sequence at SEQ ID NO. 34807
gcgtctccgtatataagaacccagatttcgaattcctcctcccctctcccaccgacgtcgacgccgctgttccagcagatcccaagggagtcttcctcctcctccgatccgtccccgtcccgatcctcgctggggatggccaccttcgagctgtaccggaggtccaccatcggcacctgcctcactgagacgcttgacgagctagtgtccagcggggccgtcagccccgagctcgccattcaagtccttgtgcagtttgacaagtccatgactgacgcgctggagagtcaggtcaagagcaaggttaacatcaaggtagcagatacagtatgcccttcctatttattgatataacaattcagcctccccactttgaatactacgtatgttgttgttactgctaaagagaaatcataggtctagagttttgaaggggatgctgaggttccttttggttaaaaagccaatatagctgtaacatatacaccacttctgttagttattagccatgtcaaataaaaatgttcttgcgaaacaaatagctgcttttcttcttctatgttt

SEQ ID NO: 34807 - protein, 72 aa, Panicum virgatum
  misc_feature: Ceres CLONE 1957550
  misc_feature (2)..(50): Pfam Name: TFIIA_gamma_N Pfam Description: Transcription initiation factor IIA, gamma subunit, helical domain
  misc_feature: Functional homolog of the protein sequence given in SEQ ID NO 50596
  misc_feature: Useful for making plants with altered lignin content
  misc_feature: Useful for making plants with altered terpenoid content
MATFELYRRSTIGTCLTETLDELVSSGAVSPELAIQVLVQFDKSMTDALESQVKSKVNIKVADTVCPSYLLI

SEQ ID NO: 34808 - DNA, 582 bp, Panicum virgatum
  misc_feature: Ceres CLONE 1957552
  misc_feature: Encodes the peptide sequence at SEQ ID NO. 34809
ttaacatccaccagatattaaacatgccacccaaaaaggaagccgcccctgaaaagaagccccttctcggtcgtcccggtaacaccctcaagatgggtatcgttggtctccccaatgtcggaaaatcctccactttcaacctcctctccaaacttaatgtcgccgctgaaaacttccctttctgtactattgatcccaatattgctaaggtcagcgtccccgataccagattcgacaagctttgcgatatcttcaagcccaaatctcaagttcctgctgtcttgaacattatctatattgccggtttggtccctggtgctcacgaaggtgctggtttgggaaatgctttcctttcccacattcgaggtgtcgatggtatattccaagttctcagagccttcgaaagtgaagaaatcactcacactgaaggtgatgtcaaccccatcagagatctcgaaattatcagcaacgaattggttcaaaaggatcttcaacaatgcaaaaagagaatcgatgagctttccgccaagatcaagagattcaacgataaggacgccaaggaagaaaccgatctcctcatta

SEQ ID NO: 34809 - protein, 186 aa, Panicum virgatum
  misc_feature: Ceres CLONE 1957552
  misc_feature (22)..(164): Pfam Name: MMR_HSR1 Pfam Description: GTPase of unknown function
MPPKKEAAPEKKPLLGRPGNTLKMGIVGLPNVGKSSTFNLLSKLNVAAENFPFCTIDPNIAKVSVPDTRFDKLCDIFKPKSQVPAVLNIIYIAGLVPGAHEGAGLGNAFLSHIRGVDGIFQVLRAFESEEITHTEGDVNPIRDLEIISNELVQKDLQQCKKRIDELSAKIKRFNDKDAKEETDLLI

SEQ ID NO: 34810 - DNA, 583 bp, Panicum virgatum
  misc_feature: Ceres CLONE 1957566
  misc_feature: Encodes the peptide sequence at SEQ ID NO. 34811
aggcgcaaccccaagccgacgcttccgaactcacccacctcccccgcgcctttcggttcaagcaactccaccgcccggagcaatggggagcacggggcgcgaggcggaggtggcccgcgccgacttccccgacggcttcgtcttcggcgtcgctacctccgcgtaccagattgagggagcaagaagggagggaggcaaaggagacaacatatgggatgtcttcacagaagacaaagaacgtgtcttagatagaagcaatggagatattgcagtagatcattatcatcgatacagggaagacatcgagctcatggcaagtttaggttttcgcgcttacagattttctatatcttgggctcgtatatttcctgatggcatgggggggaaggtcaatgagcaaggagttgccttctataacaaccttatcaactttatgattgcaaaaggagttgagccttatgcaactctgtatcactgggatcttccaaacaatcttcaaaagactctggggggctggatttctgaaaagattgtggattactttgcattgtatgcagaagcttgctttgcaaatttcggagac

SEQ ID NO: 34811 - protein, 166 aa, Panicum virgatum
  misc_feature: Ceres CLONE 1957566
  misc_feature (11)..(166): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 51143
  misc_feature: Useful for making plants with altered cell wall content and/or composition
  misc_feature: Functional homolog of the protein sequence given in SEQ ID NO 50586
  misc_feature: Useful for making plants with altered carbohydrate content
  misc_feature: Functional homolog of the protein sequence given in SEQ ID NO 50615
  misc_feature: Useful for making plants with modulated biomass
MGSTGREAEVARADFPDGFVFGVATSAYQIEGARREGGKGDNIWDVFTEDKERVLDRSNGDIAVDHYHRYREDIELMASLGFRAYRFSISWARIFPDGMGGKVNEQGVAFYNNLINFMIAKGVEPYATLYHWDLPNNLQKTLGGWISEKIVDYFALYAEACFANFG

SEQ ID NO: 34812 - DNA, 1072 bp, Panicum virgatum
  misc_feature: Ceres CLONE 1957574
  misc_feature: Encodes the peptide sequence at SEQ ID NO. 34813
gaatccctaatcccctccgcgctcgattgccgccgccgccgccgccgccgcgttcgccccagcctcccgcaatgcaacctccatccggtctctcgccgcccccaccatcctctccgcccgccgatacgctggcctccgccgccatccaaaccccaagcctccccgacaccccggcctccttggatcccgatacccccttctccgatgccgcacccctcgaagtctcggacgccgacacccccgccctcgcaccaacacccgacggcgccctcgcctccgcctctgacgcccccggcgacggcgaggacgacgggatcaccaacccctctggcggctccaggaagcacatgaccctagcgccgccggcgccggccagcaagaagtccaagaagaagggcggtaacagcgtctggacccggccaacctcccgcaagggcaagaagaaggcgaggcagccgggcggccacggccccggtggtggcatcagcggcgcccaccccggacccatcgccggtggagatgagttgtgccagctcgtccccgcgacccgccttgccgccgagcgcaacgacgacgcggccacccagcccgtgcaactctcccgcttcttcaagtccgagaagatcgaggtctccgacgaccgcctcacagctgccagcaccaagggctaccgcatggtgcgcgccacccgcggcgtggcggccggggcgtggtactttgaggtcaaggttgtgcatctcggcgccacaggccacacgcgccttggatgggtgaccaatagggcagatctccagacaccggttgggtatgatgcctatgggtttgggtaccgcgacattgatggcgccaaggtgcataaggcttggagggagaagtatgctgatgaagggtatggggaaggagatgtactcgggttctacatttctctacctgatggggagagatatgagcctaagcaacccgacctgattcagtacaagggaatgccatttcatgtgcaagtccccaaggaggagcagaaggtaccagctcctgttcctgggagtgagatatgctacttcaagaatggggt

SEQ ID NO: 34813 - protein, 333 aa, Panicum virgatum
  misc_feature: Ceres CLONE 1957574
  misc_feature (211)..(315): Pfam Name: SPRY Pfam Description: SPRY domain
MQPPSGLSPPPPSSPPADTLASAAIQTPSLPDTPASLDPDTPFSDAAPLEVSDADTPALAPTPDGALASASDAPGDGEDDGITNPSGGSRKHMTLAPPAPASKKSKKKGGNSVWTRPTSRKGKKKARQPGGHGPGGGISGAHPGPIAGGDELCQLVPATRLAAERNDDAATQPVQLSRFFKSEKIEVSDDRLTAASTKGYRMVRATRGVAAGAWYFEVKVVHLGATGHTRLGWVTNRADLQTPVGYDAYGFGYRDIDGAKVHKAWREKYADEGYGEGDVLGFYISLPDGERYEPKQPDLIQYKGMPFHVQVPKEEQKVPAPVPGSEICYFKNG

SEQ ID NO: 34814 - DNA, 597 bp, Panicum virgatum
  misc_feature: Ceres CLONE 1957574-R
gaggtaaagaatgaggggcctgccgaaaatggtattgctgaaaaaactagctagtgtagttaacatgctattaaggcttttagctatgttggtttttgaatacccgtgtaaacaccaaatgggcccatggctaggtcatggtgaggttggccgctggagccatatctgactactagatgtatgcttatatgttgtcaccaaatgggtccagtttcctgtccttggcccggtgatgaagttattcactctgttcgcttggctgtggttagtggctgctgctgatttgttatgaaagaaaaatattgttggtggctggtgttgatttggtatgagagaaaaatattgatggctggttgactgacaagccaagtgaatagagtgtttgtgtgctgccagatggtagtggaatggtgatggtaacgtatgcaacctgcggtgggacgaagagtagtgatgggagattgggaggtggtgggttgatgcggcaggtgaaactttatgctgggagtttcactgtggtcaggaaggatatttatggctagaaaaagtatctgcatgtaaatttgccaatttatattcattttcatttttcatccc

SEQ ID NO: 34815 - DNA, 1598 bp, Panicum virgatum
  misc_feature: Ceres CLONE 1957576
  misc_feature: Encodes the peptide sequence at SEQ ID NO. 34816
ggagacagccgcagccatgcgagggctcctctcttcttcctccgctctcctccgacgagccgccgccgccgccgccctgctctcccgcgcgggctggagtgacgccacagcatccgcatcctctcctctccgccgctttctccgccagaatggaaaaagagagacattttgttcctcttggtctaagggctgttcaatgtcaaccacagttgatatgcagttagactatgagagtgaccccccacttgatgatgcaaaagctcttgagaaggagtcgtcactaaatgttgctgtctctcaacttgccagtggttttgatagagaatctaatctatgtttggagcgattttcccgtacaaggcgtgcatctgtcatctctaccggctctcttaagcttgatcttgctctcggcactggaggattaccaaagggtagaatggtggagatatttgggaaagaggcatctgggaaaacaacacttgcacttcatgttgtcaaggaagctcaaaagaatggaggttattgcgcttatattgatgcagaaaatgcttttaacccttcgtttgcagaagctattggtgtagacagtgaaaggctcttgatagcccaacctgattctgctgaaaattctttgagcattgtaaacactcttgttggtggatctgttgctgttgttgtagtggatagtgtggcagcacttattcccaagtgtgaaatggaaggtgaaatatacacgaattctgaagacatacagtcccgtttgatgactcgggcgcttaggaaaattcagtacactttgtgtcgctctgaatcacttattattttcgtgaatcaggttagaacgaagttgagctcgaatcagtgtccagggatctacaaggaggtgccttgcggcggtaacgcgttaggattctatgctgcagtcagaatgaggacttcaaggagggaactgcgctatagtgaagaccaggctactggcattagtatatctgtgcaaatcatgaagaacaaattagctccagcgagtctgaaggaagtcggtatcgacatcagatttgggaaggggatctgccatgaatctgagattctggagatggcttcttgtgtcggagttgttgtgaaggatggatctgggtattggatcaatggcgagttcctgcctggcaagggggaagctgagaaattcctacatgaaaacgctggtgtggcagatgagatctgcaataccgtgagaaatcagttccttcaaaggtgacaaacgaagcccactggaagttggctggctctgaagttttctcgtcagtcgtcaccttgactgggtacagtttttataacatctgagaagaaaattgggacacactgcactggcgaggaatcattttaagtatctaatctatcatttattctacaaaggaagtgtgattaagggatgatgatcaattagagaggctaatgcattgttagtcaagttgtcttgatctcggcgtgtggcattgctgtatgattgtatcgtgtattcatagtagatttatatatgatgcatcttgctctgtaacttactggattttacctcattgaatcgagggccatttctcctg

SEQ ID NO: 34816 - protein, 412 aa, Panicum virgatum
  misc_feature: Ceres CLONE 1957576
  misc_feature (87)..(411): Pfam Name: RecA Pfam Description: recA bacterial DNA recombination protein
MRGLLSSSSALLRRAAAAAALLSRAGWSDATASASSPLRRFLRQNGKRETFCSSWSKGCSMSTTVDMQLDYESDPPLDDAKALEKESSLNVAVSQLASGFDRESNLCLERFSRTRRASVISTGSLKLDLALGTGGLPKGRMVEIFGKEASGKTTLALHVVKEAQKNGGYCAYIDAENAFNPSFAEAIGVDSERLLIAQPDSAENSLSIVNTLVGGSVAVVVVDSVAALIPKCEMEGEIYTNSEDIQSRLMTRALRKIQYTLCRSESLIIFVNQVRTKLSSNQCPGIYKEVPCGGNALGFYAAVRMRTSRRELRYSEDQATGISISVQIMKNKLAPASLKEVGIDIRFGKGICHESEILEMASCVGVVVKDGSGYWINGEFLPGKGEAEKFLHENAGVADEICNTVRNQFLQR

SEQ ID NO: 34817 - DNA, 693 bp, Panicum virgatum
  misc_feature: Ceres CLONE 1957577
  misc_feature: Encodes the peptide sequence at SEQ ID NO. 34818
aacaaacgctaaaaaagtaacagtttctgtactttattggttccgcctttattgaaactcgtcaaatttttgactacgagcttcacgccgacatttccgccacacacgcaccaccttcgtcgaccagacacacttcttcgatcacacatggctcgcatcatccgcctcaccgccttcgctgtcgcgatcgcgctcgccacgagcagcgcctccgccgacttggtcctagttccggcttgcaacgtcatcccaagcaagaagaatttccgcgcgcagcagtactacagctccgagcccgcggaagtgacgacggccgcgccgtactgctcgtcggaaccggcggaagtcacaacggcagctccgtacgagactccggctccgtactcgtcggaacccgcggaccccccctccgccgccccgtactcgtcagagccagcggaagagacaaaagaagcgccttacgagacgccggcgccatacagctcggagccggccgaggtgacgaccgcggcaccttactcgtcggaaccggcggaagtcacaacggcggctccgtacgaaacgccggcaccgtactcttcggagcccgcggaggtgacaacggccgcgccttatgagacgcccgcgccctactcttccgaacctgctgaggtgaccaccgctgcgccatacgagacgccggccccttactct

SEQ ID NO: 34818 - protein, 181 aa, Panicum virgatum
  misc_feature: Ceres CLONE 1957577
  misc_feature: SWISSPROT Homolog: EC 3.2.1.4 Cellulase
MARIIRLTAFAVAIALATSSASADLVLVPACNVIPSKKNFRAQQYYSSEPAEVTTAAPYCSSEPAEVTTAAPYETPAPYSSEPADPPSAAPYSSEPAEETKEAPYETPAPYSSEPAEVTTAAPYSSEPAEVTTAAPYETPAPYSSEPAEVTTAAPYETPAPYSSEPAEVTTAAPYETPAPY

SEQ ID NO: 34819 - DNA, 518 bp, Panicum virgatum
  misc_feature: Ceres CLONE 1957588
  misc_feature: Encodes the peptide sequence at SEQ ID NO. 34820
agcagggcaagaagacagagggcagaagaggcattggccggagaccgaggaggctccgcggttcggcgtccgaggcgaggcgcggtggcggccacaatgctcgctgcccacgccaagcgatcctgcgctttgctcaccgccttcgcgctgaccgtgcccacgctcgtcatcctcctcgccgggggcgccggcgcgccggcggtctgggttaggaacgccatggccaccttccggcaaggtccggacgatttctacacgatggcggcgcacgacaagcttcacggcggcctcttggtggaagggttcggccaggagtcgtgccgcagccggtaccaatcggccgcgtaccgccggaaccccggccggcgaccctcggagcacctcgtctccaggctgcgacggcaggaagcccggcaacggcggtgcggccccggcaccgccgcctaccgcaacgcgctggagcagctcaagtccggcaagaacgccgccgccgccgccgcgccgtcgcccccggagtg

SEQ ID NO: 34820 - protein, 140 aa, Panicum virgatum
  misc_feature: Ceres CLONE 1957588
  misc_feature: SWISSPROT Homolog: EC 2.4.1.69 Galactoside 2-alpha-L-fucosyltransferase
MLAAHAKRSCALLTAFALTVPTLVILLAGGAGAPAVWVRNAMATFRQGPDDFYTMAAHDKLHGGLLVEGFGQESCRSRYQSAAYRRNPGRRPSEHLVSRLRRQEARQRRCGPGTAAYRNALEQLKSGKNAAAAAAPSPPE

SEQ ID NO: 34821 - DNA, 298 bp, Panicum virgatum
  misc_feature: Ceres CLONE 1957604
  misc_feature: Encodes the peptide sequence at SEQ ID NO. 34822
agaggagacgctttgccccccgcacgactgctcccaaagcctacctacccctcgccagcctcgcaatcgcaaatggcgctcgccaccaacggcgcggccgccgccgccgccgcagcggccgtatccggcggcgcggcgtcccagccgcgccgcgcgaccgcgttcctcccgctgaagaggctcaccatctcggccatcctcgcctccgacccgtcgaagaacaacgggcctgccgtccccgcggcggccgcctccaaggcctcgtcctctgttgtggcgacgggggggggggaaatct

SEQ ID NO: 34822 - protein, 75 aa, Panicum virgatum
  misc_feature: Ceres CLONE 1957604
  misc_feature: SWISSPROT Homolog: EC 2.5.1.54 3-deoxy-7-phosphoheptulonate synthase
MALATNGAAAAAAAAAVSGGAASQPRRATAFLPLKRLTISAILASDPSKNNGPAVPAAAASKASSSVVATGGGEI

SEQ ID NO: 34823 - DNA, 1233 bp, Panicum virgatum
  misc_feature: Ceres CLONE 1957613
  misc_feature: Encodes the peptide sequence at SEQ ID NO. 34824
aactaacgctaaaaaagtaacagtttctgtactttattgatcatgcgcaacaagcctcacaagcagaagttcgcgtcaaaacacgagctggcacgacgtgcgggtggcaacggtggtcgtgcgacgacggagccgaagctgttttcccagtcgaaagacaccgccgttggcaaaggtggaaacgaatccggatcgaaagggcggcgtcaacaggccgcagctgcacagcgaaaggcgaaagcggaagtgagcatcgctgaaaaagcgatcgggtcagtcgcgcgaggcggaccgccacgcattgtcgccttcgccccacttaacgagtctgcgagtccgcaagctgtccgacaacaatttttcgccgcatgctcctgggagtcgtctcaagatcacgagatcgaacatgttgcgacaaacaagcaccgtttcaccacactgatgtgtccagagatggacgaacaagctgttcttgatgctgtgaaggtcgcagacgttctcgttcttgcagtcgactgtgcctcggcagttcaagaaacgatcaaggatttgaacatggagccaatcgatgacaatgcatccgcgtattccggaacgacatggttcgctgatatcggcctgtgcattactgacgcaacacgtgagctacttcacgccttgaattcacacggctgccccacgatcatcgtggttctgcaaggattggacacatacgaaaacgacaagcggcggcgacatacggttcgcattcacgagcggtacttctcggctatgttgccggaagaaacccgtgtactatgttctgatgtggctgatttcaacgaccttctcatgcgcactgccgccaacaccaaactccggcaactcaagtggcgagagcagcatccatacctactggtggacactgtcgcttttcacgaagatgagaatgcactcgaagtccgcggcttcctgcgcggcagcagtgcctcggcttcaatgttgtttcacttgaccaatttcggcacgtatcaggctctcgacatctctgctcctggcgatcccacaggtgtgaaagcagacgactttgtcggactgttggacaccgcggacccagacgttcaggagtctttggaaggcgtccagcagaatgacacagcctatgacgaacaagccgagtttccgactgaagcggatgttgaacatgccgaaaagcacactcggacggtgtgggtaccagaaggtgtttccgag

SEQ ID NO: 34824 - protein, 396 aa, Panicum virgatum
  misc_feature: Ceres CLONE 1957613
  misc_feature (263)..(335): Pfam Name: AARP2CN Pfam Description: AARP2CN (NUC121) domain
MRNKPHKQKFASKHELARRAGGNGGRATTEPKLFSQSKDTAVGKGGNESGSKGRRQQAAAAQRKAKAEVSIAEKAIGSVARGGPPRIVAFAPLNESASPQAVRQQFFAACSWESSQDHEIEHVATNKHRFTTLMCPEMDEQAVLDAVKVADVLVLAVDCASAVQETIKDLNMEPIDDNASAYSGTTWFADIGLCITDATRELLHALNSHGCPTIIVVLQGLDTYENDKRRRHTVRIHERYFSAMLPEETRVLCSDVADFNDLLMRTAANTKLRQLKWREQHPYLLVDTVAFHEDENALEVRGFLRGSSASASMLFHLTNFGTYQALDISAPGDPTGVKADDFVGLLDTADPDVQESLEGVQQNDTAYDEQAEFPTEADVEHAEKHTRTVWVPEGVS

SEQ ID NO: 34825 - DNA, 1790 bp, Panicum virgatum
  misc_feature: Ceres CLONE 1957615
  misc_feature: Encodes the peptide sequence at SEQ ID NO. 34826
acactacaagtcacgcagccctctccctccttccttggttcccgtcgaatccccctgctctcctttctttctttctctctctcccccgtcccccccccccccccttgccgttcaggaacctgcttgctctgctcgatcgccctgcgcttggttcttgcgcgtgagagctcagaagcgtgtccttttcgcttccgtttgattctatatctttgccaatccaatcgaacctccttgcttggtcccaaagggaggagaaagatcgaggagaaacgacggcggcgtaaaattccggggcgagggcgggcatggccatggttggtgctctgttcctttccatgagcgccgccgtgccatccgcttgactgaccagtcatcgtctccgtccgtgctcggcaccagctgaactcgcgcctcgaccaatcgccgtcagaacaagacagagagagctggtggcagaagctctctgcagctgcggcggagaactggtcccggagaaatgcggcagatctcgtcgctgctgcagggcctggcccggtcgctgtcggtggggagggacaggaggggacggcggcgccggcgccggcgacgggaaggccgccgcgccggcggtgctaaggacgtcgggcacggtgtggggcgagggctcggagacgttcgccgccgtgtgctcgcggcgcggcgagaagggcaccaatcaggactgctccatcgtctgggaggggttcgggtgccaggaggacaccatcttctgcggcatcttcgacgggcacggcccgtggggccactacgtcgccaaggccgtgcgcgactcgctgccgccgtcgctgctgtgccactggcaggaggccctcacgctggcgtcgctcatcgacggcgagaagaagctcagcgactgccggttcgacctctcgaagcagtcctacgtggccgcctgcgccgccgtcgacgacgagctccgccgcagccgccgcctcgacgccgtctacagcggctccaccgcgctgtccatcgtcaagcagggcggcctcatggtcatcgccaacgtcggcgactcccgggccgtcctgggcaccaggtccgacgacggcgccctcgccgccgtccagctcaccgtcgacttcaagcccaacctgcctcaggagaaggagcgcatccggcggtgcaacggccaagtgtactgcctcgccgacgagcccggcgtgtaccgtgtctggcagcccagccgggactcgccggggctcgccatgtcgcgcgcgttcggagactactccgtcaaggactacggcgtcatctcggcgccggaggtgacgcagaggaagatcagcagcagggaccacttcgtcatcctcgccaccgacggggtctgggacgtgctctcgaacgaggaggcggtgcagatcgtggcggggacgccggacagggggaaggcggccaagcggttggtggagtgcgccgtccgcgcgtggaggcgccggcggcggggcatcgccgtcgacgactgctcggcgatctgcctcttcttccactcgccgccgtcgtaggggcgggcgcacacgacacgtgaacctgcctcaatcgacgtcaaggagacaacgagatgcacatctcaagactacgatcgtcgtgcccgtcgcgttcgtggttgggagtgcaattgtcgccgtccacgattcagaacgtgcagcttgtcgcatgatcgcgacactgcagctggtggatgaccaaacaaaaaaaaatcctggctttcacaccgggcttgtcaaaatgtacgagaacgaacaccagccacc

SEQ ID NO: 34826 - protein, 170 aa, Panicum virgatum
  misc_feature: Ceres CLONE 1957615
  misc_feature (1)..(158): Pfam Name: PP2C Pfam Description: Protein phosphatase 2C
  misc_feature: SWISSPROT Homolog: EC 3.1.3.16 Phosphoprotein phosphatase
MVIANVGDSRAVLGTRSDDGALAAVQLTVDFKPNLPQEKERIRRCNGQVYCLADEPGVYRVWQPSRDSPGLAMSRAFGDYSVKDYGVISAPEVTQRKISSRDHFVILATDGVWDVLSNEEAVQIVAGTPDRGKAAKRLVECAVRAWRRRRRGIAVDDCSAICLFFHSPPS

SEQ ID NO: 34827 - DNA, 177 bp, Panicum virgatum
  misc_feature: Ceres CLONE 1957620
  misc_feature: Encodes the peptide sequence at SEQ ID NO. 34828
tcagagacacggtgatcgtggaggagaggagcgacgccgaggccagcgaagctgcggcggagccggaggaggccgagcgcgacggcgacggcaatgccgctgccgcggcgcccaaccgcaacgaccaacccagcaccaggagccgagacggaagaggtcctctactctgatattttc

SEQ ID NO: 34828 - protein, 55 aa, Panicum virgatum
  misc_feature: Ceres CLONE 1957620
  misc_feature: Functional homolog of the protein sequence given in SEQ ID NO 50604
  misc_feature: Useful for making plants with altered carbohydrate content
RDTVIVEERSDAEASEAAAEPEEAERDGDGNAAAAAPNRNDQPSTRSRDGRGPLL

SEQ ID NO: 34829 - DNA, 615 bp, Panicum virgatum
  misc_feature: Ceres CLONE 1957629
  misc_feature: Encodes the peptide sequence at SEQ ID NO. 34830
aacgaacgctaaaaaagtaacagtttctgtactttattgagctgccccagatctcgctgcctccccgcgcggctactctgacggctttagcatcaatccattccaccactactcgcacgcccctatctgctccgccgcaccaccaccataatggccgacgaagactggaagaaggacgtgaaggcgccgccgaaggacacgcgcaagaagacggaggacgttcagagccgccgcaacgtgagcttcgaggactacttcctgaagcgcgagctgctcatgggtattttcgagaagggctacgagaagccgtcgccgatccaggaggacgcgatccccatcgcgctcaccggcaaggacgtgctcgcgcgcgccaagaacggcaccggcaagaccgcgtcgttcgtgatccccgcgttggagaaggcgaagccggagatcaactccgtgcaggtgctgctgctcgtgccgacgcgcgagctcgcgctgcagacggcgcaggtgacgaaggagctcggcaagcacatcaacggcctcgaggttatggtgaccacgggcggcacgacgctgcgcgatgacatcatgcgcctcatgcagccggtgcacatcctgctcgcg

SEQ ID NO: 34830 - protein, 154 aa, Panicum virgatum
  misc_feature: Ceres CLONE 1957629
  misc_feature (54)..(153): Pfam Name: DEAD Pfam Description: DEAD/DEAH box helicase
  misc_feature: Functional homolog of the protein sequence given in SEQ ID NO 50788
  misc_feature: Useful for making plants with altered lignin content
MADEDWKKDVKAPPKDTRKKTEDVQSRRNVSFEDYFLKRELLMGIFEKGYEKPSPIQEDAIPIALTGKDVLARAKNGTGKTASFVIPALEKAKPEINSVQVLLLVPTRELALQTAQVTKELGKHINGLEVMVTTGGTTLRDDIMRLMQPVHILL

SEQ ID NO: 34831 - DNA, 648 bp, Panicum virgatum
  misc_feature: Ceres CLONE 1957629-R
  misc_feature: Encodes the peptide sequence at SEQ ID NO. 34832
tcgtgtgctccgacctcatcacgcgcggtatcgatatccaggccgtcaacgtcgtgatcaacttcgatttccccaagaactccgagacgtacctccaccgcatcggccgctccggccgtttcggccacctcggtctggccatcaacttcgtcacgtacgaggaccgcttcaacgtctaccgcatcgagcaggagctcgacaccgagatcaaggccatcccggcggagatcgacccggagctgtacgtggcttgagaagcgtggttttacacccagcggttacacgcgcacgccgcacgcacatgcgcggcgcgtcacccgcctgatcatcgtacacacagagagagcccagcgactaacgagctgcgcgacgttgcttactgcaacgtcgaacgcgtgccgttattacgcgatgcccatcagtatgctcatcgcgttcggaacctttttgccgcgcggcgagggtcacgctgcaccggaatccctttcttgtttcgtcctcggaggcgccagccgtcggccccacacggcctcggaccgcctccgcctcgtgcccacccgcgtctttcccatcgtgcgtcgtgttgaccccaggccatcagaaacccaaaactccgccacacagcatcagttccggcaggcaacaacg

SEQ ID NO: 34832 - protein, 83 aa, Panicum virgatum
  misc_feature: Ceres CLONE 1957629-R
  misc_feature: Functional homolog of the protein sequence given in SEQ ID NO 50788
  misc_feature: Useful for making plants with altered lignin content
VCSDLITRGIDIQAVNVVINFDFPKNSETYLHRIGRSGRFGHLGLAINFVTYEDRFNVYRIEQELDTEIKAIPAEIDPELYVA

SEQ ID NO: 34833 - DNA, 588 bp, Panicum virgatum
  misc_feature: Ceres CLONE 1957634-R
  misc_feature: Encodes the peptide sequence at SEQ ID NO. 34834
gcaagctcaaccttcagcaagggcagtacagtgaatgctacattctattcagcctgcccaaggaatgaccttctcactgacggtacatttgcgctagttgagaagctagatggtaacaacaattgggttcctgcctatgatgatgatgactggtcgctgcgtttcaagtggtcaagacctgcaaaattgagtccaaggagttttgcaacgctggaatggacaattcctgaagatgccccatccggtgtttacagattgaggcattttggtgcctccaagccattgtttgggtcgatcaaacattttacaggaacttctcgcgcgttcgcagtgcgctagatggtggtgcaccgttgccttggacactacagctatccgagtttacaccagtgattttttcatactgaaatggtggcacagtatcaagtatgttggtccttgttttttttacatatgtttgatggcaataacattttcagattatgccgaactgcttgcatcttgtacgcatctgtcccatggggatgtgtagcttgtacataactgcaaactcgatatatgtgtgaagtttatgcgatctcgtgaagc

SEQ ID NO: 34834 - protein, 112 aa, Panicum virgatum
  misc_feature: Ceres CLONE 1957634-R
  misc_feature: SWISSPROT Homolog: EC 3.5.1.23 Ceramidase
ASSTFSKGSTVNATFYSACPRNDLLTDGTFALVEKLDGNNNWVPAYDDDDWSLRFKWSRPAKLSPRSFATLEWTIPEDAPSGVYRLRHFGASKPLFGSIKHFTGTSRAFAVR

SEQ ID NO: 34835 - DNA, 1246 bp, Panicum virgatum
  misc_feature: Ceres CLONE 1957634
ggttagcgttgtgacgctgatctctcattgtggccgtcggaggctgattgccttttaagggtcggagatgaggggtgtggttttaggagcagatttctagtgtggggaagccaattacctggtctggtcacctccctccctctttgctgcagcaaaatctgcccactgcagtgctgagatttcgtcgtagcttgtagttggtattgctgccatccacttccattcaacgcgaggatctcatgaggttgaatccgtttcgtgtccagttagtttttgtttgctcgggcgtttagttgactcatcaatttattgagatatttgacttgcatgagctgattaaaaagccctgttccctggttcacgatggagccatcttgcatgcgataccatgtttgtggttttggttctcgtatgatatggctatgcttttttctagtactcgttcttcagagttgcagcccggcactttcagactctccatatttggttggtatgggaagctacgacataactggtcctgctgcagacgttaacatgatgggatatgcaaatgctgaacagatcgcatcaggaattcatttcaggctgaaggcccgtgcattcattgttgctgagcctaatgggaagcgtgttgtgtttgtgaatcttgatgcttgcatggcatcgcagcttgttactataaaggtgcttgaaaggcttaaagcaaggtatggagatctttataatgagaacaatgtggctatcagtggaatccatacacatgctgggcctggcggttatctgcaatatgtagtttatattgtcacatctcttgggtttgttcgccaatcatttgatgtaattgtcaatggcattgagcagtgtattgttgaagctcacaacaacctccgccctgggaaaatctatgtgaataaaggtgaactccttgatgctggtgtgaatcgcagcccaagtgcatatctaaataaccctgctgaggagagaagcaagtatcagtataatgttgacaaagaaatgacccttatcaagtttgtggatgatgaactgggtccagttgggagtttcaattggtttgcaacgcatggaacatcaatgagtcgtacaaattcattgataagtggtgataacaaaggagcagctgcacgttttatggaagattgggcagaacaaaatggtatgccaaagcagggggctcatgtaactaatgttggtttagaatatttgcacaagatatctggacttccga

SEQ ID NO: 34836 - DNA, 602 bp, Panicum virgatum
  misc_feature: Ceres CLONE 1957636
  misc_feature: Encodes the peptide sequence at SEQ ID NO. 34837
aatctaaattgaaaaatattctctttctataaactccttacaataaaatgagagaaatcgttcacatccaaggtggtcaatgcggtaaccaaatcggtgctaagttctgggaagtcatctccgatgaacacggtatcgaccccactggtacctaccacggtgattctgatctccaactcgaaagaatcaacgtttacttcaacgaagccactggtggcagatatgtccccagagctatccttatggatctcgaacccggtaccatggactccgtcagagctggccccttcggtcaactcttcagacctgacaacttcgtcttcggtcaatccggtgctggtaacaactgggccaagggtcactacactgaaggtgctgaactcatcgactccgtcctcgatgtcgtcagaaaggaagctgaaggttgcgattgcctccaaggtttccaaatcacccactccctcggtggtggtaccggttccggtatgggtaccctcttgatctccaaggtcagagaagaataccccgacagaatcatggaaaccttctccgtcttcccctcccccaaggtctctgataccgtcgttgaaccctacaacgcc

SEQ ID NO: 34837 - protein, 184 aa, Panicum virgatum
  misc_feature: Ceres CLONE 1957636
  misc_feature (45)..(184): Pfam Name: Tubulin Pfam Description: Tubulin/FtsZ family, GTPase domain
  misc_feature: Functional homolog of the protein sequence given in SEQ ID NO 50258
  misc_feature: Useful for making plants with modulated flowering time
MREIVHIQGGQCGNQIGAKFWEVISDEHGIDPTGTYHGDSDLQLERINVYFNEATGGRYVPRAILMDLEPGTMDSVRAGPFGQLFRPDNFVFGQSGAGNNWAKGHYTEGAELIDSVLDVVRKEAEGCDCLQGFQITHSLGGGTGSGMGTLLISKVREEYPDRIMETFSVFPSPKVSDTVVEPYN

SEQ ID NO: 34838 - DNA, 1721 bp, Panicum virgatum
  misc_feature: Ceres CLONE 1957638
  misc_feature: Encodes the peptide sequence at SEQ ID NO. 34839
agtttcactcccctggcctgccgcctcggataaaggaggagtggagagaaggagcttgtgagagttcatcacgtcgtccccgtcgtgaagtggtatctgctagctagctagcacataggccgtgcggcgagatgtcggcgtcgggggtgccgctggcctaccagggctcggcgtcggcgccggagtggctgaacaagggcgacaacgcgtggcagctgacggcggcgacgctggtgggtctgcagagcttcccgggtctggtggtgctctacggcggcgtggtgaagaagaagtgggccgtcaactcggccttcatggcgctctacgccttcgccgccgtctggatctgctgggtcacctgggcctacaacatgtccttcggcgacaagctgatccccatctggggcaaggcccgccccacgctgaaccagggcttcctcatcgcccagggcgacctgccggccacggggcactaccacgccgacgggagccccgagacggccgcggtggagcccttctaccccatggccaccgtcgtctacttccagtgcgtgttcgccgccatcacgctgatcctggtcgccgggtcgctgctggggcggatgagcttcctggcgtggatgctcttcgtgccgctctggctcaccttctcctacaccatcggcgccttctccgtctggggcggcggcttcctcttccagtggggcgtcatcgactactgcggcggctacgtcatccacctctccgcggggttcgccggcttcaccgccgcctactgggtgggcccgcgggcgcagaaggaccgcgagaggttcccgcccaacaacatcctgttcacgctcaccggcgccgggctgctgtggatggggtgggcggggttcaacggcggcgggccctacgccgccaacacggtggcgtccatgtcggtggtcaacaccaacatctgcgcggccatgagcctcatcgtctggacctgcctcgacgtcatcttcttcggcaagccctctgtcatcggcgccgtccagggcatgatcaccggcctcgtctgcatcacgcccggcgcaggtacggtattttttttcttctccttccttgaatttctcgcaacgggtggtggtgcgcagcgatgagcacgcgcggcgcggcggggagaagattagttgattagttgactttgaattcaaaagagttgtgcgcccgtcaccaactccaagggcgccttctacggcggcgtcggcggcgcgcagttcggcaagcagctcgccggcgcgctcttcgtcatcggctggaacgtggccgtcacctccataatctgcgtcgccatcaacgccgtcgtcccgctgcgcatgcccgaggacaagctcgaggtcggcgacgacgccgtgcacggcgaggaggcctacgcgctctggggcgacggcgagctctacgacaacaccaagcacggcgccgacgagaccgagcacggcgcccgcgccgccgtcgcgcccgtaacgacgccccccaactgatgatatggaagttatttgcccgcgcaatgcgtgatcgatcatgtatattgctccgccgatcgtgtcgtgttaaccccgccgtacgtgaagaaaccaagcgatactagcaggcttcaggttttggtcttctgaatctttattaatcgtcagctgcgacgtgtaaaatacgttctgttttcttcttcattcagatcaaagacatgtaaatcc

SEQ ID NO: 34839 - protein, 332 aa, Panicum virgatum
  misc_feature: Ceres CLONE 1957638
  misc_feature (26)..(331): Pfam Name: Ammonium_transp Pfam Description: Ammonium Transporter Family
MSASGVPLAYQGSASAPEWLNKGDNAWQLTAATLVGLQSFPGLVVLYGGVVKKKWAVNSAFMALYAFAAVWICWVTWAYNMSFGDKLIPIWGKARPTLNQGFLIAQGDLPATGHYHADGSPETAAVEPFYPMATVVYFQCVFAAITLILVAGSLLGRMSFLAWMLFVPLWLTFSYTIGAFSVWGGGFLFQWGVIDYCGGYVIHLSAGFAGFTAAYWVGPRAQKDRERFPPNNILFTLTGAGLLWMGWAGFNGGGPYAANTVASMSVVNTNICAAMSLIVWTCLDVIFFGKPSVIGAVQGMITGLVCITPGAGTVFFFFSFLEFLATGGGAQR

SEQ ID NO: 34840 - DNA, 1252 bp, Panicum virgatum
  misc_feature: Ceres CLONE 1957644
  misc_feature: Encodes the peptide sequence at SEQ ID NO. 34841
agagatccgctgcagttgagtgccctcccctccacgcccaccccttctcattatttatcccctctccctctccgcaacgacccttctccgcctcgccccccgccgccgccgccggattcgcttccgcctccggcggccacgcccatttcccgcaccactacctcgccgcatccgccggctccgatcctcagttcctcacggctgctgcggcaccatctttaccccacgaccacgccagccacaagaccagaaacgcctcccacaacgggaagaatccattcatcgagtccactcatcaggggcgctgcgcccccatctttgactcgcactccgcgtccagatctaggccggtggagcgaggaaagatgaacggaggcaccgccccatccgcggccgcggccgcggcgacgccgcctcaccggcggctgccggacttcctccagagcgtgaacctcaagtacgtgaagctggggtaccactacctcatcacccacctgctcacgctgatgctgctcccgctcatggccgtgatcctcctcgaggccgggcgaaccgaccccgacgatctgcgccagctgtggctccacctccagtacaacctcgtctccgtgcttgtcctctccgccgtcctcgtcttcggcgccaccgtctatgtgctcacccgcccgcgacccgtctacctcgtcgacttcgcctgctacaagccgcccgcccacctccaggtccgcttcgaggagtttatgcgccactccaagctctgcggcttctccgaagacgcgctcgagctccagcgcaagatcctcgagcgctccggcctcagcgaggagacctacgtcccggaggccatgcacgccctgccgccccagcccacaatggccaacgcccgcgccgaggccgagaccgtcatgttcggcgcgctcgacaacctcttcaaggccaccggcgtcaagcccaaggacgtcggcgtcctcgtcgtcaactgcagcctcttcaatcccacgccgtccctgtccgccatgatcgtgaacaagtacaagctccgcgggaacatccggagcttcaacctcggggggatgggctgcagcgccggcgtcatcgccatcgacctcgcgcgcgacatgctgcaggtgcaccgcaacacctacgccgtggtcgtcagcacggagaacatcacccagaactggtacttcgggaaccgcaagtcgatgcttgatccccaactgcctgttccgcgtcggcggcgcggcggtgc

SEQ ID NO: 34841 - protein, 295 aa, Panicum virgatum
  misc_feature: Ceres CLONE 1957644
  misc_feature (96)..(293): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
  misc_feature: The sequence is a functional homolog of SEQ ID NO 2 in US patent 7038112
MNGGTAPSAAAAAATPPHRRLPDFLQSVNLKYVKLGYHYLITHLLTLMLLPLMAVILLEAGRTDPDDLRQLWLHLQYNLVSVLVLSAVLVFGATVYVLTRPRPVYLVDFACYKPPAHLQVRFEEFMRHSKLCGFSEDALELQRKILERSGLSEETYVPEAMHALPPQPTMANARAEAETVMFGALDNLFKATGVKPKDVGVLVVNCSLFNPTPSLSAMIVNKYKLRGNIRSFNLGGMGCSAGVIAIDLARDMLQVHRNTYAVVVSTENITQNWYFGNRKSMLDPQLPVPRRRRGG

SEQ ID NO: 34842 - DNA, 310 bp, Panicum virgatum
  misc_feature: Ceres CLONE 1957652
  misc_feature: Encodes the peptide sequence at SEQ ID NO. 34843
aagccacactccactctcctgctttggttatcttcacttcactcgcagcagcagccatggatccaaccaagttccggccgtcgagcaggcacgacacgaaggtgacgacgacgaacgcgggcgcgccggtgtggaacgacaacgaggcactgacggtgggcccgcgcggtcccatcctcctggaggactaccacctgatcgagaaggtggcccacttcgcccgggagcgcatcccggagcgcgtcgtccacgcccgcggcgcctccgccaagggcttcaagaagacacccactacttctcctacctcacc

SEQ ID NO: 34843 - protein, 84 aa, Panicum virgatum
  misc_feature: Ceres CLONE 1957652
  misc_feature: SWISSPROT Homolog: EC 1.11.1.6 Catalase
MDPTKFRPSSRHDTKVTTTNAGAPVWNDNEALTVGPRGPILLEDYHLIEKVAHFARERIPERVVHARGASAKGFKKTPTTSPTS

SEQ ID NO: 34844 - DNA, 365 bp, Panicum virgatum
  misc_feature: Ceres CLONE 1957704
  misc_feature: Encodes the peptide sequence at SEQ ID NO. 34845
cgctgctcccgctctcggtccttggcaatgtcgactcgggcgaggagtccccccccgaccgcctgatgatcgacctggaagatatcaacttccaggccatccagagggtcaacaactacctctttgacaagatctacacgcccttctgctatgcctgggtgcttgacgagctcgaggctgatcgtgatacacgtgtcaccattggtattgccgtgcgcaactttgataccaccaagaactactacacgtacatgaatcccgcatcacactgtgaattcaatgggaacccgatcatgatgatctctcaccctgagtgcgctgttgatatcactgattccacgaacggtgattttcatgccggcatt

SEQ ID NO: 34845 - protein, 120 aa, Panicum virgatum
  misc_feature: Ceres CLONE 1957704
  misc_feature: SWISSPROT Homolog: EC 2.7.7.4 Sulfate adenylyltransferase
LLPLSVLGNVDSGEESPPDRLMIDLEDINFQAIQRVNNYLFDKIYTPFCYAWVLDELEADRDTRVTIGIAVRNFDTTKNYYTYMNPASHCEFNGNPIMMISHPECAVDITDSTNGDFHAG

SEQ ID NO: 34846 - DNA, 605 bp, Panicum virgatum
  misc_feature: Ceres CLONE 1957725
  misc_feature: Encodes the peptide sequence at SEQ ID NO. 34847
ggccgtcggtgcagatcttggtggtagtagcaaatattcaaatgagaactttgaaggccgaaggagcgagcgagcgagcgagaaacaggagcagagaagagagacaccaaagagcagagcacagcaatggcgggggagaagcaggagaagggtcgtctgcagcttctggacttctgggtgagcccgttcgcgcagcgctgccgcatcgcgctggcggagaagggcctgccgtacgagtccctggagcaggacctctccaacaagggcgagctcctcctccgcgccaaccccgtgtacggcaaggtccccgtgctcctccacggcggccgccccgtctgcgagtccctcgtcatcctccactacctcgacgaggcgttcccggacgaggcgccggcgctgctctccgccgacccgcgcgcccgcgcgcacgccaggttatgggcggacttttattcaaatcaataccataaaaaaatttaaagcccattattaaatgctaagaaatcaattacttaattctgtatcgggatttgaggaagatcacaatcgacttaaagggtggacttcgtgtacaccacttgtgaagccggtaagaggaggtcggt

SEQ ID NO: 34847 - protein, 117 aa, Panicum virgatum
  misc_feature: Ceres CLONE 1957725
  misc_feature (9)..(82): Pfam Name: GST_N Pfam Description: Glutathione S-transferase, N-terminal domain
  misc_feature: SWISSPROT Homolog: EC 4.4.1.5 Lactoylglutathione lyase
  misc_feature: Functional homolog of the protein sequence given in SEQ ID NO 51079
  misc_feature: Useful for making plants with modulated drought sensitivity
MAGEKQEKGRLQLLDFWVSPFAQRCRIALAEKGLPYESLEQDLSNKGELLLRANPVYGKVPVLLHGGRPVCESLVILHYLDEAFPDEAPALLSADPRARAHARLWADFYSNQYHKKI

SEQ ID NO: 34848 - DNA, 1140 bp, Panicum virgatum
  misc_feature: Ceres CLONE 1957741
  misc_feature: Encodes the peptide sequence at SEQ ID NO. 34849
ccatcgaggggaatcagcgagagaatgagagattagtgaatccggccgcagagctagctcttgctacgtaattcttgctagatagtaggtagctagcaagcgggggcctcaagtgcaggctagctagccggcggcggcgagccggtgacgatgaagaaggaggacctcgagtcgccgctgctgtccgacggcgatccggcgccggcggactccgagggcggcagcgggtacgcgcttgtctgcgccctcctcgcctccctcacctccatcatcttcggctacaaccgcggcgtgatgagcggggcgcagaagtacgtgcaggaggacctgggcgtcaccgacgggcagctggaggtgctcatcggcgtcaccagcatctactccctcgtcggctcgctggcggcggggtggacctgcgaccgcgcgggccgccgccgcgccgtcgccctctccgcggccatgttcctcgcgggctccgccgtcaccgccgccgccaacgggtacgccgcgctcatggcggggcagctcgtctccggcgtcgcctgcgggttcggactcgtcgtcgcgcccgtctacatcgccgagatcgcgccggcgagctcgcgagggttcctctcctccatccccgagatcgccagcaactcgggcatcctgctcagctacattgccgactttgcgctcgcggacctccccacaacgctcagctggcgcctcatgatcggcatcggcgccgtcccgccgctgttcctcgcggtcgccgcggtgctcgccatgccggagaccccgcgctggctggtcctccacggccgccccgacgaggcccggcgcgtgctggcgcgcatggcggggggcgccgaccgccggctccaggagatcgtggcctccgtccgggaggcgtcgtccaagagcgccggcgagtcgtcgccgggcgtgtggcgcgagatcttgctccgccccacgccggccgtgcggcgcgtgatggtggccatcctcggcctgcaggtgttccagcaggcgtgcggcgtggcggcgatgatcctgtacgcgccgcgggtgttcagccacgtcggcatcacctccgaccgcgcggtgctcggcgccacggtgctcctcggcgccgtcaaagacggtggccatcgt

SEQ ID NO: 34849 - protein, 329 aa, Panicum virgatum
  misc_feature: Ceres CLONE 1957741
  misc_feature (31)..(328): Pfam Name: Sugar_tr Pfam Description: Sugar (and other) transporter
MKKEDLESPLLSDGDPAPADSEGGSGYALVCALLASLTSIIFGYNRGVMSGAQKYVQEDLGVTDGQLEVLIGVTSIYSLVGSLAAGWTCDRAGRRRAVALSAAMFLAGSAVTAAANGYAALMAGQLVSGVACGFGLVVAPVYIAEIAPASSRGFLSSIPEIASNSGILLSYIADFALADLPTTLSWRLMIGIGAVPPLFLAVAAVLAMPETPRWLVLHGRPDEARRVLARMAGGADRRLQEIVASVREASSKSAGESSPGVWREILLRPTPAVRRVMVAILGLQVFQQACGVAAMILYAPRVFSHVGITSDRAVLGATVLLGAVKDGGH

SEQ ID NO: 34850 - DNA, 1212 bp, Panicum virgatum
  misc_feature: Ceres CLONE 1957753
  misc_feature: Encodes the peptide sequence at SEQ ID NO. 34851
gatcatcacttccactccggggggctccccctccttccccttgtcccccgtgactccgcgacggagaagacaaacgatgacgccttccggccaactgctccccttggcccgcccgcctccgccgcctcccgctcctccagtcctctccagccgccgcagccggtgcctgcctcccgcccgcgcgcacgccagaggctcgcctccgcctctatggcgggcccaccgcctccacgaccgcttcctgcatcctcctccgcagttccgcgctccggccagggaccctcgacctccaacgcctccaggcgtttcggccgccggaggaggcgaggctcaggcggcggcggtggcggagttcgtgacgtctgagagggtgaaggtggcggcgatgctggggctggccctcgcgctctgcaacgccgaccgtgtcgtcatgtccgtcgccatcgtgcctctctcccaggcgtacggttggaccccttcatttgccggcgtcgtgcagtcatccttcctttgggggtatctgatgtcgccgataattggtggagcgcttgttgactattatggtggaaagcgagtcatggcttatggtgtagccttatggtccttggctacattcctgtctccttgggcagctggtcgctctatctggttatttctctttactagagttctgctgggtattgcagaaggagtggcactcccaagcatgaacaacatggtgttgaggtggtttcctcacacagaaagatctagtgctgtgggtattgcaatggctggctttcagcttggcaataccattgggttacttctatccccaatcatcatgtcacgaactggaatatttggaccttttgtgatatttggattattcggatttttgtgggtgttggtgtggataccggctatatctggcacacctggtgaacatgcacaaatatcagcatatgaactggagtatataaccaaaggtcagaaattggtgaagcctcaaattggaagtgcaaaaacaaaaaaggtcccccctttcagcaaactactttccaaatggccaacgtgggctttgataagtgcaaatgccatgcatagctggggttatttcgtcattctttcatggatgccagtctatttcaaaacaatatatcatgtcaatctgagagatgctgcatggttcagtgcactcccctgggtgatgatggcagttttaggttatgt

SEQ ID NO: 34851 - protein, 378 aa, Panicum virgatum
  misc_feature: Ceres CLONE 1957753
  misc_feature (105)..(378): Pfam Name: MFS_1 Pfam Description: Major Facilitator Superfamily
MTPSGQLLPLARPPPPPPAPPVLSSRRSRCLPPARAHARGSPPPLWRAHRLHDRFLHPPPQFRAPARDPRPPTPPGVSAAGGGEAQAAAVAEFVTSERVKVAAMLGLALALCNADRVVMSVAIVPLSQAYGWTPSFAGVVQSSFLWGYLMSPIIGGALVDYYGGKRVMAYGVALWSLATFLSPWAAGRSIWLFLFTRVLLGIAEGVALPSMNNMVLRWFPHTERSSAVGIAMAGFQLGNTIGLLLSPIIMSRTGIFGPFVIFGLFGFLWVLVWIPAISGTPGEHAQISAYELEYITKGQKLVKPQIGSAKTKKVPPFSKLLSKWPTWALISANAMHSWGYFVILSWMPVYFKTIYHVNLRDAAWFSALPWVMMAVLGY

SEQ ID NO: 34852 - DNA, 631 bp, Panicum virgatum
  misc_feature: Ceres CLONE 1957753-R
gtaaatctacaggagatgcccccacaatatgctggagtcctacatggaatgtcaaatacagctgggacatttgccgccattttaggaactgttggagcagggttttttgttgatcggatgggttctttccgtggatttttgatattgacgtcgctcctatacttcagcagtactcttttctgggatatatttgctactggagagcgtgttgattttgatggcactggctagcattgattttgatggtactggctagcacctgagaggaacttcacagtttctatcgagcacaaaatgaggattctggacggtgctttactgccctctctgcgaaacctcaagttctatgcacatgaggatgaagagcttaagttatgactgtacaacattgtgttttgacttttcaaagtatccaatgattttatcttggaaagtcagatatcagtggtgggtgaacacatggaactggctttgaagatcatgctagattttcttgcagggtaacctcggacctcggaatgtgttttgagtcaatgaaacctgaatatgtaacttagaataaataacagggtaggagctcgaccattcatggcacccaaagtagtagagatctgaaacaaatttgcaggcc

SEQ ID NO: 34853 - DNA, 574 bp, Panicum virgatum
  misc_feature: Ceres CLONE 1957769
  misc_feature: Encodes the peptide sequence at SEQ ID NO. 34854
cccgagacagccgctcctccgccggcctcctcctcccacctcctcgcggctcgcggcgcggccatccatcccacccccggaacacacccccgaccactggcacctcgcgccacggccccccgaccaccgccaccgccgcctttgactcgttgaccgacaagtgtgagcgccgccggccatggatgcgcgccgcaagctggggcagcagggcgccgccgcggtgccggcggcggcggcccggctgccgagggtgcaggccggggacgcgctgccgctgccgatccggcacaccaacctcatcttctcggccctgttcgcggtctcgctcgcctacctgatgcgccgctggcgcgagaagatccgcagctccacgccgctccacgccgtggggctcgccgagatgctcgccatcttcgggctcatcgcctcgctcatctacctcctcagtttcttcggcatcgccttcgtgcagtccatcgtctcctccagcgacgaggacgaggacttcctcggcgtcggggccggggctccggcgccccccgccgcggcgccgcccgccccgtgcgcgctgctg

SEQ ID NO: 34854 - protein, 131 aa, Panicum virgatum
  misc_feature: Ceres CLONE 1957769
  misc_feature: SWISSPROT Homolog: EC 1.1.1.34 Hydroxymethylglutaryl-CoA reductase (NADPH)
MDARRKLGQQGAAAVPAAAARLPRVQAGDALPLPIRHTNLIFSALFAVSLAYLMRRWREKIRSSTPLHAVGLAEMLAIFGLIASLIYLLSFFGIAFVQSIVSSSDEDEDFLGVGAGAPAPPAAAPPAPCAL

SEQ ID NO: 34855 - DNA, 576 bp, Panicum virgatum
  misc_feature: Ceres CLONE 1957804-R
  misc_feature: Encodes the peptide sequence at SEQ ID NO. 34856
cgcgtccccggagcatggcgctggagccatcgatgaggagatgaagaggaaggagttcgaagcgcgcgccaaggtctgggaagagtccaagaagtgtaaactcgcctcaagataccagaggaaggaggtgaagatacaggagtgggagagctgccagaaatccaaatttgaagccaaattgaggcaggctgaggcgcgggctgagcggatgaaagcccgggcgaagcaggacctggccaagagcctgtcctccctgagccagaaggtggagggcaagcaggcgagggtggaggctcgccggagccggcaggcgacacggctggcgcgggaggtggagcgcatccgcaagaccggccgggagccgtgcaggctccggcggtgctgcacctggttcatgctgtgatcggcgtggggcttcctctcgttgctgcacctcaactgaagcctgaaggtctcaaatgcatgtttcaggacaggaaaatatcatggcatcagctatgtacatgaaaccatcgccaaatctatgaaaccgtcgccaaatctatctgagcctgtgcttctgcacaatgagcaatc

SEQ ID NO: 34856 - protein, 133 aa, Panicum virgatum
  misc_feature: Ceres CLONE 1957804-R
  misc_feature (14)..(125): Pfam Name: Remorin_C Pfam Description: Remorin, C-terminal region
ASPEHGAGAIDEEMKRKEFEARAKVWEESKKCKLASRYQRKEVKIQEWESCQKSKFEAKLRQAEARAERMKARAKQDLAKSLSSLSQKVEGKQARVEARRSRQATRLAREVERIRKTGREPCRLRRCCTWFML

SEQ ID NO: 34857 - DNA, 875 bp, Panicum virgatum
  misc_feature: Ceres CLONE 1957804
acagtagcagttaaatatactcctacatttacagctttccatgattctctctgatcaattgcttccaatgtctcggtaactgcttgtttgaccacataaagaattggcagtgattagtatggatattagcgtcacctcctgagtattaaaatccttgttcttgcgcgatcgatcttggtgcagatgggggtcatatctccaaccaagctcaggatgaagctgctgggctcccatggcggcggcggcggcggcaacaaggacgaggccactcgcaagtcgccgcgggcgtcgccgtcgaggctcgacgacgccgacgacgccgaccaccccaagaacagcctcctggcgcaggagctcgacgaagagtaccccaaggaccggtcggattcgtcccggtcgcgctccgacgccagccacggcagggctgcgcgcagcggcggcgggagtgacagcggggccgagaacggcggcgccggcggcagcttcgagttctacaaggaggagagggcggccctgcagccgccggccgcggcggcggcggccgtctccgggccgttcttccggcagttgccgtccaagtggaacgacrckkagaagtggatcgccgggcggcacgtcgtgcactccaaccccatcttctccaagaagcccgccgccgcgtcgccgcacactcccaccgccgccgccggccgcgtcgcgcccgagtccgcggggtcgatgggcggcgccgccgcttgttgcgacagccagagctcccgcgccggcggcggcagtgctgccgccagcgccctgaccgagctgtcgtccaagtcctcgtcgccgccttcggggagcggggcgggagagaaagccgccccaaaaaacgcccggtttct

SEQ ID NO: 34858 - DNA, 1349 bp, Panicum virgatum
  misc_feature: Ceres CLONE 1957829
  misc_feature: Encodes the peptide sequence at SEQ ID NO. 34859
caagtagcctgaccgcttcttgctgccacctgtgctccgtttccttttctgctcccgggctccctctcctcgagttcttgctcgcctctcttcctcttgggtttggtccaacaagtggagaaaggggcaggatgaagtccggggagcggccgaagctggtgcggggcctccggcaggagtcccggcggttccggctgctggtcatcgtcgtcggcttcttcctcgtctccctcaccttcgtcgtcatctccaggcccgacgccatcctcttcagcctgaacggcaagctgccggtggagcaggcgccgacgtccatcctgatcaagcagaaggtcaattcgccgcccgacacctcccggaagacctcgaccgacgctctccgtggagatcctagagtggtcgacgacgaagccgatgtgagaccaaaaggtaccaaaggcgaggaggagagccgggtgctgagcgagcccgacccgaccagcgggatgacggagctgaccccaaacaaggacgggggcggccgtaaatccgacgwggagacgttaggcggcgaggggaaacgggaggagggggaggagcgtggtcacgcggcggagaagcacaaagtcacgctcccaaccgtttccaattacaccattcatgactccgaggacaccgaaaatggcaagcaagacgacggtacaggttctgacctgcagggaagcaagcccctgtgtgatttctcaaactttagagcaaatgtgtgcgagatgcgtggcgatgttagggttcacccaaacgcgacctcaatcatgttcatggagcctgccggttcgcagagagatgagctctggaagatcaagccgtaccctcggaaaggggacgagttctgcctcagccatatcaccgagctgacagtgaaatcaaacaaagtggccccagagtgcaccaagtaccacgatgtgcctgctgtgatcttttcactgacaggatacacaggaaacctgttccatgatttcaccgacgtgatggtccccattttcacgaccgcaagcgagttcaatggtgaagttcagttcctcataaccgacatggcactttggtggaccatcaagtatcacactgtgctccagaagctgtccaaatacccactgattgatttcagcaaggatgaccaggtgcattgcttcaagcatgtcatcgtcggcctccatgcttacatggagttcacaatcgactcgtccaaggccccgcacaactattccatggtcgacttcaacagattcatgcgcggagcttactcgctgggcagggacaccgttaccgtgcttggagagtaccccaaggtcaagccaagattgctcatcatc

SEQ ID NO: 34859 - protein, 405 aa, Panicum virgatum
  misc_feature: Ceres CLONE 1957829
  misc_feature: Functional homolog of the protein sequence given in SEQ ID NO 51300
  misc_feature: Useful for making plants with altered carbohydrate content
  misc_feature (135)..(135): Xaa is any aa, unknown, or other
MKSGERPKLVRGLRQESRRFRLLVIVVGFFLVSLTFVVISRPDAILFSLNGKLPVEQAPTSILIKQKVNSPPDTSRKTSTDALRGDPRVVDDEADVRPKGTKGEEESRVLSEPDPTSGMTELTPNKDGGGRKSDXETLGGEGKREEGEERGHAAEKHKVTLPTVSNYTIHDSEDTENGKQDDGTGSDLQGSKPLCDFSNFRANVCEMRGDVRVHPNATSIMFMEPAGSQRDELWKIKPYPRKGDEFCLSHITELTVKSNKVAPECTKYHDVPAVIFSLTGYTGNLFHDFTDVMVPIFTTASEFNGEVQFLITDMALWWTIKYHTVLQKLSKYPLIDFSKDDQVHCFKHVIVGLHAYMEFTIDSSKAPHNYSMVDFNRFMRGAYSLGRDTVTVLGEYPKVKPRLLI

SEQ ID NO: 34860 - DNA, 602 bp, Panicum virgatum
  misc_feature: Ceres CLONE 1957829-R
  misc_feature: Encodes the peptide sequence at SEQ ID NO. 34861
tgctcatcatcaagaggcaccgaacgaggagtttcctcaacctcgatgagatcatcgccatggctgaggagctcggctttgaggtggtgatcgatgaggccaatgtgagctctgacatctccaagttcgccaggctggttaacacggtcgacgtgatgatgggagtccatggggctgggctcacaaactgtgtgttcctgccacagaatgccacgctgattcagatcgtgccgtggggagggctggaatgggtatcccgcacagatttcggcaacccagcagagctcatgggcctgcactacaagcaatacagcatcagcgtggacgagagcagcctcgcggagcagtacccacgggaccatgagatcttcaagaaccctattgcattccataagcacgggttcgacttcatcaggcagactttcatggacaagcagaacgtgaagctggattgcaagaggttcaggccgattctcttggaggctttggacaatctcaacccatgaagattgtgatcgattggttgttgggcatggtaatagaggttcttgtacacaatccattttttccttcaccattattcgttcccgtttaattagtac

SEQ ID NO: 34861 - protein, 167 aa, Panicum virgatum
  misc_feature: Ceres CLONE 1957829-R
  misc_feature: Functional homolog of the protein sequence given in SEQ ID NO 51300
  misc_feature: Useful for making plants with altered carbohydrate content
LIIKRHRTRSFLNLDEIIAMAEELGFEVVIDEANVSSDISKFARLVNTVDVMMGVHGAGLTNCVFLPQNATLIQIVPWGGLEWVSRTDFGNPAELMGLHYKQYSISVDESSLAEQYPRDHEIFKNPIAFHKHGFDFIRQTFMDKQNVKLDCKRFRPILLEALDNLNP

SEQ ID NO: 34862 - DNA, 608 bp, Panicum virgatum
  misc_feature: Ceres CLONE 1957835
  misc_feature: Encodes the peptide sequence at SEQ ID NO. 34863
acacaccacacatcgcgccctcgctcgcacttcctccgctcgtcggacatctcctcccgtcctttcgtttcgaagcctcggggatcccagcgatggccgcctccgccaccctggtgtcggtccacgagaagatcgagaagcttcgcagcgaggtcgcctagctcgaccagatcatcgagaacgagaagtccggcttcatcaaccgcgtgtctcgctacctcggtggggaggcggatcagatcgagtggagcaagatccataccccgaccgatgaggtggtggtgccgtaccacaccctcgcgtcgcctcccgaacatctcaaggagacgagtaagctgctggacaagctcgttgtgctcaagcttaatggagggctcggcacgaccatgggctgcactggccccaagtctgtcattgaggtccgcagtgggttcacattccttgaccttattgtgattcaaagtgagtctttgaacaagaagtatggatgcagtgtccctttacttctgatgaactcttttaacactcatgatgacacacaaaagattgttgagaaatatgccaactccaacattgagattcacactttcaatcagagccagtatcct

SEQ ID NO: 34863 - protein, 73 aa, Panicum virgatum
  misc_feature: Ceres CLONE 1957835
  misc_feature: SWISSPROT Homolog: EC 2.7.7.9 UTP--glucose-1-phosphate uridylyltransferase
MGCTGPKSVIEVRSGFTFLDLIVIQSESLNKKYGCSVPLLLMNSFNTHDDTQKIVEKYANSNIEIHTFNQSQY

SEQ ID NO: 34864 - DNA, 582 bp, Panicum virgatum
  misc_feature: Ceres CLONE 1957839
  misc_feature: Encodes the peptide sequence at SEQ ID NO. 34865
aaaactcaactaagcgatccagagtccgacgcagttgcgccacgccggcgatagcagatgaagaagcgcaaggcggcggacggaaccccagaaccgtgccgcgatcggctcagcagcctccccgacgacctgatcgggcgcatcctctccctgctgccgaccccgcaagccgtgctcacgtcccagctgtcgcggcggtggaggcgggcgtgggcacacatcgccgccctgaacctgtccgccgtccgggactgcgcgcggcgcggcagggggccccggctcagcgacctcgccaggggggccctcctccggttcccgacgccgggcatcccctcggtctccgtcgagaccaaccgcagcgtctacaccgccgacgaatggtaccgccaggcgatggagcgcgcggtcggctccgtgcgcgtcgcgtcgccttgcacgctcaacgggctggagctccctccctgcgcgcgggcggaggccctggccgtgcgctcgccgcgcaccgtcctgacgctccccgatccggcggcggcggcgccgttcggcaggctggccgagctgagcctctcgctggtgcagctg

SEQ ID NO: 34865 - protein, 174 aa, Panicum virgatum
  misc_feature: Ceres CLONE 1957839
  misc_feature (16)..(63): Pfam Name: F-box Pfam Description: F-box domain
MKKRKAADGTPEPCRDRLSSLPDDLIGRILSLLPTPQAVLTSQLSRRWRRAWAHIAALNLSAVRDCARRGRGPRLSDLARGALLRFPTPGIPSVSVETNRSVYTADEWYRQAMERAVGSVRVASPCTLNGLELPPCARAEALAVRSPRTVLTLPDPAAAAPFGRLAELSLSLVQ

SEQ ID NO: 34866 - DNA, 613 bp, Panicum virgatum
  misc_feature: Ceres CLONE 1957841
  misc_feature: Encodes the peptide sequence at SEQ ID NO. 34867
atcatcgatcaacacaaccttgccccagccctagcaaggctagaacacagtaaagtctcatcaataattccacacttttctagctagcggcgattactatcagagcaggccgcagaggctgctgcagggagcacagaacagaagtaagcacacacgccaagaaaccaaagcagccaaagacaccggccaggggaggggagcaccgaagctgtagctcatcatggggatggtggagagcatcagccccacggcggcggaggcctccacctcctcgcgctccaccggcgcgtccacggccaccacggagtccggcgccgcgcagccgccgcttgccgcagcgccgggcggcgcggccggcggggaggtggtctcgccggcggacgagcaggccgtcacgccgcagccgtcggcggcggcggcggtgccacaggggtcctcgcggtacaagggcgtcgtgccgcagcccaacggccgctggggcgcgcagatctacgagcgccacgcgcgggtgtggctcggcacgttccccgacgaggaggccgccgcgcgcgcctacgacgtcgccgcgctccgctaccgcggccgcgaggccgccacaaacttcccggggggc

SEQ ID NO: 34867 - protein, 130 aa, Panicum virgatum
  misc_feature: Ceres CLONE 1957841
  misc_feature (73)..(122): Pfam Name: AP2 Pfam Description: AP2 domain
  misc_feature: The sequence is a functional homolog of SEQ ID NO 20 in the 10/838,616 US patent application
  misc_feature: The sequence is a functional homolog of SEQ ID NO 1176 in the 10/374,780 US patent application
  misc_feature: The sequence is a functional homolog of SEQ ID NO 1372 in the 10/412,699 US patent application
  misc_feature: The sequence is a functional homolog of SEQ ID NO 30 in the 10/838,616 US patent application
  misc_feature: The sequence is a functional homolog of SEQ ID NO 732 in the 11/435,388 US patent application
  misc_feature: The sequence is a functional homolog of SEQ ID NO 1185 in the 10/374,780 US patent application
  misc_feature: The sequence is a functional homolog of SEQ ID NO 40 in the 10/838,616 US patent application
  misc_feature: The sequence is a functional homolog of SEQ ID NO 742 in the 11/435,388 US patent application
  misc_feature: The sequence is a functional homolog of SEQ ID NO 38 in the 10/838,616 US patent application
  misc_feature: The sequence is a functional homolog of SEQ ID NO 740 in the 11/435,388 US patent application
  misc_feature: The sequence is a functional homolog of SEQ ID NO 1186 in the 10/374,780 US patent application
  misc_feature: Functional homolog of the protein sequence given in SEQ ID NO 50664
  misc_feature: Useful for making plants with altered lignin content
  misc_feature: Useful for making plants with altered protein content
  misc_feature: Useful for making plants with altered terpenoid content
  misc_feature: The sequence is a functional homolog of SEQ ID NO 50 in the 10/838,616 US patent application
  misc_feature: The sequence is a functional homolog of SEQ ID NO 48 in the 10/838,616 US patent application
  misc_feature: The sequence is a functional homolog of SEQ ID NO 1183 in the 10/374,780 US patent application
  misc_feature: The sequence is a functional homolog of SEQ ID NO 22 in the 10/838,616 US patent application
  misc_feature: The sequence is a functional homolog of SEQ ID NO 756 in the 11/435,388 US patent application
  misc_feature: The sequence is a functional homolog of SEQ ID NO 1179 in the 10/374,780 US patent application
  misc_feature: The sequence is a functional homolog of SEQ ID NO 34 in the 10/838,616 US patent application
  misc_feature: The sequence is a functional homolog of SEQ ID NO 52 in the 10/838,616 US patent application
  misc_feature: The sequence is a functional homolog of SEQ ID NO 736 in the 11/435,388 US patent application
  misc_feature: The sequence is a functional homolog of SEQ ID NO 1892 in the 10/412,699 US patent application
  misc_feature: The sequence is a functional homolog of SEQ ID NO 32 in the 11/375,241 US patent application
  misc_feature: The sequence is a functional homolog of SEQ ID NO 370 in the 10/374,780 US patent application
  misc_feature: The sequence is a functional homolog of SEQ ID NO 420 in the 10/225,066 US patent application
  misc_feature: The sequence is a functional homolog of SEQ ID NO 550 in the 11/435,388 US patent application
  misc_feature: The sequence is a functional homolog of SEQ ID NO 78 in the 10/225,068 US patent application
  misc_feature: The sequence is a functional homolog of SEQ ID NO 8 in the 10/838,616 US patent application
MGMVESISPTAAEASTSSRSTGASTATTESGAAQPPLAAAPGGAAGGEVVSPADEQAVTPQPSAAAAVPQGSSRYKGVVPQPNGRWGAQIYERHARVWLGTFPDEEAAARAYDVAALRYRGREAATNFPG

SEQ ID NO: 34868 - DNA, 1273 bp, Panicum virgatum
  misc_feature: Ceres CLONE 1957888
  misc_feature: Encodes the peptide sequence at SEQ ID NO. 34869
aaccccaccattcactctcgctgcgcgggccacctctttctatataagctttctagtgagccttccaacttacttgttaccacccacaaccacacaatctggtccaccacacccaacagtaaatatgcctggtggaggagccattcctgtcaccggtacctccgatgtcaaccgcgttgaggcgcccgtcacagtccgtgcctacctgattgttgcttttgcagcttttggtggtattttctttggatatgatactggctggatgggcggtgtcctcaacatggactacttcatcaagcaatacactggctacgagtatcccgatatcaagttcccgaatggcactcccgccgaaatcaaggaataccgcaacaagttcttcagtgtttcctcgtcacaacagtctctgaccacttccatcctctccgctggaaccttctttggcgctatcatcgcgggtgatcttgccgacttcatcggtcgccgcatgaccatcattctgggctgcgccatcttctccatcggtggcattctcgagactgcctccactggtctcaacgtcatggttgctggtcgtctcatcgccggtttcggtgttggtttcatctctgccatcgtcattctgtacatgtctgagattgctccacgtaaggtccgcggcgccgtcgttgctggttaccagttctgcatcaccatcggtattctgcttgccaactgcgtcgtctacgcgactcagaagcgccgcgacaccggctcttaccgcatccccatcgcggtgcagtttctctgggctatcattctggccgttggtcttgctctcctgcccgagtctccccgcttctgggtgaagaagggtaagctcgacaaggctgctgctgccctcggtcgcgtccgcggccagcccctcgactctgagtacatccaggacgaactcgccgagatcattgccaaccacgagtatgagatgtccgtcgttccccagaacagctacatcggatcctgggcggcctgcttctcgggatccatccgcagccctgcatccaacaggcgccgtaccgtcgtcggtatttgcatgcagatgatgcagcagctcactggcatcaacttcatcttctacttcggccccgtcttcttccagcagctcggatccatccagaaccccttcctcatctccctggtcaccactcttgtcaacgtccttttcacaccagcctcattcgtcatggtcgagaagatcggtcgccgtccaatcctgatcttcggcgccgcaggc

SEQ ID NO: 34869 - protein, 382 aa, Panicum virgatum
  misc_feature: Ceres CLONE 1957888
  misc_feature (29)..(382): Pfam Name: Sugar_tr Pfam Description: Sugar (and other) transporter
MPGGGAIPVTGTSDVNRVEAPVTVRAYLIVAFAAFGGIFFGYDTGWMGGVLNMDYFIKQYTGYEYPDIKFPNGTPAEIKEYRNKFFSVSSSQQSLTTSILSAGTFFGAIIAGDLADFIGRRMTIILGCAIFSIGGILETASTGLNVMVAGRLIAGFGVGFISAIVILYMSEIAPRKVRGAVVAGYQFCITIGILLANCVVYATQKRRDTGSYRIPIAVQFLWAIILAVGLALLPESPRFWVKKGKLDKAAAALGRVRGQPLDSEYIQDELAEIIANHEYEMSVVPQNSYIGSWAACFSGSIRSPASNRRRTVVGICMQMMQQLTGINFIFYFGPVFFQQLGSIQNPFLISLVTTLVNVLFTPASFVMVEKIGRRPILIFGAA

SEQ ID NO: 34870 - DNA, 590 bp, Panicum virgatum
  misc_feature: Ceres CLONE 1957888-R
tccccctcacaatccgttcgcggggagtcggtctctccacctcgtccaactggttctggaactgcatcatcggagtcatcaccccgtacctcgtcgccgaccgtccggactctgctcgtctcggctctaacgtcttcttcatgtggggtggcctctgctgcatctccttcctgttcgcctacttcctggtccctgagaccaagggccttaccctcgagcaggtcgacaagatgcttgaggagacgtcgccccgcacctcgcgcaagtggaagccgcacagcactttcgcctcggagatgcacctgggtgagaagcacatcactgtgcccgttgccacggagcacgttgcccccaagacggaggcttctgtcgtctaggtctgagtcgtatggggttttgtcgtacaggtaccgacatacaattcccagaacccattgcgttgcttccatacgctctgctatagttatgagtgcatgggaatgcacgaggataatgtttgataatgactgatcatgtccatgctgcttcaagtggcagtctgagacgtcatggaataaatactcgcccaatgataattggttctttcatcc

SEQ ID NO: 34871 - DNA, 616 bp, Panicum virgatum
  misc_feature: Ceres CLONE 1957901
  misc_feature: Encodes the peptide sequence at SEQ ID NO. 34872
actgaagtcgtagttcagacaaaggtgcaaacaatgaagactcggagagttctcacggccattaccatggccgtcttcttcttcttcttctccgccaccgcactaccggcggtggctgcatcggtcatagagcatacctttgttgtaagccagatgaagatgacacacctgtgcaaggagacaccggtcactgttgtgaacgggcagctcccggggccggtgatagatgttactgaagaggattcagtggtcgttcatgtcgtcaacaagtcaccctacaacataacgatccattggcatggagtgaagcagtggctgaactgttgggcggatggggtgccgatgattacccaataccctatccaaccaaaccacaacttcacctaccggctcaacatcactgggcaagaaggcaccttgtggtggcatgctcatgttcccggcttccgagcaactgtgcatggtgccttcatcattcggccaagacatggagctagttcgtatccatttccaaagcccgataaggagattcccgtcatcataggggattggtggaacatggatcttgcactgttggagaagcactttgagaaagaacttgttgatgatcttcctg

SEQ ID NO: 34872 - protein, 183 aa, Panicum virgatum
  misc_feature: Ceres CLONE 1957901
  misc_feature (26)..(142): Pfam Name: Cu-oxidase_3 Pfam Description: Multicopper oxidase
  misc_feature: SWISSPROT Homolog: EC 1.10.3.2 Laccase
  misc_feature: Functional homolog of the protein sequence given in SEQ ID NO 51212
  misc_feature: Useful for making plants with altered cell wall content and/or composition
  misc_feature: Functional homolog of the protein sequence given in SEQ ID NO 50535
  misc_feature: Useful for making plants with altered carbohydrate content
MAVFFFFFSATALPAVAASVIEHTFVVSQMKMTHLCKETPVTVVNGQLPGPVIDVTEEDSVVVHVVNKSPYNITIHWHGVKQWLNCWADGVPMITQYPIQPNHNFTYRLNITGQEGTLWWHAHVPGFRATVHGAFIIRPRHGASSYPFPKPDKEIPVIIGDWWNMDLALLEKHFEKELVDDLP

SEQ ID NO: 34873 - DNA, 658 bp, Panicum virgatum
  misc_feature: Ceres CLONE 1957927
  misc_feature: Encodes the peptide sequence at SEQ ID NO. 34874
attccacatccggccccccacgcatggagtccctggtggcggcgctccccacgggcagcgcggcggcggcggcggccgtcggcgggctgctgacggccgccgcgctcgccgggagggctggcgccaagaacaaccgctccaccgcgcccccagctgttcctggtttaccaattgttggcaatcttcttcagttgaaagaaaagaaaccccaccaaacctttacaaaatgggctgaaatttatgggccaatttacactataaagacaggtgcttcttctgctgttgtgctcaattcaactgaagtagccaaggaggcaatgattgcaaaattctcatccatatctacccgaaagctgtctaaagcattgtcagtgctcactcacgacaaaactatggttgctacaagtgattatggtgacttccacaaaatggtcaagcgttatatcatgacaagcatgctgggtacttctggccagaaaaaattcagggacacaagaaacatgatggttgataacatgctgagcactttccacacattgttaaatgatgatccaaatgctcctttgaattttcgggaagttttcacgaatgagttattcagattatccctgattcaggctttaggtgaggatgttagttcagtctatgtggaagagtt

SEQ ID NO: 34874 - protein, 211 aa, Panicum virgatum
  misc_feature: Ceres CLONE 1957927
  misc_feature: SWISSPROT Homolog: EC 1.14.13.78 Ent-kaurene oxidase
MESLVAALPTGSAAAAAAVGGLLTAAALAGRAGAKNNRSTAPPAVPGLPIVGNLLQLKEKKPHQTFTKWAEIYGPIYTIKTGASSAVVLNSTEVAKEAMIAKFSSISTRKLSKALSVLTHDKTMVATSDYGDFHKMVKRYIMTSMLGTSGQKKFRDTRNMMVDNMLSTFHTLLNDDPNAPLNFREVFTNELFRLSLIQALGEDVSSVYVEE

SEQ ID NO: 34875 - DNA, 1277 bp, Panicum virgatum
  misc_feature: Ceres CLONE 1957935
  misc_feature: Encodes the peptide sequence at SEQ ID NO. 34876
gcccaaaccaccccgaaccggcaaacccacacaaatcctctcctcctcctcgagcagcccagttaatcactgcatcacctcgtctcccctctcgaagaaatagcttccggaccctcctccagcgcgcgaacgaagaggtgaacggcgatccctgggaggatagcaacaatggcagcgaagcggctccacgacgggtacgggcacgacggcgaccagcccgacgacaagcggattcgccgcctgccctccttctcgacggtgatccgggaggcgatgatgcagaagcacttgacgaacctgttcaggattctcgagcccctcctccgccgcgtggtgcaggaggagctccaggcggggctgatgcagagcccgcgctacatcgagaggtccccggcgacgccgcccgccgagcgcccggcgtggaagctggcgttccggaccccgccgcagctgccgatcttcacgggcagcaagatcgaggacgccagcggcgccccgctggagatcgtcctcgtggacacggacacggggtcccccgccgcgctcccgcaggcgctgcgcgtcgagctggtcccgctcttcggggacttcctgcaggacggccgcgaggactgggcccccgaggagttccagaaggagatcgtgaaggagcgcgagggcaagcgcccgctcctcaccggcgacgtcaacctcaccatgcgggagggccgcgccacggtgggcgagctccagttcacggacaactcgtcgtgggtccgctgccgcaagttccgcatcggcgtccgcgtcgtgcccggcagctacgacggcgccaggatccaggaggccatgacggaggccttcgtcgtcagggaccaccgcggcgagctctaccgaaagcactacccccccgtccttggcgacgacgtctggaggctcgagaagatcgggaaggaaggcgcgttccaccggaagctgaggaacaacaacgtcgtcaccgtccaggagttcgtcaggatgctcatggtgaagcccgacgagctgcgcgcgattctgggcgagggcatgaccgaccgcatgtgggaggtgaccacgaaccacgccaggacctgcgaacccgacgacaaggtgtacgtctacgccgggccgcacggcaccatctacgtgaactccgtcttcaagctcgtgagggtcgagatcggcggcgtggagtggccgctgcagcagctgaggggtcatgcgaagatgattgtgcagcagctgatgctggaggcgtacgagcagcgccacagcctcca

SEQ ID NO: 34876 - protein, 369 aa, Panicum virgatum
  misc_feature: Ceres CLONE 1957935
  misc_feature (81)..(369): Pfam Name: Calmodulin_bind Pfam Description: Calmodulin binding protein-like
MAAKRLHDGYGHDGDQPDDKRIRRLPSFSTVIREAMMQKHLTNLFRILEPLLRRVVQEELQAGLMQSPRYIERSPATPPAERPAWKLAFRTPPQLPIFTGSKIEDASGAPLEIVLVDTDTGSPAALPQALRVELVPLFGDFLQDGREDWAPEEFQKEIVKEREGKRPLLTGDVNLTMREGRATVGELQFTDNSSWVRCRKFRIGVRVVPGSYDGARIQEAMTEAFVVRDHRGELYRKHYPPVLGDDVWRLEKIGKEGAFHRKLRNNNVVTVQEFVRMLMVKPDELRAILGEGMTDRMWEVTTNHARTCEPDDKVYVYAGPHGTIYVNSVFKLVRVEIGGVEWPLQQLRGHAKMIVQQLMLEAYEQRHSL

SEQ ID NO: 34877 - DNA, 655 bp, Panicum virgatum
  misc_feature: Ceres CLONE 1957935-R
cgacgacgtggtctcattcccccaagccaacagcttcggctaccagtgccctggccaagtgttccacatgccaggttaagaattgcactgggaaagggccccaaaaattgagatcttcagaaagtaactctagtgaagatcacttgcaaggttccaagcttccagctctaggatgtacattaaccaatacgtctgtctctgtctgtccacggaagtgtgtggtcggtcggtctgctgtgtgttaagtaacggcagggtttaagggtaggtgaacttgagcggcccttccgctgcgtcgctaagcatgcgcccgagcatcggccgcgagcagcgagaagaggcgaccaagtgcaaaaattctttggtttaattcgtatcctttgttgtaaattcctcagtttctcgttctgttctgcctgctggtcgagtagcgctctgctctgagatgttttgctctcaaggagctgcatgtaaatgtaatggaagggcagcgattcttgggcaggagaacgagtgtggtatgcctgcaagggctgtagaacttgtgtaaacagacagttctgctttttttttctttaacattttcacaagttttttgtgtcctgtaaacatcaaggtcgtgataataaaggaaggaagctgcctttttgtacat

SEQ ID NO: 34878 - DNA, 1098 bp, Panicum virgatum
  misc_feature: Ceres CLONE 1957936
  misc_feature: Encodes the peptide sequence at SEQ ID NO. 34879
acctgcctggctgcctcgtctcctcgcagtgcccaggcatctgctgctcctggcaatattgcttgccttcttttgctccgccacggttggtactgctgctgattcctccagtctccacctcaaatcctcctcctcctcttcttcttcgtcctcctcatctccttgcgcggctcttgtgcttcgcctgttcggagcggtcttggcccccgctgcgccaaaatttgattttgttgaggtcttcgggacggaaggttgggtttttggtcgggattattcgtggccacaggtacccgtggcccatttctgcatattggtttccgtctgtgctgtgagtttgctgtgatttctcgccgcttcgctgttgaaccgaagattccatcttcgtttcgtgcaaacaccaaagtggtggaagcagttcttctgggaacacatagctgcttagtggggagatttggctggaagtcttggcgctggctccaatcttgctttgatgcaataatcgaatgtagtgatgccgatgacgatatctgagtttgaatttcgagtgtgagagagcaaacagctgcggaatctgaataccggttcgtaggacaatttccctttcggaggaactgtcgctgaggggaaaagagatcaatggcgtcgctgtcaattggtgaggtgacaaacagggggagcatgtgggagctagatcagaaccttgatcgacccatggatgaggaggcgggcaggctgaagaatatgtacagagaaaagaagttctcatcagctttgttactacggctggcatttcaaagccttggggtggtttttggtgacttgggcacatcacctttatatgtgttctataatatctttcctcgtggagtagataatgatgaggatgttattggagctctttccttgattatttacaccctcactctcattccacttctgaagtatgtttttgttgtcttgagggcaaatgacaacggtcaaggtggtacatttgctctttattccctattgtgccgtcatgcaaagatcaacaccatacctaatcaacacaggactgatgaggaattgacgacatatagtcggcaaacctatgaggag

SEQ ID NO: 34879 - protein, 153 aa, Panicum virgatum
  misc_feature: Ceres CLONE 1957936
  misc_feature: Functional homolog of the protein sequence given in SEQ ID NO 50430
  misc_feature: Useful for making plants with modulated biomass
MASLSIGEVTNRGSMWELDQNLDRPMDEEAGRLKNMYREKKFSSALLLRLAFQSLGVVFGDLGTSPLYVFYNIFPRGVDNDEDVIGALSLIIYTLTLIPLLKYVFVVLRANDNGQGGTFALYSLLCRHAKINTIPNQHRTDEELTTYSRQTYE

SEQ ID NO: 34880 - DNA, 663 bp, Panicum virgatum
  misc_feature: Ceres CLONE 1957953
  misc_feature: Encodes the peptide sequence at SEQ ID NO. 34881
gaatcctcggcaacctccggcacaacaacatcgtcaggctgctctgtttcctgtccagctccgactccaagctcctcgtgtacgactacatggagaacggcagcctggacaagtggctccacggcggcgccctcgtcgccggcgggcaccccatggcgagggcgcgttccgcgcggcgcgagccgctggactggcagacgaggctcagggtggccgtcggcgccgcgcaggggctgtgctacatgcaccacgagtgcgagccgcccatcgttcaccgcgacgtcaagtccagcaacatcctgctggactcggagttccgggccaaggtcgcagacttcgggctggccaggatgctggcgcaggccggggccccggaaacgatgtccggcgtcgccggctcgttcggctacatggctccagagtgtgctttcaccaagaaggtaaacgagaagcttgacgtctacagctttggcgtcgttctcctggagctcaccaccggcaaagaggccaacgacggcggcgggcacggcaacctggcggagtgggcacggcaccactaccagtcaggggggagcatccccgatgccatggacaagagcatcagatacgccgggtactctgacgagatcgaggttgtcttcaggctaggcgtgctgtgcaccg

SEQ ID NO: 34881 - protein, 220 aa, Panicum virgatum
  misc_feature: Ceres CLONE 1957953
  misc_feature (1)..(213): Pfam Name: Pkinase_Tyr Pfam Description: Protein tyrosine kinase
  misc_feature: SWISSPROT Homolog: EC 2.7.11.1 Non-specific serine/threonine protein kinase
ILGNLRHNNIVRLLCFLSSSDSKLLVYDYMENGSLDKWLHGGALVAGGHPMARARSARREPLDWQTRLRVAVGAAQGLCYMHHECEPPIVHRDVKSSNILLDSEFRAKVADFGLARMLAQAGAPETMSGVAGSFGYMAPECAFTKKVNEKLDVYSFGVVLLELTTGKEANDGGGHGNLAEWARHHYQSGGSIPDAMDKSIRYAGYSDEIEVVFRLGVLCT

SEQ ID NO: 34882 - DNA, 695 bp, Panicum virgatum
  misc_feature: Ceres CLONE 1957958
  misc_feature: Encodes the peptide sequence at SEQ ID NO. 34883
agtcaccaggagcttgcattgggagcagcaccaatggcagaccagcactacctcatctacctcggactggctctcgtctccctgctcgccatgctcgccaagcgccggcgctccgcgatggcgctcgagcaaggtctgcggctgccgcccgggccatggcagctgccgatcatcggcagcctgcaccacatggtcggcaagctcccgcaccacgcgatgcgcgacctcgcgcggtgccacgggccgctcatgctgctccggatcggcgaggtgcccacgctggtggtgtcgtcccgggaggcggcgcgggaggtgatgaggacgcacgacgcggtgttcgcgacgcggccgctgagccccaccatgcgggcgctcaccaacggcggccggggcatcatcatggcgccctacggggcccactggcggcagctccgccggatcaccatcaacaagctcctcagcgcgcgccgcgtcctctccttccgcgccgtccgcgaggaggaggtcgccgccatgctgcgcgcgtgcgccgccgcggcgtcgcgctcccgccccgcggacatgcgcgagcagctgtccacgctcatcacggacatcacgatgcgcgccgcgatgggcgaccggttcaaggaccgcgaggccttccagcacgtgctcgaccgcgccatcgtgctcgcggccgggtttcacgcggc

SEQ ID NO: 34883 - protein, 220 aa, Panicum virgatum
  misc_feature: Ceres CLONE 1957958
  misc_feature: SWISSPROT Homolog: EC 1.14.13.68 4-hydroxyphenylacetaldehyde oxime monooxygenase
MADQHYLIYLGLALVSLLAMLAKRRRSAMALEQGLRLPPGPWQLPIIGSLHHMVGKLPHHAMRDLARCHGPLMLLRIGEVPTLVVSSREAAREVMRTHDAVFATRPLSPTMRALTNGGRGIIMAPYGAHWRQLRRITINKLLSARRVLSFRAVREEEVAAMLRACAAAASRSRPADMREQLSTLITDITMRAAMGDRFKDREAFQHVLDRAIVLAAGFHA

SEQ ID NO: 34884 - DNA, 679 bp, Panicum virgatum
  misc_feature: Ceres CLONE 1957981
  misc_feature: Encodes the peptide sequence at SEQ ID NO. 34885
agaagccaccggcaaagagagagcctctgccgattcagtagcaattctctggttggtgttcgtcacttgatctcagctgctgctgctgctgctgctgtgtgtgtgtgtgtgtctgggaagaaacaaggagaggggagagatggcttgccctgcgcagtacatgctctcgtccagcggctgcatcttcctggggagctgcaagcctcagacgagcctcgtccgaggcgccgtcaccggcggcgtcagcggcagcaggccgttcctgctcacctgcagcgcctcgtcgtctccgtccccttcctcgccggtgccggcgcaggaggactccgactgcaacgaggaggagtgcgccccggagaaggaggtcgggagcctgagcgccgagtggctggcggaggagcggacccgggtcgtcggaaccttcccgcccaggaagagagggtggaccggcctcgtcgagaaggacaccgccggccagaccaacatctactccgtcgaggtacgccagccatagacgagataagatagcactagctctgcaactgacgcctggacctgcgcagccgacggtgtacgtggcggagagtgccatcagctccggcacggcgggcacgtcggcggagggggccgagaacacggccgccatcgcggcggggctcgtcctcatcaccgtcgccgc

SEQ ID NO: 34885 - protein, 124 aa, Panicum virgatum
  misc_feature: Ceres CLONE 1957981
  misc_feature: Functional homolog of the protein sequence given in SEQ ID NO 50253
  misc_feature: Useful for making plants with modulated flowering time
MACPAQYMLSSSGCIFLGSCKPQTSLVRGAVTGGVSGSRPFLLTCSASSSPSPSSPVPAQEDSDCNEEECAPEKEVGSLSAEWLAEERTRVVGTFPPRKRGWTGLVEKDTAGQTNIYSVEVRQP

SEQ ID NO: 34886 - DNA, 837 bp, Panicum virgatum
  misc_feature: Ceres CLONE 1957988
  misc_feature: Encodes the peptide sequence at SEQ ID NO. 34887
acccacgtccccaccccaccagcccccgcaattcccgcaggttgcagaagcgcccctcgccggcggctccggcgagcggccacgggcgcgcgcgcgtccccggaggaggcggattccgccctctgccggcgcgccgagtgggtgcggagggcccgcctcgccggcgccggcgatgggcaactcgctggggtgctcggcctccggcgagcggctcgtgtcggcggcgcgcgacggggacgccatcgaggcgcggatgctgctggagctcagcccggcgctcgcgcgctactccaccttcggcggcctcaacaccccgctccacttctccgccgccaagggccacctcgacattgtcycgatgctgttggagaaaggtgctgacgttaacgcgcgcaactactgcggccagactgcattgatgcactcatgtcggcatgggcactgggaggtggttcagatgcttcttctctacagatgcaatgttaccagggcagattacttgagtggccgaacagcattgcattttgccgcacatgatggatttgttcggtgtgtaaggcttttgcttgcagattttgtccctagtgtggccttggaggatattgccacttcggtagtggatggtgattgtcagacaaatggcgggagcagtcccaattcttcattggggcagaagtttaatgaacctgctcgtgtgaggtacataaacaagcctgctgatggtggtgtaacagcacttcacatggcggcattgaacggtcacttagattgcattcagttgttgattgacttgggtgctaatgtctcagccgtcacattcccctatggcactactgc

SEQ ID NO: 34887 - protein, 221 aa, Panicum virgatum
  misc_feature: Ceres CLONE 1957988
  misc_feature (184)..(216): Pfam Name: Ank Pfam Description: Ankyrin repeat
  misc_feature (44)..(76): Pfam Name: Ank Pfam Description: Ankyrin repeat
  misc_feature (77)..(109): Pfam Name: Ank Pfam Description: Ankyrin repeat
  misc_feature: SWISSPROT Homolog: EC 2.4.2.30 NAD(+) ADP-ribosyltransferase
  misc_feature (62)..(62): Xaa is any aa, unknown, or other
MGNSLGCSASGERLVSAARDGDAIEARMLLELSPALARYSTFGGLNTPLHFSAAKGHLDIVXMLLEKGADVNARNYCGQTALMHSCRHGHWEVVQMLLLYRCNVTRADYLSGRTALHFAAHDGFVRCVRLLLADFVPSVALEDIATSVVDGDCQTNGGSSPNSSLGQKFNEPARVRYINKPADGGVTALHMAALNGHLDCIQLLIDLGANVSAVTFPYGTT

SEQ ID NO: 34888 - DNA, 1064 bp, Panicum virgatum
  misc_feature: Ceres CLONE 1957999
  misc_feature: Encodes the peptide sequence at SEQ ID NO. 34889
aaaattacaagcaatttttcctagaaaaatttaatttgagccaaaaaaaaaggatggagttgttttatgtcttgataatttatactacgattggtgcatcttgcttctatttgatcatgtgtgctgatcccaataaaaagggagttggagcttttctcaacagactcttttacgtccaattcccaaagctcttccagaagtttgcacccagatttttgctggatttagtcggaaaaggatttaattacatctgttacacaaatcatccattgatacagatcatgtatttgctgattgtcattggaggctttattttgtatattctcaaaggctttggcgaacattttccaaataaaagattgagtgatattcattattatttggccttcttgatgacaggactggctcttggaatctactataaagtctgcagcgttagtccaggtgttatcacaaaagaaaatatccgctactaccagaaaaaatataataggtttgacggatatctttatgttgataataatacgtgtaaaacttgcaaaatcgtcaagcctgctcgctcaaaacattgccgtatctgtaatgtctgtgttgctaaattcgatcatcattgcgtttgggtgaaacaatgtataggagaaaagaattataaatggtttttgagttttattttgagccattgcattttatgcttctatgccacatatattggagcttgggtgttttatggcagaatggtcgacgataagcttcttgaagtcaattattatatcggtggaagaagtgaacctgttaaaggctccatctttattgctcttcaatatttattccataaatatacagcatttttctttgttgttatcatttgtgctgtgatgggagttaccttgtcaatctttttcgtttatcattgctcaatgatcgctgaaggcgttaccacaaacgaaagaatcaagaagagtgatattaaacatgcccttgagtcagaagtcaaggatattgatcacaaactcgaaagagaaggcgttcaaaaggaagaaaaagactctttggttcaacaaaag

SEQ ID NO: 34889 - protein, 336 aa, Panicum virgatum
  misc_feature: Ceres CLONE 1957999
  misc_feature (151)..(212): Pfam Name: zf-DHHC Pfam Description: DHHC zinc finger domain
MELFYVLIIYTTIGASCFYLIMCADPNKKGVGAFLNRLFYVQFPKLFQKFAPRFLLDLVGKGFNYICYTNHPLIQIMYLLIVIGGFILYILKGFGEHFPNKRLSDIHYYLAFLMTGLALGIYYKVCSVSPGVITKENIRYYQKKYNRFDGYLYVDNNTCKTCKIVKPARSKHCRICNVCVAKFDHHCVWVKQCIGEKNYKWFLSFILSHCILCFYATYIGAWVFYGRMVDDKLLEVNYYIGGRSEPVKGSIFIALQYLFHKYTAFFFVVIICAVMGVTLSIFFVYHCSMIAEGVTTNERIKKSDIKHALESEVKDIDHKLEREGVQKEEKDSLVQQ

SEQ ID NO: 34890 - DNA, 577 bp, Panicum virgatum
  misc_feature: Ceres CLONE 1958004-R
  misc_feature: Encodes the peptide sequence at SEQ ID NO. 34891
tgtagcaactaagtatgcagaaaatgtgtttatacgtaacttatttccactttttcagtcactctcacaagttatgaatgcttctatggaagagctggctcgttgcccaggaattggtgagcggaaggtaaaacgactttacgatactttccatgagccgttcaaacgggtttccacccgcccaaaccttgtagaccctgatactcctgacagagagaaagcatcaggtcaaccttcatcgacgaatgatagatcagaaaacacagcagagaaaccagaggcatccaagaagaaaggtcccgatgtgaggtcggcccttaccgctgcctttgccaagtattcggagaagatgcgcagccagagccgtgacaccgccaacaaggctggtgaaggtggtagcagctcaaacatggaagatgaccagaccaaatactagatcagctgttgtaggatgctaacagtaatgtaccattgccagtctgctctccctgtcaggcagtgattgttgttgtaattgcaaaattttctgctgtatgttttccctgtgttaaccgtcagaaaacatctgtgccctttc

SEQ ID NO: 34891 - protein, 144 aa, Panicum virgatum
  misc_feature: Ceres CLONE 1958004-R
  misc_feature (20)..(49): Pfam Name: HHH Pfam Description: Helix-hairpin-helix motif
VATKYAENVFIRNLFPLFQSLSQVMNASMEELARCPGIGERKVKRLYDTFHEPFKRVSTRPNLVDPDTPDREKASGQPSSTNDRSENTAEKPEASKKKGPDVRSALTAAFAKYSEKMRSQSRDTANKAGEGGSSSNMEDDQTKY

SEQ ID NO: 34892 - DNA, 1273 bp, Panicum virgatum
  misc_feature: Ceres CLONE 1958004
gggtgacagggtcgtcaggctcgtgggtcgcgactccctgtcctcgaacggacacgcctctcggactcccgcgccgccatggacgggggaggagagcagcaggggccgccggagcggcagcccggcaagatcctcatcaagatcccgtcctaccaggaggtcttcggcactggcgcatcctcctcctcctcgacgccgccctcctacaaccctcctctaagcagttccggcgcccccgctgctccatcctcctcttcatcgtcggggtcgttctcgcaagcgttctccttcctcaagtcctccgagttctactcgcctcccccgccgcctccccagcccacctccaccccgaggccgcctcaggctagctcatccgcgccggtagcccagacccagagcaagagcacaattctcgtcagtcataggcagagagggaaccctctgctgaagcacatcaggaatgctaggtgggcgtttgccgatgtcgtaccggactatgtgctcggtcaatcgtcatgtgcgttgtacttgagtatcaggtaccatcttctacatccagattacttgtattatcggataagagaactgcaaaagaatttcasgctgcgtgtcatcttgtgccatattgatgttgaagatgtagtcaagcctctgcatgaaattacaagaacagcattgcttcatgactgcaccctcctgtgcggttggaggtattattctgtggcttcctaatgtgcttggattaagtaatattcttgttcatattctctgtgctatatcatgtgtttttgtatcagttctacggaatgtgaatttagttctgcgatgcgatcacctcgtactggatcttatgtattgtggtattgccaatgaagtacagttctgttcaagaaaatttagcatcttatgtattgtggtatttagcatctcaatattgaaatttgaaacagttgcacacatttattttcatttatctaagaatgaatttaacggcctccatcacacaaatcggggagtttttagaacaacatattgatgtactggtgatgtactggaacattgcgtgatgaatcaatgatgcaacaatatgcttgtaaagacgaaagagtaagttgtctgagcaaactgttctctcgtagcctggaggaatgtggtcggtacttggagactatcaaagtgtacgaaaacaagccagctgacaatatccgtgagcacatggataatgactatttatcacggttgacacatgcacttacatccattaggcatgtta

SEQ ID NO: 34893 - DNA, 617 bp, Panicum virgatum
  misc_feature: Ceres CLONE 1958030
  misc_feature: Encodes the peptide sequence at SEQ ID NO. 34894
atcgattgagaggagaggagaggcccagccgcggtcggagatgggcggcgcggcggcggggaccaagtggatccaccacatccagcgcctcagcgcggccaaggtgtcaacggaggcggtggagcgggggcagagccgggtcatcgacgcctccctcaccctcatccgtgagcgggcaaagctcaaggcagagttgctgcgtgctctgggtggcgtgaaagcttcagcgtcacttttaggggtccctcttggtcacaactcatcctttctacaaggccctgcatttgctcctccccgcataagggaggccatttggtgtggaagcacaaactctagcacagaagaaggcaaagaattgaatgatcctcgggtgctaactgatgttggtgatgtccccattcaagagatccgtgactgtggtgtcgaagatgacagattgatgcatgtaattagtgagtctgtcaaaacagtgatggaggaggagcctcttcgaccgttggtgttaggaggcgatcactcaatatcctatccagtggttagagctgtgtctgaaaagcttggaggacctgttgacattcttcatcttgacgcacatccagatatctatgattgttttg

SEQ ID NO: 34894 - protein, 192 aa, Panicum virgatum
  misc_feature: Ceres CLONE 1958030
  misc_feature (59)..(192): Pfam Name: Arginase Pfam Description: Arginase family
  misc_feature: SWISSPROT Homolog: EC 3.5.3.1 Arginase
MGGAAAGTKWIHHIQRLSAAKVSTEAVERGQSRVIDASLTLIRERAKLKAELLRALGGVKASASLLGVPLGHNSSFLQGPAFAPPRIREAIWCGSTNSSTEEGKELNDPRVLTDVGDVPIQEIRDCGVEDDRLMHVISESVKTVMEEEPLRPLVLGGDHSISYPVVRAVSEKLGGPVDILHLDAHPDIYDCF

SEQ ID NO: 34895 - DNA, 1055 bp, Panicum virgatum
  misc_feature: Ceres CLONE 1958045
  misc_feature: Encodes the peptide sequence at SEQ ID NO. 34896
gattttcttgctccaagagggggttgcagccagtgataatggatcctccccttgccatcccaactccgcctcctgctcagaatcctcccacaacttctcaggtgtccagacctgaagaaaaaccttttttagatcaaatcagagctcagctggatgaagaattagcaatcaaagttggagggcttacgacgagcgaaattttatgttgggaaattgaagactttgctcaattcaacattcccatagaagtggctcaagtcatcatcaacgccagacctgtagctcaaacccaagtaggacctgtttcgctgaaaaaagaacaagaggaaattgttcaaaggttctacatcgataaccaagaaaaggtcacagaattatcccaaagccaaaaggattatatcacgaaacaactccagcgaggggctcctgctcaagagatttcgatagaattagggtacccactccatctggttcaagcactttgttcagatccaaatgacccttacaagaaatggtccattccttcccaaaatcttaagcacttaggccatcttgcaaggggagcctttggaaaggtagataagtatgaatatgaatatgctgaaaaccaaacagaaactgtggctgtgaaaagtattagggctaagaagtcaactggtgaccagagccttgaaatatcgattctttgtcgactcggaagccatccaaatattgttgagtttgttggattctgtggactatggattgttctagaattttcagaacttgggacccttaagagctatctgttgaacaccgagaacgacatctccgatcctcttcaattgtctctggcttttgatcttgcgaaaggactttcctttttacattcttcggatgttcttcatcgagatcttaaaccagaaaacgttcttttatttcaagttaaagacggaattcgagcgaaaattacagatttgggactttcaacaacccttgaagagggccaacccctaggacagcatggaacactctgttggagagctccggaatcttttcgagtgggtaatcggtat

SEQ ID NO: 34896 - protein, 338 aa, Panicum virgatum
  misc_feature: Ceres CLONE 1958045
  misc_feature (166)..(338): Pfam Name: Pkinase_Tyr Pfam Description: Protein tyrosine kinase
  misc_feature: SWISSPROT Homolog: EC 2.7.10.2 Non-specific protein-tyrosine kinase
MDPPLAIPTPPPAQNPPTTSQVSRPEEKPFLDQIRAQLDEELAIKVGGLTTSEILCWEIEDFAQFNIPIEVAQVIINARPVAQTQVGPVSLKKEQEEIVQRFYIDNQEKVTELSQSQKDYITKQLQRGAPAQEISIELGYPLHLVQALCSDPNDPYKKWSIPSQNLKHLGHLARGAFGKVDKYEYEYAENQTETVAVKSIRAKKSTGDQSLEISILCRLGSHPNIVEFVGFCGLWIVLEFSELGTLKSYLLNTENDISDPLQLSLAFDLAKGLSFLHSSDVLHRDLKPENVLLFQVKDGIRAKITDLGLSTTLEEGQPLGQHGTLCWRAPESFRVGNR

SEQ ID NO: 34897 - DNA, 632 bp, Panicum virgatum
  misc_feature: Ceres CLONE 1958050
  misc_feature: Encodes the peptide sequence at SEQ ID NO. 34898
cagctatgctacaggttattcttgggtatgggatcatttcttcagccagattgagcctattgctgccaataccccctaccatgtctgtattggaaatcatgagtatgattggccatcacaaccttggaaaccatggtgggctacatatggaaaggacggtgggggtgaatgtggaataccatacactgtcaagttcacaatgcctggcaattcagttctacctactggtaatggtggtccagacaccatcaatctttattactcctttgattcaggtgtggtgcatttcgtgtacatgtcaactgaaactaattttcttcagggcactgaccattacaacttcttaatagcggaccttgacaaggtgaaccgaactaaaacaccattcattgtttttcagggccaccgtcccatgtacacctcaagtgatgaaaccagggatgctgctttgaaacagcacatgctccagaatttggaaccactgctggtgacatacaatgtgacccttgcactctggggacatgtccacaggtatgagaggttctgccccatgaagaacttccactgtgttaacacttcgtcaagcttcctataccctgccgcccctgtgcatcttgtgatcgggatgggtg

SEQ ID NO: 34898 - protein, 210 aa, Panicum virgatum
  misc_feature: Ceres CLONE 1958050
  misc_feature: SWISSPROT Homolog: EC 3.1.3.2 Acid phosphatase
SYATGYSWVWDHFFSQIEPIAANTPYHVCIGNHEYDWPSQPWKPWWATYGKDGGGECGIPYTVKFTMPGNSVLPTGNGGPDTINLYYSFDSGVVHFVYMSTETNFLQGTDHYNFLIADLDKVNRTKTPFIVFQGHRPMYTSSDETRDAALKQHMLQNLEPLLVTYNVTLALWGHVHRYERFCPMKNFHCVNTSSSFLYPAAPVHLVIGMG

SEQ ID NO: 34899 - DNA, 673 bp, Panicum virgatum
  misc_feature: Ceres CLONE 1958055
  misc_feature: Encodes the peptide sequence at SEQ ID NO. 34900
attcccatccggcacagccacgaaaacaacagtcgccggcacgctcgccgtccgccgcacagagagggaggggcaagaagctcgtcgcaagaggtagggtagggagggggcagcaatggcggagtaccagggggagtacgggcacccgtacccgcgcgtcctctcgccgcgggtcgcagcagccgccgccggggaggccgagcacgccgttcagcagcacagcgagcgcatctcagggagtgctggtgatgtgttaaaagataatcctgtggggaggttgaaggttttcatttatgacttgccgaggaagtacaacaagaagatggtcaccaaggatccacggtgcctcaatcacatgtttgctgcagaaattttcatgcatcgtttcttgctctcaagtgctgtgcggactctaaatcccaaggaggcggactggttctatacgccagtttatactacttgtgatttaactaatgctggactgcccttgccatttaagtcaccacgggtgatgaggagtgcaatccagtatatttcaaacaaatggcccttctggaacagaactgatggagcagatcacttctttgttgttccgcatgattttgcagcatgcttccactaccaagaagaaaaggctattgagcgtggaattcttccattgctgcgacgtgct

SEQ ID NO: 34900 - protein, 185 aa, Panicum virgatum
  misc_feature: Ceres CLONE 1958055
  misc_feature: Functional homolog of the protein sequence given in SEQ ID NO 50624
  misc_feature: Useful for making plants with altered carbohydrate content
  misc_feature: Functional homolog of the protein sequence given in SEQ ID NO 50682
  misc_feature: Useful for making plants with altered cell wall content and/or composition
MAEYQGEYGHPYPRVLSPRVAAAAAGEAEHAVQQHSERISGSAGDVLKDNPVGRLKVFIYDLPRKYNKKMVTKDPRCLNHMFAAEIFMHRFLLSSAVRTLNPKEADWFYTPVYTTCDLTNAGLPLPFKSPRVMRSAIQYISNKWPFWNRTDGADHFFVVPHDFAACFHYQEEKAIERGILPLLRR

SEQ ID NO: 34901 - DNA, 662 bp, Panicum virgatum
  misc_feature: Ceres CLONE 1958079
  misc_feature: Encodes the peptide sequence at SEQ ID NO. 34902
ctctattttgatgtatatgtggatagctcgtcagtgacgaaagatcttgatctctccactaagagttttggtaacttggcagtgccattttacatggatgttgtcttgccatcaagtgacccatctggtaagctcagcgtcagcattgggccttctagcttaaagaatgtggcaccggatggcatcttgaatggcctagagatcatgaagatgaacattagttccgggtctgttgtcgttgtggcaccaccgccagtggcaaagcgtcatcttgctgtcatattgggctctgttcttggaggtgttgctgctgtcatcattggtactgttctctgcatctgctgcagaagaaagaagaagccacgtacaccactgacaagccggccctcaagttcttggacacccctcaacggtcttagcttccttaccacaggtagccgaacaaccagcaggaccactcttacatctggaactagcggtgacaccagctacaggattccatttgttgtgctgcaagatgcgacaaaccactttgatgagcagatggtcattggagttggaggctttgggaaggtctacagagcagtgatgcacgatggcagcaaacttgcagtaaagcggggcaaccagaaatctcaccaagggttgagggagttccggac

SEQ ID NO: 34902 - protein, 220 aa, Panicum virgatum
  misc_feature: Ceres CLONE 1958079
  misc_feature: SWISSPROT Homolog: EC 2.7.11.1 Non-specific serine/threonine protein kinase
LYFDVYVDSSSVTKDLDLSTKSFGNLAVPFYMDVVLPSSDPSGKLSVSIGPSSLKNVAPDGILNGLEIMKMNISSGSVVVVAPPPVAKRHLAVILGSVLGGVAAVIIGTVLCICCRRKKKPRTPLTSRPSSSWTPLNGLSFLTTGSRTTSRTTLTSGTSGDTSYRIPFVVLQDATNHFDEQMVIGVGGFGKVYRAVMHDGSKLAVKRGNQKSHQGLREFR

SEQ ID NO: 34903 - DNA, 667 bp, Panicum virgatum
  misc_feature: Ceres CLONE 1958085
  misc_feature: Encodes the peptide sequence at SEQ ID NO. 34904
acctgcgttcgtcttatacctggggaggcgagctcaccctagcgtcctagcgagcagcgcttcgtgctcgtgcgtgcgtgcgtgcggcacaatgggcgcaggcgacgggaggacggaggcgatcatgcgcgagatcgcgagcctgcgcgcccagagggacgagctggacagccgcatccgcttcttcgagtcccagctccgcgtcggcggcgctgcgccgaccacgctccctcccagcctctccaccaagctggacgccatgggcgtgcatgcagccgccgccgggggcggcctcagccccgacatggtccggcgctacagccgccacctccttctccccgactttggcgtgcaagggcaacggaggctctcccggtcatctgttctggtggtcggagccggagggctgggctcggccgtagccctgtatctggctgcatgtggcgttggttccttaggcattgctgatggagaaaacgttgaactcagcgatctccatggacaggttatacacgtagaagcatatgttgggcagccaaaagtgaaatcagcagcgtctgcttgccgggcgattaattcctctatcaagttgttcgaccatcatctcaaactgaagtccaaaaatgctttggatgttgtgagacaatatgacatagtagttgatgcg

SEQ ID NO: 34904 - protein, 191 aa, Panicum virgatum
  misc_feature: Ceres CLONE 1958085
  misc_feature (94)..(190): Pfam Name: ThiF Pfam Description: ThiF family
MGAGDGRTEAIMREIASLRAQRDELDSRIRFFESQLRVGGAAPTTLPPSLSTKLDAMGVHAAAAGGGLSPDMVRRYSRHLLLPDFGVQGQRRLSRSSVLVVGAGGLGSAVALYLAACGVGSLGIADGENVELSDLHGQVIHVEAYVGQPKVKSAASACRAINSSIKLFDHHLKLKSKNALDVVRQYDIVVD

SEQ ID NO: 34905 - DNA, 1177 bp, Panicum virgatum
  misc_feature: Ceres CLONE 1958087
  misc_feature: Encodes the peptide sequence at SEQ ID NO. 34906
cccccttgcccttctgtcatccgactctcgggagcctcgccgccgccgccgctgccgcctccttgcgccatggcggagaagtcaccggcggccgacgtggaggccggactcctcgcccacctcaactccacgggcgaggtccccgactcccgctccttcgcctcttccctcggcgtatctcacctcgagcttgagggcgtcatcaagagtctctcagctttccgcatcgtcgacaccaccgacatcatcaaggaaacatgggtgctcaccgacgaggccaagggctatgccgccaggggatcccccgaggcgcagctcgtcgccgccatcccaccggagggcgcctccaaggatgcactcaaagcgaaattgggggatgccttcgatgtcagcatgaaggcagctgcgcggaacaaatggatagggtttgagaagggcaacaaggatttggtcctcaggaaggttgacaacgtcaaggatgagttgcaagagcagcttaaaaagctagagaaaggggaggttgttcctgataaagtgattgatgatttgaagagaaggaagcttattacgaaagagaaatcaatttggtactcactaaagaaagggcctgagtttgttgtaaagagaaaaactttggcaactgatgtgacaacagaacaccttaggagtggtgactggaaggaccttgaattcaaagactacaattatggagctcagggacaacctatagccaaaggttatgtgcagcctttgatggaggttcgtgaggcaatcgagaacatctttattatgatgggattcacagagatgccaaccaacaattttgttgaaagcagcttctggaatttcgatgcactgttccagccacaacagcatccttctcgggattcacatgacacctttttcctgaaagcccctgcagcaacgagtcacttgcctgaggactatctagagaaagtaaagcaagttcatcagtttggtggttatggctctaaaggatatggttatgactggaagcgggatgaagcagagaaaaatcttcttcgtactcatacaactgctgtttccacgagaatgttatacaagcttgctcaagagaaaccttttgcccccaagagatattactccattgatcgagttttccgtaatgaaagctgttgaccggactcatcttgct

SEQ ID NO: 34906 - protein, 363 aa, Panicum virgatum
  misc_feature: Ceres CLONE 1958087
  misc_feature (210)..(363): Pfam Name: tRNA-synt_2d Pfam Description: tRNA synthetases class II core domain (F)
  misc_feature: SWISSPROT Homolog: EC 6.1.1.20 Phenylalanine--tRNA ligase
MAEKSPAADVEAGLLAHLNSTGEVPDSRSFASSLGVSHLELEGVIKSLSAFRIVDTTDIIKETWVLTDEAKGYAARGSPEAQLVAAIPPEGASKDALKAKLGDAFDVSMKAAARNKWIGFEKGNKDLVLRKVDNVKDELQEQLKKLEKGEVVPDKVIDDLKRRKLITKEKSIWYSLKKGPEFVVKRKTLATDVTTEHLRSGDWKDLEFKDYNYGAQGQPIAKGYVQPLMEVREAIENIFIMMGFTEMPTNNFVESSFWNFDALFQPQQHPSRDSHDTFFLKAPAATSHLPEDYLEKVKQVHQFGGYGSKGYGYDWKRDEAEKNLLRTHTTAVSTRMLYKLAQEKPFAPKRYYSIDRVFRNESC

SEQ ID NO: 34907 - DNA, 1294 bp, Panicum virgatum
  misc_feature: Ceres CLONE 1958089
  misc_feature: Encodes the peptide sequence at SEQ ID NO. 34908
gcccacacacggaccattggcctcggaccagccgagcgttccggctccccacgaggccacgacccaccgatccccttgtccttccgattcaggcaggaaccctaggcggcggcgtcccgcagcccggcgaggcagcgacggccgacgagcgctagccgctagacgcccgggccggccgcctcccgcggctcgcgcgccgcgcaggggctccgcagcggcactgcggcagacgcgtggctccgccatgcgccggcgcaagcgctggcagcgcggcagcgggctcggctggctgcggcaccggcatccgagcagcaagacagcaagcaatcgccaatcgagccagtgatattgaacatccaagataccagcaaggaccccttcgccaacggtctcaagcacgcgggggacgcaaagttcactggctccatgatcgatctaacaagaaacgaccgtgctcttccaagcaacagcagccttggtcgggtgtggtacgggaacccagtgctgctctgggacgccgccaccggtgagctagcaagcttcaacaccgtcttctcctttatgatctttcaggatactcaatataagaagaatccggatgggactttcaacgctggcgatgggatggccttcttcctcgcgagctactcggacagcagcgtcctgggcaacagcggcggcgggggtgggaacctcggcctcttcaatgacaccaaccacttcaacgccaccggtgacagtcgggtcgttgccgtcgagttcgatacgttccttaatccgcaatgggataatagctctcagcacgttggcatcgacatcaactccatcatgtcggtggcgtccgaatacacggatccctatgattcgcccggacacaagaacctcacgtcagatctctggctgaccgccacggtcaaatacgataacaagacgaagctgttaaccgtcgatctggatatcgaaggttacctataccacgtcaaccataccgctgacctgaagttgttcttgccggagcaggtggctgtcggcttctctgcggcaaccggcgcatcaggcgagctgcaccgggtacaggcatggtcgttcaattccacacttgaaaagaaggtcactccgataggtagtactagtatgtcacctgcaccttcatcccgaccacttgtagcaccagaaattacatcggagccgtcgccaaagttggtactcaaggtgctggttcctgtacttgctgtctcagtctgtggaattatgggtcttctcctgtggcagaagcgcagaagaaacgaagccc

SEQ ID NO: 34908 - protein, 289 aa, Panicum virgatum
  misc_feature: Ceres CLONE 1958089
  misc_feature (2)..(222): Pfam Name: Lectin_legB Pfam Description: Legume lectin domain
MIDLTRNDRALPSNSSLGRVWYGNPVLLWDAATGELASFNTVFSFMIFQDTQYKKNPDGTFNAGDGMAFFLASYSDSSVLGNSGGGGGNLGLFNDTNHFNATGDSRVVAVEFDTFLNPQWDNSSQHVGIDINSIMSVASEYTDPYDSPGHKNLTSDLWLTATVKYDNKTKLLTVDLDIEGYLYHVNHTADLKLFLPEQVAVGFSAATGASGELHRVQAWSFNSTLEKKVTPIGSTSMSPAPSSRPLVAPEITSEPSPKLVLKVLVPVLAVSVCGIMGLLLWQKRRRNEA

SEQ ID NO: 34909 - DNA, 635 bp, Panicum virgatum
  misc_feature: Ceres CLONE 1958089-R
  misc_feature: Encodes the peptide sequence at SEQ ID NO. 34910
ggggtacatagatccagagttcgtccacacaagccggcggtgcacccagtcggatgtctacagcttcgacatcgtcctgcttgagattgcctccggccgaccaccctgggacaggtgggatccgtccttcatgctgatgaagtgggtttggagtctgtatatcgagggcaacatccttgatgcggcggacgcgcggctgaggacgggcgacgaggccgtggagcggcatatggagcgtgctctggtcgtggggctctggtgcacgctccgcgagccagagcaccggccatcggttgcggacgccttgcacatcctgcagtccgaggacaagctgccagaccttcccctgcagatgtacaagatggcagcagcgccgagctttgctgtgggcgagcgcggagtctctggcagctcctactccagcggcggccgctcttcggctaccaccggcgcgactggatcttccgaatcgtctgccaattgattggatttaccccccattccatggttatcgttgtgcctggtgaccatggttttttactgtgtacgttagaatatcactgtaatttgtgatgactttaagctaaacggagttaatgccttattcccatatccactgaatctctatttacatc

SEQ ID NO: 34910 - protein, 160 aa, Panicum virgatum
  misc_feature: Ceres CLONE 1958089-R
  misc_feature: SWISSPROT Homolog: EC 2.7.11.1 Non-specific serine/threonine protein kinase
GYIDPEFVHTSRRCTQSDVYSFDIVLLEIASGRPPWDRWDPSFMLMKWVWSLYIEGNILDAADARLRTGDEAVERHMERALVVGLWCTLREPEHRPSVADALHILQSEDKLPDLPLQMYKMAAAPSFAVGERGVSGSSYSSGGRSSATTGATGSSESSAN

SEQ ID NO: 34911 - DNA, 525 bp, Panicum virgatum
  misc_feature: Ceres CLONE 1958091
  misc_feature: Encodes the peptide sequence at SEQ ID NO. 34912
gtcaggctaaaaagagacgctcgtctcgtcacgtccgccgccatggctctgggccggggtgctgctcgccgccgccgacgccgccgctgccgccttcctcctgctcctcgccgacgcctctgcggatcccgacatgtccatcatctcctacaacgaggagcacggcgcgcgggggctggaccggacggaggccgaggtgcgagctatgtaccacctctggctcgccgagcacggccgggcctacaacgcgctcggtgagcactaccgccgcttccgcgtcttctgggacaacctcctcttcgtcgacgcgcacaacgcccgcgctgccgaccaccggtaccgcctccgcatgaaccatttcgccgatctgaccaacgacgagttccgcgccgcctacctccgcgccagcctccccgcccggagcgaccgcgtggtcggggagaagtaccgccacgacggcttctaggcgctgccggaggccgtcgactggatgacctagggcgccgttgctcccgtcaacaacca

SEQ ID NO: 34912 - protein, 110 aa, Panicum virgatum
  misc_feature: Ceres CLONE 1958091
  misc_feature (26)..(84): Pfam Name: Inhibitor_I29 Pfam Description: Cathepsin propeptide inhibitor domain (I29)
  misc_feature: SWISSPROT Homolog: EC 3.4.22.14 Actinidain
MSIISYNEEHGARGLDRTEAEVRAMYHLWLAEHGRAYNALGEHYRRFRVFWDNLLFVDAHNARAADHRYRLRMNHFADLTNDEFRAAYLRASLPARSDRVVGEKYRHDGF

SEQ ID NO: 34913 - DNA, 679 bp, Panicum virgatum
  misc_feature: Ceres CLONE 1958095
  misc_feature: Encodes the peptide sequence at SEQ ID NO. 34914
gtggaacgcgaggacaaccccaagtcatctccattatccctcttgtcaggcgtggccgagtgagtgagcagctttgcttctcccatctccggcgctccggcggtcctgatcctgaacccagcagggctgatcagaaagtgccgcgctttgtttccgtcaggtggttggtgcgcgacctgagagcacatcagaagatggccggagcagcggcggtcgacgtgccggcgatggcggcgaccaacggagggtcgtgttgccacgccgccaaggggcccgggtacgcgacgccgctggaggctatggagaagggccccagggagaagctcatctacgtcacctgcgtctacaacggtactggaattaacaagccggattaccttgcgacggtggatttggaccccaactctcctacatactcccaggtgatccacaggctcccggtgacccacatcggcgacgagcttcatcactctggctggaactcttgcagctcctgccatggtgatccatcagcgaaacgtcgcttcttgatcctgccttcattgctgtcagggcgtgtgtatgtcgttgatacggcgacagacccaagggcgccatccttgcataaggtggtcgaggctgaggacattgctgagaagaccgggcttgggtttcctcacacctctcattgccttgcatc

SEQ ID NO: 34914 - protein, 161 aa, Panicum virgatum
  misc_feature: Ceres CLONE 1958095
  misc_feature (23)..(161): Pfam Name: SBP56 Pfam Description: 56kDa selenium binding protein (SBP56)
MAGAAAVDVPAMAATNGGSCCHAAKGPGYATPLEAMEKGPREKLIYVTCVYNGTGINKPDYLATVDLDPNSPTYSQVIHRLPVTHIGDELHHSGWNSCSSCHGDPSAKRRFLILPSLLSGRVYVVDTATDPRAPSLHKVVEAEDIAEKTGLGFPHTSHCLA

SEQ ID NO: 34915 - DNA, 608 bp, Panicum virgatum
  misc_feature: Ceres CLONE 1958106
  misc_feature: Encodes the peptide sequence at SEQ ID NO. 34916
ggagctgcgccttctccatcgggagggtgcgggagcgccgccgtcgcctcagacctcggcgtcctccgcctcatcctcgctgcctcggcgtcctccgcctcatcctcgccgccgtcgctaccctcctcttccccggtcccaagaagctatccgctgccggaggagatcaccgccgcggctgtgctctgttcaggatctacatcctcgtccatatataggaggcatccacaccaagaagagtgaggagcaccaaggacttccggcgcctgttcaggatctacatcttcccgagcgagttcttggttgatctcttcctctttgaccacctcccaggctatgtgttgttgttccctgccgcatactcaagttctgggctttcttaggaatcatgttgcagattccccttatcgtattgacatcttacctcaaaaataaattcagagacacgatggttggcagtatgatcttttggttctttttctgcatctacgggcaacctatatgccttctcttgtattaccatgatgtgatgaacaggatcaactagacaacataaacttctgcagctaaccgtgatgtatatcattttatcatgtgtatgatagcta

SEQ ID NO: 34916 - protein, 52 aa, Panicum virgatum
  misc_feature: Ceres CLONE 1958106
  misc_feature: The sequence is a functional homolog of SEQ ID NO 2 in US patent 7067718
MLQIPLIVLTSYLKNKFRDTMVGSMIFWFFFCIYGQPICLLLYYHDVMNRIN

SEQ ID NO: 34917 - DNA, 1265 bp, Panicum virgatum
  misc_feature: Ceres CLONE 1958111
  misc_feature: Encodes the peptide sequence at SEQ ID NO. 34918
ccgttcattcattcggattgagtcccgtctcgccgttcatcgtcgtctccaccgagtcgcaaaagaaaaaaaaggggaaaagcgtaggaggaggaggtggaggaggaggaaaggaaagcttctggagagagactgttttccgaagccatgttccttttgctgataacctgtctcatactcagctcaagttacctgctggtgacatgcagcaatttttaccgcagcttggaatgacatcacctttcttcacaccaaattcttttggaagcccttattatcagaatttgcaccctgctaatgcatttccaacttcaattggaactggagggtaccctgtaactggttcagttttgccaccttttatggctagttatgctccccaaggttctcttgctacgcctcttgacagtcctatgactccaagctttagtggcaggccatctggttttccttcaactgggaatcctattgggggaacagattttatgcagtcatataaaatgtatggacaacttggggttggtatgcagccatccattcccgacccaaacttcattcatttctttcagcacccctctttacttcagtatactggtggaaatcaatacaatacaatgggtccaagatttactgttgctgggaatccagctgaaagctttgatccacaaaagatgatgcctcaaactgcatacccatctgatcagacgcttcagcttccaagaggttttcctaattctcccacatccagaagaggagttgttccaaattatcaagccatgtcaccctacataccgatgagttaccctaccagtctggtgtttcagggacaaacattgcctggagcattgcctcctggcaggagaaacgattctgttggattccagtcccccaccagaaatattactgctaattcagggactcaagggcagcctcaaaggcagaagtttgatgaaccaaaggcctgttctttcctagaagagctaaagtccaacagagcacgtagggtcgagctatctgatatcacaggccgtattgtggaatacagcgctgaccagcatggtagccgattcatccagcagaagttggaaaactgcactgctgaagagaaggcatctgtttttgcagaagttcttcctcatgctgcatctttaatgactgacgtttttgggaactatgtgatccaaaagttctttgaacatggaactcgtgagcaaaggagggatcttggcactaagcttgttggtcatgttttgcctttgagtctt

SEQ ID NO: 34918 - protein, 420 aa, Panicum virgatum
  misc_feature: Ceres CLONE 1958111
  misc_feature (375)..(409): Pfam Name: PUF Pfam Description: Pumilio-family RNA binding repeat
  misc_feature (339)..(373): Pfam Name: PUF Pfam Description: Pumilio-family RNA binding repeat
VHSFGLSPVSPFIVVSTESQKKKKGKSVGGGGGGGGKESFWRETVFRSHVPFADNLSHTQLKLPAGDMQQFLPQLGMTSPFFTPNSFGSPYYQNLHPANAFPTSIGTGGYPVTGSVLPPFMASYAPQGSLATPLDSPMTPSFSGRPSGFPSTGNPIGGTDFMQSYKMYGQLGVGMQPSIPDPNFIHFFQHPSLLQYTGGNQYNTMGPRFTVAGNPAESFDPQKMMPQTAYPSDQTLQLPRGFPNSPTSRRGVVPNYQAMSPYIPMSYPTSLVFQGQTLPGALPPGRRNDSVGFQSPTRNITANSGTQGQPQRQKFDEPKACSFLEELKSNRARRVELSDITGRIVEYSADQHGSRFIQQKLENCTAEEKASVFAEVLPHAASLMTDVFGNYVIQKFFEHGTREQRRDLGTKLVGHVLPLS

SEQ ID NO: 34919 - DNA, 565 bp, Panicum virgatum
  misc_feature: Ceres CLONE 1958111-R
  misc_feature: Encodes the peptide sequence at SEQ ID NO. 34920
aggcagatcgtggagcagacagaagggcaatgccaatttgctggcaatgatgaaggaccagtatgctaattatgtggttcagaagatactcgaaacatgcaatgagagtcaacgggaacttctcctcagccgtgtaaagggtcatctgcaagcattgaggaagtacacctatggcaagcacattgtaagccgagttgagcagctctgtggtgaaggacctactgactcggactcttgaaatgaacccacaaattcatcataggagaggtgacttgatctttgctatccatcagctgtgaagaaagcaaaacaagtcgaactccggtaccttcggacgggctaacaaaactgtcgtcgaagattgtataggtgtgactttctccagggtagtcttttcaggttctatagaacagcagcttagcgtgtgcatcactgtatctatgttagggtgtgcctatttacagaataatagtggtcggttagctgtgtgcaaaaggagtttagcgttatggtttgtatgcgatacatatcagctgtgcccggtaatgtatttgcttgcatcgca

SEQ ID NO: 34920 - protein, 78 aa, Panicum virgatum
  misc_feature: Ceres CLONE 1958111-R
  misc_feature (8)..(42): Pfam Name: PUF Pfam Description: Pumilio-family RNA binding repeat
  misc_feature: The sequence is a functional homolog of SEQ ID NO 1232 in the 10/666,642 US patent application
GRSWSRQKGNANLLAMMKDQYANYVVQKILETCNESQRELLLSRVKGHLQALRKYTYGKHIVSRVEQLCGEGPTDSDS

SEQ ID NO: 34921 - DNA, 435 bp, Panicum virgatum
  misc_feature: Ceres CLONE 1958121
  misc_feature: Encodes the peptide sequence at SEQ ID NO. 34922
aatagcgcgcggcggcggtgttggccgtgcggtggggggaaatggcggcctcgccgccgaggcagaagccgcggttcgcggcggtgccggatgcgcttgcctctctccccctcgaggtcctcgacaacatcttctcccgcctccacatctacgacgtggtccgcacctcggtgctctcccgcacgtggcggcgccggtgggagtcgctccccacggtggacctctcccatagccccggcatctgcgcctccgacatcgacgctctgctcctccgccgcggctccgcacccgtccgcgcgttccgcctccccgcgagggaccccacgtggatgatctggaactacttccacgactggctcctctgcctctcacggcgcggcgtccgggacccaaccctcggcttcccgtcccagttcagcctcttccggctgcatt

SEQ ID NO: 34922 - protein, 131 aa, Panicum virgatum
  misc_feature: Ceres CLONE 1958121
  misc_feature (17)..(64): Pfam Name: F-box Pfam Description: F-box domain
MAASPPRQKPRFAAVPDALASLPLEVLDNIFSRLHIYDVVRTSVLSRTWRRRWESLPTVDLSHSPGICASDIDALLLRRGSAPVRAFRLPARDPTWMIWNYFHDWLLCLSRRGVRDPTLGFPSQFSLFRLH

SEQ ID NO: 34923 - DNA, 607 bp, Panicum virgatum
  misc_feature: Ceres CLONE 1958130
  misc_feature: Encodes the peptide sequence at SEQ ID NO. 34924
aaaaaatctggccaagtcaccaccgcagcctaaacccctcctcacccccgccgccggcgccgacatggccgtccaccacctactccgccgcggggtctccggcgggtccccgctccgcggcctcctcctcgcctcccaggagatcgggaggcgtccgttgagcttggcggtgtcgggggacgcggcagccgagctgaggggcgcgcgggaggatgtcaagcagctgatcaacaccaccttctgccatcccatcttggttcgattggggtggcatgatgctggtacctatgacaagaacattgcagagtggcccaagtgcggcggagctaatggtagcttgagatttgaaattgagttaaagcatggggctaatgctggtcttgtgaatgctttgaagctgatccagccgatcaaggataagttttcaggtgtcacatatgcagatctgtttcagctagccagcgccacagccattgaggaagcaggtggccccaaaattcccatgatctatggaagggttgatgttacggcccctgaacaatgcccgcctgaggggaggcttcctgctgctggcccaccttcacccgcggaacatttacagtgaagt

SEQ ID NO: 34924 - protein, 179 aa, Panicum virgatum
  misc_feature: Ceres CLONE 1958130
  misc_feature (47)..(177): Pfam Name: peroxidase Pfam Description: Peroxidase
  misc_feature: SWISSPROT Homolog: EC 1.11.1.11 L-ascorbate peroxidase
MAVHHLLRRGVSGGSPLRGLLLASQEIGRRPLSLAVSGDAAAELRGAREDVKQLINTTFCHPILVRLGWHDAGTYDKNIAEWPKCGGANGSLRFEIELKHGANAGLVNALKLIQPIKDKFSGVTYADLFQLASATAIEEAGGPKIPMIYGRVDVTAPEQCPPEGRLPAAGPPSPAEHLQ

SEQ ID NO: 34925 - DNA, 1101 bp, Panicum virgatum
  misc_feature: Ceres CLONE 1958131
  misc_feature: Encodes the peptide sequence at SEQ ID NO. 34926
attcgaagcggcagtcgtaaccaagtggcatcagtagatagagcccatccatctatctagctctactggtatagatgctctcgcatcggtaggagggcgagggcgagggtggggaggagggcacgggagaggccgccaccaggccaactacctagtgggggagggccggagggtgggggatttctcgggggaggagcgcccgggaggacctgattgggggctccgggccgcgatctctgagcgcagatttggtgcctgcgatctgccatggattcggtttaggttgggggagatcgatcggcttctcgccacgagatctagattcgatttttgcgcctgttttattcgcgagttgtagaagaggaggagcaaataaatcaacaggaggaagaatttctcggggtgggtaagggagaaggcatgatgctggaagggaagccctacctcgtctcgcgctccctgccgagctcctgcgagcccgagacggagtgggcgtacctcgcgcacgaagtcctcagcggcaagcgcccggcgccggaagaagttgaggaagctgacggcggcggcaagcgcagcaagccgccgtctccgcagccgcacacgccggacatcgctgagggccacggctccagccgccatgcctccggtggtggggagcaacagggcactgggagcaaccccattaattctatcggccgtgacctgaccatcaattgcctcctccggctatcccggtcagactacggctcggtggcctccctcagccgggacttccgctccctggtccgcagtggggagatctaccgcctgcggcgccagaatggggtggcggagcattgggtctacttctcctgcaatgttcttgaatgggatgcatatgacccatatcgagatcgctggatccgggtgcccaagatgccaccagatgaatgcttcatgtgctccgataaggaatcacttgcagtcggcactgagctgcttgtgtttgagatggcgcgtattgtgttcagatacagcatcctaaccaattcatggacgagggctgatgcaatgaactccccccgctgcctgtttgggtcaacaagtgttggggagaaggcc

SEQ ID NO: 34926 - protein, 226 aa, Panicum virgatum
  misc_feature: Ceres CLONE 1958131
  misc_feature (86)..(133): Pfam Name: F-box Pfam Description: F-box domain
MMLEGKPYLVSRSLPSSCEPETEWAYLAHEVLSGKRPAPEEVEEADGGGKRSKPPSPQPHTPDIAEGHGSSRHASGGGEQQGTGSNPINSIGRDLTINCLLRLSRSDYGSVASLSRDFRSLVRSGEIYRLRRQNGVAEHWVYFSCNVLEWDAYDPYRDRWIRVPKMPPDECFMCSDKESLAVGTELLVFEMARIVFRYSILTNSWTRADAMNSPRCLFGSTSVGEK

SEQ ID NO: 34927 - DNA, 417 bp, Panicum virgatum
  misc_feature: Ceres CLONE 1958137
  misc_feature: Encodes the peptide sequence at SEQ ID NO. 34928
tccaccacacgccgaggcttgctcttcttcttcttgttgttgttgctggtgatagaaaaatagcattcccgggcagccgtgcgcccaagatcggcgaggccggccgtgcttgttgctcgcgcccttgacacgtcgtccctctgctagcgcagaggtagcgaggtatgtagcaatggagacccgggacagcgccccctcccccgcgccactcccctactcctactcggagctgccgcccaccgatgccgcatccgaagaggtctgcggcgcccccccccgtcgaacgccgctctgagccgccgcgccactaggctgcctctgttgattgctcctctgcccgacgcctctggccggagactgcataacgcccccctcgcccccctcctctccagagccagcgcggcaatgctgaacctc

SEQ ID NO: 34928 - protein, 40 aa, Panicum virgatum
  misc_feature: Ceres CLONE 1958137
  misc_feature: Functional homolog of the protein sequence given in SEQ ID NO 51130
  misc_feature: Useful for making plants with altered carbohydrate content
METRDSAPSPAPLPYSYSELPPTDAASEEVCGAPPRRTPL

SEQ ID NO: 34929 - DNA, 393 bp, Panicum virgatum
  misc_feature: Ceres CLONE 1958144
  misc_feature: Encodes the peptide sequence at SEQ ID NO. 34930
tgattaatccaccgaggccatgcgcgcgcggcatacagggagagagagagaggccaaggacaagaaatggagggcgaggaggacgaccttcccctgggcgcccacaagttctcggagcggcagcccatcgggacggcggcgcatggcgccggggatgacaaggactactaggaccccccgtcggcgccgttgttcgagcccgggcagctcacgtcctggtcgttctaccgcgcgggtatcgcccagttcgtcgccaccttcctcttcctctacatcaccatcctctccgtcatgggcgtctccaactcccactccaagtgcgccaccgacggcatccatggcgtcgcctggaccctcggaggaatgatcttcgcgctcctctactgcaccgcc

SEQ ID NO: 34930 - protein, 33 aa, Panicum virgatum
  misc_feature: Ceres CLONE 1958144
  misc_feature: Functional homolog of the protein sequence given in SEQ ID NO 50910
  misc_feature: Useful for making plants with modulated drought sensitivity
  misc_feature: Functional homolog of the protein sequence given in SEQ ID NO 50195
  misc_feature: Useful for making plants with modulated water use efficiency
MGVSNSHSKCATDGIHGVAWTLGGMIFALLYCT

SEQ ID NO: 34931 - DNA, 596 bp, Panicum virgatum
  misc_feature: Ceres CLONE 1958148
  misc_feature: Encodes the peptide sequence at SEQ ID NO. 34932
atcgacttcctttgctctgctaccaaggacatccatctccacacacaaacactactcgagaccaacaagaatacctgcaaacatgcagatctttgtcaagactttgactggcaagaccatcacccttgaggtggagtcctccgataccatcgacaatgttaagtcgaaaattcaagacaaggagggtatcccgcccgaccagcagcgcctgattttcgcgggcaaacaactcgaggacggccgcaccctctcggattacaacatccaaaaggaatcgacgcttcacctcgtcctccgtcttcgtggcggtatgcaaatcttcgtcaagactctgaccggcaagaccatcaccctggaggtggaatcatcggatactatcgacaatgttaagtcgaagatccaggataaggagggtatccctcctgaccagcagcgcctgatttttgctggcaagcaactcgaggatggtcgcactctttcggattataatatccagaaagagagcaccctgcatcttgtcctgcgcctgcgcggtggtatgcagatcttcgtcaagaccctcacgggaaagacgatcacattggaggttgagtcgt

SEQ ID NO: 34932 - protein, 171 aa, Panicum virgatum
  misc_feature: Ceres CLONE 1958148
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVES

SEQ ID NO: 34933 - DNA, 363 bp, Panicum virgatum
  misc_feature: Ceres CLONE 1958158
  misc_feature: Encodes the peptide sequence at SEQ ID NO. 34934
accgccgcgaccagaaggcagcttcaaccgcagcgtgcatgagccgagcaaaccgccgcacaccaacgcctcccgcaatggcgcgcgccggcgctctctgcctcgtgctgctctgcctcctggccgcgcactccgccgtggcgcagaagtccgccgcccccgccccggccaccggggcggccgccgcctccaccccgccggccccgtcaaagaagacgcccgcgcccgccgcagctccgcccaccatctcccctggcaccccggccccggccgccgcgccgcccaccgacgccggccacccccgcgcccgccgcggctcctcccactaccaccacgcgtgcaccaggcgtggccccgcccaag

SEQ ID NO: 34934 - protein, 95 aa, Panicum virgatum
  misc_feature: Ceres CLONE 1958158
  misc_feature: Functional homolog of the protein sequence given in SEQ ID NO 50275
  misc_feature: Useful for making plants with altered carbohydrate content
MARAGALCLVLLCLLAAHSAVAQKSAAPAPATGAAAASTPPAPSKKTPAPAAAPPTISPGTPAPAAAPPTDAGHPRARRGSSHYHHACTRRGPAQ

SEQ ID NO: 34935 - DNA, 1133 bp, Panicum virgatum
  misc_feature: Ceres CLONE 1958171
  misc_feature: Encodes the peptide sequence at SEQ ID NO. 34936
acccgcgaactggccgcctggccggccgctatgggctccacttcgtcgacggcgctgggttggccgccggcaaccgcagatgactgcatcccaccaaagaagaggaagacttggtgcagtgtccagcaacctgtgcagaatcatgacaggatcagcacactaccagatgacattttgatcaaaattctttcgctaatgacagtcaaggaggctgcagttactgcttgtctgtccaccagatggagacacctctggaaaaacgttgaccgtctcatccttgagatgcatacttttggaatgcaaatgccagaaaatacaaataataacgaaaatcctgatttctggaatcaagaagctacaaagtttgtgactaaagtaaatgaagttttgcgccatcataatggtaatggaatcaagaaagtcgaagtcaacttcccattatcctcgtcccatgcttcggaccttgatcgctgggttgcattcacagctgcatctggttcaagaacacttaaccttatcctttctggccatcatggtattattgccacaccggatgcagaacgatacagcttccctttgaagcattttgttgatttgagaggttgccaattgcgcatattgcttctatccatgtgcagtttagaatcagtgtctgcaaaactcagtggcttttcttatctacattgcctttcacttcaccgtgtatcagtggttgattcagttgttctgaatattatgtccagttgccgtgctctccaccactttagcctgcaaagatgccatcagttgattaccatgagaacctctcatgcagaattggtgtatctggaagttcgtaattgtaagagcttaattaatattagcattcatgctgaaaggctggagtgtttctcatacaagggtcataaggtagatattgagtatgaatgtgcaccaattcttcacagacttcatgttttttttgtgaagaataatgaatgccctttagacttcttgggtgctctccctaagctcagatcactgaccttacagtttcccacatgtttacaggtatctcgtgtactgcaacacagtaaaatatttgctggtttgaagaagatcgtgctgtgtctcttgacatcttggaaaacgag

SEQ ID NO: 34936 - protein, 377 aa, Panicum virgatum
  misc_feature: Ceres CLONE 1958171
  misc_feature (49)..(96): Pfam Name: F-box Pfam Description: F-box domain
TRELAAWPAAMGSTSSTALGWPPATADDCIPPKKRKTWCSVQQPVQNHDRISTLPDDILIKILSLMTVKEAAVTACLSTRWRHLWKNVDRLILEMHTFGMQMPENTNNNENPDFWNQEATKFVTKVNEVLRHHNGNGIKKVEVNFPLSSSHASDLDRWVAFTAASGSRTLNLILSGHHGIIATPDAERYSFPLKHFVDLRGCQLRILLLSMCSLESVSAKLSGFSYLHCLSLHRVSVVDSVVLNIMSSCRALHHFSLQRCHQLITMRTSHAELVYLEVRNCKSLINISIHAERLECFSYKGHKVDIEYECAPILHRLHVFFVKNNECPLDFLGALPKLRSLTLQFPTCLQVSRVLQHSKIFAGLKKIVLCLLTSWKT

SEQ ID NO: 34937 - DNA, 1661 bp, Panicum virgatum
  misc_feature: Ceres CLONE 1958175
  misc_feature: Encodes the peptide sequence at SEQ ID NO. 34938
attctccttcccagttcccagtcccggccgccacccccaccccgaaccccccacccagcgccccctcctggccaccttctcgagcccctgtggcaccggcggcgcagtgccgcacggctcgcacccccacggccccacccgctcagctcctcagtcgctcctccagcggtcaccgctccccgccggccaccgctccttcgccggtcgcagctcccctgccggacgtcgctccaccaacggccgcgccgctccgcaccggtcgtcgctccctgtcagcctgctcggtacaagaaatcaccgcccagcagcccgacccccgccttcctgattccgccgtggtgcctgatcccgtctccttcctggtgtcggggttgcggcggcgccgacgagccaccaccgagcgcgatggcgagctcggctctgaggcgatctctccctcggggcccctcactccgcagcgccctcttgtcccgccggccacccgccgccagcgacttctgccgctctttccagtccggggatggtgaaactcgggagaccacggacgaattcgaggcacggctgtttgggaacaagggccttgaagagggttcactctatcagaaactcgatagggttgagaataccagtaagagatatggcatgggctctggatccaggggtggttttggtggtctccgcgataggagcagttctgggaccatgggtggttttggtgggttcggtgaccgtaacagcactggatccatgggtgggtttggtgggtttggcgacaggagcagctctgggtcattgggtggttttgattctttgaatgatgggatgagtgagatgcttggtaatgtggcacgtaacaacatcgaattggacgatgacgatgaggaggaggactgggacgatgaggactttgagttcaggcctgacatggacttcaggcgaggttcgacctatactgttcgggaccttgaccttaatagacctgcagccgcaaagaaccctcccagaccacagtttgaaacaactacagcagaagttttgaggaaggctgattttaggaacgttagattcctcgccaactttcttacagaagctggaattatcatcaagagaagccagactcgcataagtgcgaaagctcagcgtaagattgcaagagagatcaaaaccgctcgtgcctttgggctaatgcctttcacaacgatgggtagaagaccattcatctttggcagaagcgccgaggagcactattcagaggaagaatatggattcgactttgtgaagcagaaggatggtgaacctgatgaggataatggggaagctgagccaagcgtggaggctgtgtaagcattctggagcgaccttttgcaatcgccccgtttcatcagttgttctcatttgacacagctctgcgtgcctgcctgatgcccccattttgctttgttcagaggatagctcagcttagcctgaataaactgtgacattcggttgtgtacctctgcttgcctgttgtcgtgtgatagcgaaatatcttcagtgacactatcctccaggctggagatcatgtgccatatgagatgggccatgtgatcggacgctcggaaacctttgtggtaatactgctgagttcaatttcatatccaagcatgactgttaggctgttc

SEQ ID NO: 34938 - protein, 312 aa, Panicum virgatum
  misc_feature: Ceres CLONE 1958175
  misc_feature (208)..(261): Pfam Name: Ribosomal_S18 Pfam Description: Ribosomal protein S18
MASSALRRSLPRGPSLRSALLSRRPPAASDFCRSFQSGDGETRETTDEFEARLFGNKGLEEGSLYQKLDRVENTSKRYGMGSGSRGGFGGLRDRSSSGTMGGFGGFGDRNSTGSMGGFGGFGDRSSSGSLGGFDSLNDGMSEMLGNVARNNIELDDDDEEEDWDDEDFEFRPDMDFRRGSTYTVRDLDLNRPAAAKNPPRPQFETTTAEVLRKADFRNVRFLANFLTEAGIIIKRSQTRISAKAQRKIAREIKTARAFGLMPFTTMGRRPFIFGRSAEEHYSEEEYGFDFVKQKDGEPDEDNGEAEPSVEAV

SEQ ID NO: 34939 - DNA, 588 bp, Panicum virgatum
  misc_feature: Ceres CLONE 1958180
  misc_feature: Encodes the peptide sequence at SEQ ID NO. 34940
gagagagtcggcggcggtgaccggaggggcggcgagatggcgaaggggttcacgtcatacctggcgatgaccaccggccccgatgccggggacccgtccgtggcggccatggcgctcatcgaccccgacctgcgggagatcggcgtcgccgcgcggaagctcgccaaccactccttcgtcctcggcggcgggctcggcttctgcacctccttcctcaagtggctcgccttcctcgccgcagtgtacctcttgatattggaccgcacaaactggaagaccaacatgatgacggccctcttggttccctacgtgttcttcacactacctcatgttctgttttctctgataagaggagaggttggaaaatggattgcaattgttgcagttattctgcggctcttcttcccacgccacttcccagattggttagagctgcctggtgccatcatcctgctcacagttgtcgctcccagcctctttgcggacaccttcaggggtgacctggtcggcatcttcatatgcctctcgatcggatgctacctgctttcacaccatatcaaggcatcgggtgggttcacgaaccccttc

SEQ ID NO: 34940 - protein, 183 aa, Panicum virgatum
  misc_feature: Ceres CLONE 1958180
  misc_feature (9)..(182): Pfam Name: WCOR413 Pfam Description: Cold acclimation protein WCOR413
MAKGFTSYLAMTTGPDAGDPSVAAMALIDPDLREIGVAARKLANHSFVLGGGLGFCTSFLKWLAFLAAVYLLILDRTNWKTNMMTALLVPYVFFTLPHVLFSLIRGEVGKWIAIVAVILRLFFPRHFPDWLELPGAIILLTVVAPSLFADTFRGDLVGIFICLSIGCYLLSHHIKASGGFTNP

SEQ ID NO: 34941 - DNA, 536 bp, Panicum virgatum
  misc_feature: Ceres CLONE 1958188
  misc_feature: Encodes the peptide sequence at SEQ ID NO. 34942
acaccaccacaccgatctagaactgcttcacagagtcacagttcagtcatcactccgaccgacagagaaaaatgtgcggcggtgcgatcctcgcggagctcatacccggcggcggccggaggggagcccccgccgcggcggccaaggacgacaacttcgaggccgccttccgggagttcgacgaggactccgaggaagaggtcgtgatgctgacggagcgcatggcgtccgcgcttggcgcccgcgccggctgggcccggcgcagcaggcgtccgagccagtaccactgcggccggcggaggccgtggggcaagtgggcggccgaggtccgcgaccccgtcaggggcgtccgcgtctggctcggcaccttcgccaccgccgaggccgccgcgcgcgcctacgactacgcggcgcgcgacctccgcggcgccggcgccaagctcaacttccagtcctccgacacggtccgcaccggcaagcgacgcgccgccgccgcgatcgccatggccgcgccgtacatctaccacgtccacaac

SEQ ID NO: 34942 - protein, 154 aa, Panicum virgatum
  misc_feature: Ceres CLONE 1958188
  misc_feature (69)..(120): Pfam Name: AP2 Pfam Description: AP2 domain
MCGGAILAELIPGGGRRGAPAAAAKDDNFEAAFREFDEDSEEEVVMLTERMASALGARAGWARRSRRPSQYHCGRRRPWGKWAAEVRDPVRGVRVWLGTFATAEAAARAYDYAARDLRGAGAKLNFQSSDTVRTGKRRAAAAIAMAAPYIYHVH

SEQ ID NO: 34943 - DNA, 605 bp, Panicum virgatum
  misc_feature: Ceres CLONE 1958193
  misc_feature: Encodes the peptide sequence at SEQ ID NO. 34944
agtccccgagacgcatcacgggcgcagccgcagcatcagcggagcggacagggacaccctgctcccagtctcacactccactctgccaccctctgtctgagctgcctccgttgccatggccgcgcggatcttgctcccgctgctcctcttcctcctcggctcgcattgctggaccggggcgggggaggcggccgcggcggcgaggctgcagctgctgcaggtgcggcgcgccggggatcccacctctcaggtcgacttcgacttctcgcccttcctcatcgattacttcagcgggcgcctgaagcggctgatgggcacccacgtggtggcggcgtcctcggaggccctcacgggcgtcacctcccgcgacgtcgtcatccacccgtccacgggcgtcgcggcgcggctctacctccctagcttccgcgccagcgcacagatgctcgtgctggtctacttccacggcggcgcgttcgtggtggagtccgtcttctcgcacatctaccacgcctacctcaccactctggcggtgagggcgggcgtggtgggcgtgtccgtgatctaccgcctggcgcctgagcacccgctccaggcagcgtacaacg

SEQ ID NO: 34944 - protein, 163 aa, Panicum virgatum
  misc_feature: Ceres CLONE 1958193
  misc_feature: SWISSPROT Homolog: EC 3.1.1.3 Triacylglycerol lipase
MAARILLPLLLFLLGSHCWTGAGEAAAAARLQLLQVRRAGDPTSQVDFDFSPFLIDYFSGRLKRLMGTHVVAASSEALTGVTSRDVVIHPSTGVAARLYLPSFRASAQMLVLVYFHGGAFVVESVFSHIYHAYLTTLAVRAGVVGVSVIYRLAPEHPLQAAYN

SEQ ID NO: 34945 - DNA, 655 bp, Panicum virgatum
  misc_feature: Ceres CLONE 1958198
  misc_feature: Encodes the peptide sequence at SEQ ID NO. 34946
agttgagagaagagagagagagaccccactgctgagccgcagaagagaaggaaggataagtgagattccacacaagcatctcaaacagctgagtgcctttgatcctctgctctcagtgctctgctcgccatggcatcttcggtttcatcagtagtcttgctgctactctgcatggccgccgccgccgcggcgcagctctcgccgacgttctacgacacgtcgtgccccaacgcgctgtccactatcaagagcgccgtgacggccgccgtgaacaaggagaaccgcatgggagcctccttgctcaggcttcacttccatgactgctttgtccaggggtgcgacgcgtccgtactgctggctgacatccccggcagcttcaccggcgagcagggggcgttgcccaacgcgggatctctgaggggcttcgacgtcatcgccaacatcaaggcgcaagtggaggccatctgcaagcagaccgtctcctgcgccgacatcctcgccgtcgccgatatatagccccatccattaatgcttttgctttcttcaagtacttcaagtgccatgcatgaacaaacaaattaattaacttaaggtcctgcatgcatgcatggatgcaggggcgcacacgatcgggcagtcgcagtgcctcaacttc

SEQ ID NO: 34946 - protein, 128 aa, Panicum virgatum
  misc_feature: Ceres CLONE 1958198
  misc_feature (39)..(128): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50228
  misc_feature: Useful for making plants with altered carbohydrate content
  misc_feature: Functional homolog of the protein sequence given in SEQ ID NO 50229
  misc_feature: Useful for making plants with altered cell wall content and/or composition
MASSVSSVVLLLLCMAAAAAAQLSPTFYDTSCPNALSTIKSAVTAAVNKENRMGASLLRLHFHDCFVQGCDASVLLADIPGSFTGEQGALPNAGSLRGFDVIANIKAQVEAICKQTVSCADILAVADI

SEQ ID NO: 34947 - DNA, 674 bp, Panicum virgatum
  misc_feature: Ceres CLONE 1958211
  misc_feature: Encodes the peptide sequence at SEQ ID NO. 34948
aaccgcggcgagccaaagccaagccaaaccaaaccaaacccgctgctccactgccaggtgccaacttcctctccaagcctcgctctcgcggactcctctcatcggggggccggcggcggcgactaagccgcgatggactcgaggccccgcgagaccgacgcccccggcgacccggccaacggcgccgcccctccgccggccgcggcggggggcgtcgagatcaccaagccccgcaacgacaagcgcgggtaccgccgcgtggtgctccccaacgcgctcgagtgcctgctcatcagcgaccccgacaccgacaaggcggcggcgtcgatgagtgtttcggtggggtacttctgcgaccccgatggtctggaggggctcgcccacttcctcgagcacatgcttttctatgctagcaaaaaatatccaatagaagatagttactcaaagtacattgcagagcatggtggttcaaccaatgcgttcacaagtactgaacgcacaaatttttattttgatgtgaacagtgatagccttcatgatgctttagataggtttgcacaattctttatcaagccattgatgtctccagatgctgtacatagggaaataaaagctgttgactctgaaaatcagaaaaaccttttatcaaatccttggcgaatgagtcagcttca

SEQ ID NO: 34948 - protein, 180 aa, Panicum virgatum
  misc_feature: Ceres CLONE 1958211
  misc_feature (50)..(180): Pfam Name: Peptidase_M16 Pfam Description: Insulinase (Peptidase family M16)
  misc_feature: SWISSPROT Homolog: EC 3.4.24.56 Insulysin
MDSRPRETDAPGDPANGAAPPPAAAGGVEITKPRNDKRGYRRVVLPNALECLLISDPDTDKAAASMSVSVGYFCDPDGLEGLAHFLEHMLFYASKKYPIEDSYSKYIAEHGGSTNAFTSTERTNFYFDVNSDSLHDALDRFAQFFIKPLMSPDAVHREIKAVDSENQKNLLSNPWRMSQL

SEQ ID NO: 34949 - DNA, 626 bp, Panicum virgatum
  misc_feature: Ceres CLONE 1958267
  misc_feature: Encodes the peptide sequence at SEQ ID NO. 34950
agagcaagcacggggagccggcagcgtctgacatggcggcgctgtggctggcgagagcgtcgtcccagctggcgcgccgcgccgcgaggaggctcccgccgcttccgtcgcgcctcggcggcgaacccagcccgtggctcttgggctcatcggcagaagcgccgccgcctgttcttggatcgccaccactgccaccgttggagagaatcgtccgccggggcttctgctccgtccggcgcttcgccggggagagcagcgccgccgctgctgacgaggaggagccggagaacgggttcgccggcggcgatcagaccattgacttccctggagggaaggtttcatttgtagctgaaatgaacttccttccggagtcacatggggaaaggatcagctgctaccgtgttcttgacgatgatggcagaacaatatctggtagtagattccgagaggtcagtaaggaggtggctctgaaaatgtacagggagatggtcaccctccagatcacggataacatcttgtatgaagcacagaggcagggcagattctccttttatctcacttccaatggcgaggaagcgatcaacatagcatctgctgcggcacttagtattgacgacattgtgctg

SEQ ID NO: 34950 - protein, 197 aa, Panicum virgatum
  misc_feature: Ceres CLONE 1958267
  misc_feature: SWISSPROT Homolog: EC 1.2.4.4 3-methyl-2-oxobutanoate dehydrogenase (2-methylpropanoyl-transferring)
MAALWLARASSQLARRAARRLPPLPSRLGGEPSPWLLGSSAEAPPPVLGSPPLPPLERIVRRGFCSVRRFAGESSAAAADEEEPENGFAGGDQTIDFPGGKVSFVAEMNFLPESHGERISCYRVLDDDGRTISGSRFREVSKEVALKMYREMVTLQITDNILYEAQRQGRFSFYLTSNGEEAINIASAAALSIDDIV

SEQ ID NO: 34951 - DNA, 591 bp, Panicum virgatum
  misc_feature: Ceres CLONE 1958270
  misc_feature: Encodes the peptide sequence at SEQ ID NO. 34952
aacccagcacccagtcaccacccgctctcccggcactggctccgactggccgctctcccgccatgatgaaccacctccacaactcatccccgacccacgcgccgtcgccggcgcacgctccggagccgaaggccgccaaggcggagcgccccggcccgcgctcctggatcgggtacctcctccgagagcaacgcctcctcttcgtcctcctcggcgcgctcatcgcctcgaccttattcctcctccggccgtaactctcgctctcatcatcgtcccatctcaccgacgcccgacagctcgtctccttcgccgcacgctcaggcggccccgcgggggtgcgccaggcgccgcgccgggtcgccctctctggcggagctggggacgacggccgccatctcctggaccggctgctggagcacggccacagagcgatcgtgctcgacgatttcttcacgggcaggaacgacaacgtcccgcaccacctccggaacccgaggttcgagctgctccgacacgatgtcgtcgagccgatcctcctcgaggcccatcggatctaccacctcgcgtgccccgcgccacccgtgcactaca

SEQ ID NO: 34952 - protein, 62 aa, Panicum virgatum
  misc_feature: Ceres CLONE 1958270
  misc_feature: Functional homolog of the protein sequence given in SEQ ID NO 51471
  misc_feature: Useful for making plants with altered cell wall content and/or composition
MNHLHNSSPTHAPSPAHAPEPKAAKAERPGPRSWIGYLLREQRLLFVLLGALIASTLFLLRP

SEQ ID NO: 34953 - DNA, 623 bp, Panicum virgatum
  misc_feature: Ceres CLONE 1958276
  misc_feature: Encodes the peptide sequence at SEQ ID NO. 34954
aatggttttctttgcagagcaagagagttctttgataggatgccagcaaaggatactgcagcatggaatgcgatgatcaccgcttatgccaacaatggccagctgaatgaagctcggagactattcaattcgatgcctgcaaaagacctggtaacctggaataccatcattgaggcatattccaagaacgaacgtaaggatgaagctgtaaatgtatttcttcttatgcgccgctcagaggtatctcctgacatcagtacattaattagtatcctagttatttctgagagcacaatggaagttaagcagatccatggtttggttgtcacacttggactcctgtcaaaaatcgacttaggaaatgctttgctcacaatgtactcgagaagtggagatttgctttctgcttcgcttgctttcaagagattggaagtgaaggacaccataacatgggcgtcgatgatgcaagcttttgcgaaccatggctgtggctaccaagccttacagggctttgctcagatgttgaggcatgggtataagcccacttcaactacctttacagccattctgtcagcttgtagccatgccggcttggtcgagaaaggtcgcaagatgttcaaatc

SEQ ID NO: 34954 - protein, 207 aa, Panicum virgatum
  misc_feature: Ceres CLONE 1958276
  misc_feature (51)..(85): Pfam Name: PPR Pfam Description: PPR repeat
  misc_feature (149)..(183): Pfam Name: PPR Pfam Description: PPR repeat
NGFLCRAREFFDRMPAKDTAAWNAMITAYANNGQLNEARRLFNSMPAKDLVTWNTIIEAYSKNERKDEAVNVFLLMRRSEVSPDISTLISILVISESTMEVKQIHGLVVTLGLLSKIDLGNALLTMYSRSGDLLSASLAFKRLEVKDTITWASMMQAFANHGCGYQALQGFAQMLRHGYKPTSTTFTAILSACSHAGLVEKGRKMFK

SEQ ID NO: 34955 - DNA, 673 bp, Panicum virgatum
  misc_feature: Ceres CLONE 1958277
  misc_feature: Encodes the peptide sequence at SEQ ID NO. 34956
tgaaagttattgatttcggatcagcatgcctggagggtaaaacggtttactcatacatccagagccgctattacaggtctccggaggttctccttggctatccatatacaactgcgattgacatgtggtctttcggttgcatagttgctgaactatttataggtttgccattatttcctggagcgtcagaatatgatgtgcttcagcgaatgatgacgattcttggggggcaaccaccagatgacctgctaagggaagctaaaaatactggaagattttttaaacatgttggaagtatttttcctggcagtgaggcacctgatggtattcctagtgcatacagatttttaagtgaagaagagattgaaacgagagaatccaagaggccaaaggtagggaagtggtacttcccacgcctaaagcttgacagactcatatataactacccttggaacaattcagaactgacagagacagaagaaacagatcgtttggcattagttgatttcttgaaggggcttcttgaatttgatccaaataagcgatggtcaccggtgcaggctctatttcatcctttcataacaggcgaaccgttcaccagtccatatgagcctgtacctgagactgcaagaattcctgttgctcgtgctgcagcaattgatcacaatcctgg

SEQ ID NO: 34956 - protein, 223 aa, Panicum virgatum
  misc_feature: Ceres CLONE 1958277
  misc_feature: SWISSPROT Homolog: EC 2.7.11.1 Non-specific serine/threonine protein kinase
KVIDFGSACLEGKTVYSYIQSRYYRSPEVLLGYPYTTAIDMWSFGCIVAELFIGLPLFPGASEYDVLQRMMTILGGQPPDDLLREAKNTGRFFKHVGSIFPGSEAPDGIPSAYRFLSEEEIETRESKRPKVGKWYFPRLKLDRLIYNYPWNNSELTETEETDRLALVDFLKGLLEFDPNKRWSPVQALFHPFITGEPFTSPYEPVPETARIPVARAAAIDHNP

SEQ ID NO: 34957 - DNA, 704 bp, Panicum virgatum
  misc_feature: Ceres CLONE 1958315
  misc_feature: Encodes the peptide sequence at SEQ ID NO. 34958
  misc_feature (607)..(607): n is a, c, t, g, unknown, or other
atcggatcctgagccctcgtgaggggagttgacggcgcagcacaaggcgacggcgaccgctccgccgccttctcgccgggtaatttgggagatggccttcctgcagaaggttggcaatcttgtcaagcggtccacgggtgccagctcgtcactctaccaggcggttcgatgcatgtcctcgtccaaactcttcataggaggaatctcgtatggcacagatgagcacagcctcagggatgcgcggtttgcattgagtcagatcattaccggtgatcgtgttcctgccgcctctggtttctgtgcgagagctcttccgatgaggggtttctccacggtgggaaatgctgaggttgcttcagacgatgaggattccagctctccagcggttgcgcaccccccacggattaagttcaagaggctcgacaagactgccaggcacatcatgaatatcttgaacaaagaggcagttgaaaaggtccgctctgagagggagattcctgatgtacaacctggatgtatcattcaaatgagattgcaagttcctgagaacaaacggcgagaatctacattgaaagggattgtgataggaaggcgtaatgctgggatncatacaactttcagacttcgtagattagtagctggtattggagttgagtctgtctttccactctactcaccaaacatcaaagaaatcaagatattgg

SEQ ID NO: 34958 - protein, 204 aa, Panicum virgatum
  misc_feature: Ceres CLONE 1958315
  misc_feature (118)..(202): Pfam Name: Ribosomal_L19 Pfam Description: Ribosomal protein L19
  misc_feature (172)..(172): Xaa is any aa, unknown, or other
MAFLQKVGNLVKRSTGASSSLYQAVRCMSSSKLFIGGISYGTDEHSLRDARFALSQIITGDRVPAASGFCARALPMRGFSTVGNAEVASDDEDSSSPAVAHPPRIKFKRLDKTARHIMNILNKEAVEKVRSEREIPDVQPGCIIQMRLQVPENKRRESTLKGIVIGRRNAGXHTTFRLRRLVAGIGVESVFPLYSPNIKEIKIL

SEQ ID NO: 34959 - DNA, 1657 bp, Panicum virgatum
  misc_feature: Ceres CLONE 1958340
  misc_feature: Encodes the peptide sequence at SEQ ID NO. 34960
atcatcgatcgcttcatcagtagttcttcccgcggagctagctagctgtccatggaagctccggcggcggagagcagcaacaatcctaataccaataatggcggtggtgctgaagatgagggcgacgccggtggccgcttctcctggcggctggtctggctcttggccgtccggtccgcagcagagaaggtggcccagatcgcgagggacgaccccaggcgggtggcgcactcgctcaaggtcgggctggctctcacgctcgtctccgtggtctactacgtcacgccgctcttcaacggcttcggcggctccgccatgtgggccgtgctcacggtcgtcatcgtcatggagttcaccgttggtgcgacgctgagtaaaggcctgaaccgagctctggcgacgctggtggccagctccctcgtcatcggagctcatgaggtagccagcctcgtcgtcccgagtgagaaggcagagtccatactactcgtcgtcttcgtcttctttgtagcgtcggcagcgaccttctcacggttcatcccggagatcaaggcgaggttcgactacggtgtcagtatattcatactcaccttcagcctcgtcgccgtctccagctgccgcgtcgaggagctcatgcccctcgcgctccagcgcaccaccaccatcttggccggcgtcgccatctgcctctgcaccacaatcttgatctgcccggtctgggccggcgaggacctgcacaagctcgcagccaacaacctggacaagctggccgagttcctcgaaggaatggaaactgaatgctttggagagaatgctagaagcgagaatctggagggcaaggatttccttcacgcgtacaagagggtcctcagctccaaggagaaagaggactctttgtgcacagttgccaagtgggaacctatgcatggcaaattccgcttccgccacccatggagtaaataccagaaacttggcagtctttgccgccaatgtgcttctaaaatggaggctcttgcttcctatgtcgtcatcctgacaaaatctcagtatcccgaagccagtccagagctatgcttgaaggttcggacaacatgcggtcaaatgagcttgcactctgcttgggctctcagagaactctcatcagcagttaggtcaatgactacaccatcttcagcaaacaatgacttgtctgcagccatgaaagtggcaaatagctgcggaaatgaattactggaagatgcggcactattgcaagtgatgcatatagcagttgttggatcccttctatcagacttggtcatgcaggtaaacaaaataacagaatcagttcacaacctagcacgacttgcacgcttcaaagacccggaaaagacaggaaatgatgtagttatcaatgtaaaaacttgataaacagatgttcttattatgtgatacaaatatgagcataatgacttttacaatttgtttttcgcactggcacatgattgtgacctcaggcctgccatttgagttgataggtctacaacagaatcagttgatgaagcgaagcaacaaagtaaacatgtaggtttattcacccgcaccaacttgacgagatggttctcccgaaggcaattcgttgtatttattaccataataatattgagttgaagtccacttg

SEQ ID NO: 34960 - protein, 450 aa, Panicum virgatum
  misc_feature: Ceres CLONE 1958340
  misc_feature: The sequence is a functional homolog of SEQ ID NO 1 in US patent 7138563
MEAPAAESSNNPNTNNGGGAEDEGDAGGRFSWRLVWLLAVRSAAEKVAQIARDDPRRVAHSLKVGLALTLVSVVYYVTPLFNGFGGSAMWAVLTVVIVMEFTVGATLSKGLNRALATLVASSLVIGAHEVASLVVPSEKAESILLVVFVFFVASAATFSRFIPEIKARFDYGVSIFILTFSLVAVSSCRVEELMPLALQRTTTILAGVAICLCTTILICPVWAGEDLHKLAANNLDKLAEFLEGMETECFGENARSENLEGKDFLHAYKRVLSSKEKEDSLCTVAKWEPMHGKFRFRHPWSKYQKLGSLCRQCASKMEALASYVVILTKSQYPEASPELCLKVRTTCGQMSLHSAWALRELSSAVRSMTTPSSANNDLSAAMKVANSCGNELLEDAALLQVMHIAVVGSLLSDLVMQVNKITESVHNLARLARFKDPEKTGNDVVINVKT

SEQ ID NO: 34961 - DNA, 370 bp, Panicum virgatum
  misc_feature: Ceres CLONE 1958342-R
  misc_feature: Encodes the peptide sequence at SEQ ID NO. 34962
ccttcgtggtctgcgccgccgactccgacatcgcagaggatgccatcaaggagtacatatccaagcaggtggtgttctacaagaggctgcacagggtgtacttcacccactccatccccaagtcagcgtcggggaagatactgaggagagagctgcgggccaagctcgccgcagcggcgaccgcctgagtagctgcagcctcagatccttgccttgctacgtgcattcatttggtgttggcattgtattaccattcagtgtatgtgtataaccgtaccgagattgcaagatgtattcataatttcatatgctttgtaagagaatgcatttattcgatgtggcatcaataagattggcaaattttaaagcc

SEQ ID NO: 34962 - protein, 61 aa, Panicum virgatum
  misc_feature: Ceres CLONE 1958342-R
  misc_feature: SWISSPROT Homolog: EC 6.2.1.12 4-coumarate--CoA ligase
  misc_feature: Functional homolog of the protein sequence given in SEQ ID NO 50496
  misc_feature: Useful for making plants with altered lignin content
  misc_feature: Functional homolog of the protein sequence given in SEQ ID NO 50497
  misc_feature: Useful for making plants with altered cell wall content and/or composition
  misc_feature: Functional homolog of the protein sequence given in SEQ ID NO 50495
  misc_feature: Useful for making plants with altered carbohydrate content
FVVCAADSDIAEDAIKEYISKQVVFYKRLHRVYFTHSIPKSASGKILRRELRAKLAAAATA

SEQ ID NO: 34963 - DNA, 1340 bp, Panicum virgatum
  misc_feature: Ceres CLONE 1958342
ctgaagtcaggtattgttccacttcacattttatcatgttgtattgtagcttttgtaattatacagtaaagaataaaaaccttctgggagaggtgattgcacatttaacttggatactcatacaaattgtgttctttttctgtgctgattcaatgtgtttagcttggaattggattgagtgcagtcaatatctgaagaagatgctataggagcaacagaagctcgggccctgcatgcaggtggtgctcccaatctgcggcaggttgttgaatcaaggtgagagataattcatgagctatgttcctagacgagccttgtctttatgataaaaggatagcctttagcacattggttttgtcgtgggatttctagggtacccacagtcgggtggcggaacgcacccgtctatccccagcgagaagaacagaagttgcatttgagactgcaaaatgtgcgcggttttatgggcacggttaattcccgtaatataatatgttcgtacgacctcctatattttacacaatcaacttttttttacagcctaggaaagatatactatggtgactgcatgcatgcgagaggtagagagagagagaaaaaaggacaaatgggaaatgtatgcatatgtgggaagaagaaaaatgacaaatgttgttcacacatgcatgcatatgtgaggaggagaaagagaacgcatgcacacaacttcaaacacagaaaatagcatagtttcaaaatcgagtgtccaaatcaaaattctgcgaaacagctgtgctcatttcaattagagtttcaaaacaagatcccgcgtcactatgtttcaatgatatttttttacatgagaaaatacttttttttagtgtattctaatttgcttatgacttttgcaaaaattgattgatattgagaagatagattggatggtgtgaatagaggatgatggcaaacaattatgttagggtagatgaatgtttattgcatgatcagtgatgtgaaactttagcaagtcaactgagtattttttttattcttctattatgtaaacaatttatgtgtctttgaaaaactattatcgaaacatatgcaagtggcgccttattttgaagatcttttaaaaagaaatatagttgtgcaattagaatttgaatttaatgatcacttcaagaactagtacaattttttaaattttgaagttgcttgtgcgtgctgtcgtggaagataaattctttcaactctatttgagccgctgtcgccgatggtgtgtcttagtctacttgatgtcatcgatgcaaagggtggtagcgtaggtagaattagaaataaaattttggccggctggt

SEQ ID NO: 34964 - DNA, 1106 bp, Panicum virgatum
  misc_feature: Ceres CLONE 1958349
  misc_feature: Encodes the peptide sequence at SEQ ID NO. 34965
atccgaggccgtcccgcactaccaagccacctcccgcaccgcgccgctgccgccgccgccgtctcgcacgcgcggcagaggacgcgcgcgatcccctcccacccaccaccaccagatcgcgccatggcctccacggccttcgccgccaccaagttcctcccggcccacctcgactcctccccgcgcatcgcgccccaccgcgccggccccaccgcgaatctctccttcgcgccgctttccccctcttcctcctccgcggcgtcgctcctccgcctccgatccccgtcgccgtccggcccgggaggcaggctgcccccgcccccgcgctcgtacggcggcggcggatctggcgacgccgcggactccggcggcggcgacggccgccgcgggggcatcctcggcgtcttcctggccggctgggccgcccgcgtcgccgcggacccgcagttcccgttcaaggtgctcatggaggagatcgtcggcgtcaccgcctgcgtgctcggcgacatggcctcccgccccaacttcggcctcaacgagctcgacttcgtcttctccaccctcgtcgtcggatccatcctcaacttcgtcctcatgtacctcctcgcgcccaccgccagcgtcgccgccgccgcctcgtccgccgccgccgcgctccccagccacatgttcgagcccggcgcctactcgctcggctcccgcgtcgccaccctcgtgtccaagggcgcgaccttcgcgatggtcgggttcgcggccgggctcgccggcaccgcgctctccaacgggctcatcgccatgcggaagcgcatggacccggagttcgagactcccaacaagccgccgcccacgctgctcaacgcggccacctgggcgatccacatgggcgtcagcagcaacctgcgttaccagactctgaacggggtcgagtacctgctcggcaaggtagcgccggcgccagtgttcaaggtgtccatcgttgctctccgctgcatcaacaacatgcttggtggcatgtccttcgtgttgcttgccaggttgactggatcgcaaagatcagataagccagcgacggctgcagaaaagaaggaacggttgatagctgtggg

SEQ ID NO: 34965 - protein, 327 aa, Panicum virgatum
  misc_feature: Ceres CLONE 1958349
  misc_feature: Functional homolog of the protein sequence given in SEQ ID NO 50526
  misc_feature: Useful for making plants with modulated biomass
MASTAFAATKFLPAHLDSSPRIAPHRAGPTANLSFAPLSPSSSSAASLLRLRSPSPSGPGGRLPPPPRSYGGGGSGDAADSGGGDGRRGGILGVFLAGWAARVAADPQFPFKVLMEEIVGVTACVLGDMASRPNFGLNELDFVFSTLVVGSILNFVLMYLLAPTASVAAAASSAAAALPSHMFEPGAYSLGSRVATLVSKGATFAMVGFAAGLAGTALSNGLIAMRKRMDPEFETPNKPPPTLLNAATWAIHMGVSSNLRYQTLNGVEYLLGKVAPAPVFKVSIVALRCINNMLGGMSFVLLARLTGSQRSDKPATAAEKKERLIAV

SEQ ID NO: 34966 - DNA, 1231 bp, Panicum virgatum
  misc_feature: Ceres CLONE 1958357
  misc_feature: Encodes the peptide sequence at SEQ ID NO. 34967
accatgaaaacagcccatcagagtagacagcgagacgacagagaccttcaccaccgcttcacgcgcgcgcacggatattttcccttttcccttgcacacaacagatattttccgcttcaagaggggcgctgtggattttgctgacttcgcttcagcaagtcagagaagcaagaggggaagcgaagatccgatctccccccgcctttcccctccccccaaatccacaccatccgggccgcggccgcgccatgccgccctccgccgacgccatgtcggcccccggggacgccgccgccgccgccgccgccgacgtgcgcatgatctcctccaaggagctccgcgcgcacgcgtcccccgacgacctctggatctccatctccggcgacgtctacgacgtcacgccgtggctgccccaccaccccggcggggacctcccgctcgtcaccctcggcggcggatacggcaagggtggtggccttggagaagggatcggccacggcatcggtggcagctacgggaagggcggcgggctcggcgaaggaatcggccacggcatcggcggcggctacggcaagggcggcggcatcggtggcggctacggaaagggcggtggtcttggtggtggttacggcaagggtggcgggctcggcgaaggaatcggccatggcatcggtggaggctacggcaagggcggcggcctaggcagcgggatcggccacggtgttggtggcggcttcggtaagggcggcggaatcggccatggtgtcggcggcggcttcggcaagggcggcggccttggcggatcacgaggcggttacggcggtggtgctggcagcggcgtcggcagcggtggcttcggcaagggctttgggtttgggtacggcaacggcggcggcttcggcggtggaggtggcggaggcggtggcggcggcggcggcattggcggtcaccactgatagagatacgccggcacgtgttttccccagttccatcacttgagctctacatacctcagagcagatcgtgtttggtcgttgtgtgtcctgtgccctccggtttgttggagggatttgttcgtgcatgctttgtatgattgtatctttttgtcattaattccggtgatggtgatgccagtcacaatattatgtaagtacgtacgtgatccatgtaacgctccctgaatgattcgagaaatataaatgaagccaagcttttgttgaacgtggtcacc

SEQ ID NO: 34967 - protein, 228 aa, Panicum virgatum
  misc_feature: Ceres CLONE 1958357
  misc_feature: SWISSPROT Homolog: EC 1.1.2.3 L-lactate dehydrogenase (cytochrome)
  misc_feature: Functional homolog of the protein sequence given in SEQ ID NO 50178
  misc_feature: Useful for making plants with modulated nitrogen use efficiency
  misc_feature: Functional homolog of the protein sequence given in SEQ ID NO 50702
  misc_feature: Useful for making plants with altered lignin content
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50144
  misc_feature: Useful for making plants with altered terpenoid content
  misc_feature: Functional homolog of the protein sequence given in SEQ ID NO 50179
  misc_feature: Useful for making plants with modulated phosphate use efficiency
MSAPGDAAAAAAADVRMISSKELRAHASPDDLWISISGDVYDVTPWLPHHPGGDLPLVTLGGGYGKGGGLGEGIGHGIGGSYGKGGGLGEGIGHGIGGGYGKGGGIGGGYGKGGGLGGGYGKGGGLGEGIGHGIGGGYGKGGGLGSGIGHGVGGGFGKGGGIGHGVGGGFGKGGGLGGSRGGYGGGAGSGVGSGGFGKGFGFGYGNGGGFGGGGGGGGGGGGGIGGHH

SEQ ID NO: 34968 - DNA, 633 bp, Panicum virgatum
  misc_feature: Ceres CLONE 1958360
  misc_feature: Encodes the peptide sequence at SEQ ID NO. 34969
tcccttcccgggcggagcagttcccactccccactccacctccttctacgactacacccccgccctcaccgtccgctcccccactcccctccgtcgcgcttcccgaccccccctcgcgtcgtacggagctccccgtccagacggaacgccgacgccatgggggccttcgcgaaggaggagcaccagttcctcgccgagctcggcctcgcgccgcgcaacccgggatccttcgcctgcggggcctggggcggctcgggcgccgtagtcaccaccgccagcccgaccaacaaccaggttatcgcggaggttgtggaggcgtccgtgaacgactacgaggagggcatgcgcgcctgcttcggtgccgccaagacatggatggcgattccagctccgaagcggggagagattgttcggcaaattggtgacgcgctgagagcaaagctccatcaccttggcaggcttgtgtcacttgagatggggaaaaatcttccggaagggatcggggaggttcaggaaatcatcgacatgtgtgattatgctgtggggctaagtcgccaattaaatgggtccattataccatctgaacgtccaaaccatatggatgatggaggtgtggaatcctcttggagttgt

SEQ ID NO: 34969 - protein, 158 aa, Panicum virgatum
  misc_feature: Ceres CLONE 1958360
  misc_feature: SWISSPROT Homolog: EC 1.2.1.3 Aldehyde dehydrogenase (NAD(+))
MGAFAKEEHQFLAELGLAPRNPGSFACGAWGGSGAVVTTASPTNNQVIAEVVEASVNDYEEGMRACFGAAKTWMAIPAPKRGEIVRQIGDALRAKLHHLGRLVSLEMGKNLPEGIGEVQEIIDMCDYAVGLSRQLNGSIIPSERPNHMDDGGVESSWS

SEQ ID NO: 34970 - DNA, 717 bp, Panicum virgatum
  misc_feature: Ceres CLONE 1958384
  misc_feature: Encodes the peptide sequence at SEQ ID NO. 34971
gatccatacataaacttctacaagagtatggacagcttggtgaaccagcaatacgcagctacactcatcagatactttcaggcttagcatatttgcatgctaagaacacagtccacagggacatcaaaggtgcaaacatactagtagatccaagtggccgtgttaagcttgcagactttgggatggcgaaacatatcaacgggcagcattgtcctttctcatttaagggtagtccatactggatggctccagaggttataaaaaattctaatggatgcaaccttgcggttgacatatggagtttaggatgcactgtcctagaaatggctacctcgaagccaccgtggagccagtatgaagggattgctgcagtgttcaagattgggaacagcaaggaacttccatcaataccagatcacctttcagagcattgcaaggacttcattaggaagtgtctgcagcgtgacccatctcaacgtccaacatcagctgagcttttgcaacatccattcatacaaaatggaatttcacttgagaaatctgttgctcttaatcctttggaacatttggctgccatatcctgtagaccaaaacccaaggtgtccatgcagacaagaaatacctccttaggcttggagggtcagactatttaccagagaaggggtgtaaaactatcgtcaaaacacagtgatatccatataagaagcaatatatcct

SEQ ID NO: 34971 - protein, 238 aa, Panicum virgatum
  misc_feature: Ceres CLONE 1958384
  misc_feature (1)..(171): Pfam Name: Pkinase Pfam Description: Protein kinase domain
  misc_feature: SWISSPROT Homolog: EC 2.7.11.25 Mitogen-activated protein kinase kinase kinase
SIHKLLQEYGQLGEPAIRSYTHQILSGLAYLHAKNTVHRDIKGANILVDPSGRVKLADFGMAKHINGQHCPFSFKGSPYWMAPEVIKNSNGCNLAVDIWSLGCTVLEMATSKPPWSQYEGIAAVFKIGNSKELPSIPDHLSEHCKDFIRKCLQRDPSQRPTSAELLQHPFIQNGISLEKSVALNPLEHLAAISCRPKPKVSMQTRNTSLGLEGQTIYQRRGVKLSSKHSDIHIRSNIS

SEQ ID NO: 34972 - DNA, 702 bp, Panicum virgatum
  misc_feature: Ceres CLONE 1958385
  misc_feature: Encodes the peptide sequence at SEQ ID NO. 34973
aattccctctcatctcgcgtctccgcacggagggccgccccctcctcgtccgccgcctgccgccggcgcgctctccattaccccggcgatggcctgcctatccaaaaccagcctcaccaatcacgtctagcaagcacagagccacgcgtcacaacaacacatcctccgcgtcaggccggatcggcaggaagaagatggaggcgagcgtgggcatccgggcgcggcccggtgcctgggccgggctcgagaagccgcgcggcgcctactctgcaagagccccgccggtgaggctcacgccggagaagctgccggagaggctggctctgggaaccggtccgcggcggagcacggatcctgtgctccgtgccgcaaagctgaaagcttcgtgctgcaagaaatcggcaggtactgaaaaggtccactactctgctgatgaagctctcatactacagcaaaaagcccaggatgttctcccttacttggatggccgatgtgtttatctagtcggaatgatgggttcaggcaaaactacagttgggaagatattagctgaagtactaggttattctttctttgacagtgataagttggtagagaaggctgtcggtatatcatctgttgctgagatttttcagctccacagtgaagcattcttcagagataatgaggtacatgtctatttctctagtgcgatttattaaa

SEQ ID NO: 34973 - protein, 168 aa, Panicum virgatum
  misc_feature: Ceres CLONE 1958385
  misc_feature: SWISSPROT Homolog: EC 2.7.1.71 Shikimate kinase
MEASVGIRARPGAWAGLEKPRGAYSARAPPVRLTPEKLPERLALGTGPRRSTDPVLRAAKLKASCCKKSAGTEKVHYSADEALILQQKAQDVLPYLDGRCVYLVGMMGSGKTTVGKILAEVLGYSFFDSDKLVEKAVGISSVAEIFQLHSEAFFRDNEVHVYFSSAIY

SEQ ID NO: 34974 - DNA, 692 bp, Panicum virgatum
  misc_feature: Ceres CLONE 1958388
  misc_feature: Encodes the peptide sequence at SEQ ID NO. 34975
ggaagcggaagaagggcaaacgagccgccccctcctcccccgcgccgccgacagaagcgcccgccacggcagccccagccgccatggagtccgaagcggacgccgccactacgacctacgtctacgacgctctcccggggctgaccctggccttctcgccggaggaggccctcgacgacggagccgagccccggccggcccccgccgccgcggggcaggacggggatgatgctaccgcgacctacgccgtcttccgcaacgagataacggcggctggggatgctctcgtggacattcccgcggcggacttcttctcgcttgacgtctccgcctctgcctccgtcgaggccgagcgggcctctccgcaggccccggcgtccgcggccgcggcggcgacgccctcgagctcccgcgctgcggaggagcagccagcgcaggggtcggagcgcgcgtggttccggggagggaggcggatcaggagccccatgctgcagctacacaaggagattctcgacttctgcgattttatctcaccttctactgaagagcaatcttcacggacagctgctgtgcgagctgtctccgatgttgtcaaacatatatggcctcagtgcagggtggaagtctttggatctttcagagcacggctctatctaccaacaagtgatattgatgttgtaatatttgattcc

SEQ ID NO: 34975 - protein, 202 aa, Panicum virgatum
  misc_feature: Ceres CLONE 1958388
  misc_feature: SWISSPROT Homolog: EC 2.7.7.19 Polynucleotide adenylyltransferase
MESEADAATTTYVYDALPGLTLAFSPEEALDDGAEPRPAPAAAGQDGDDATATYAVFRNEITAAGDALVDIPAADFFSLDVSASASVEAERASPQAPASAAAAATPSSSRAAEEQPAQGSERAWFRGGRRIRSPMLQLHKEILDFCDFISPSTEEQSSRTAAVRAVSDVVKHIWPQCRVEVFGSFRARLYLPTSDIDVVIFD

SEQ ID NO: 34976 - DNA, 1257 bp, Panicum virgatum
  misc_feature: Ceres CLONE 1958404
  misc_feature: Encodes the peptide sequence at SEQ ID NO. 34977
agggagccggcgcggcgcaagcaggacggcagaatcgccgaccaggcgaccacgttgggctccgaactcgctcctgttccgccgccgccgcaatcggcctcgcttcatcgggggaagccggaaacctcacagcagccgagggtacgcgagaagccaggccccgccttccgcacgaactcttccctcgccctcccgcttctgcagcttgattgccgtgggggtggaaattcagcggaatttccgctggtttcttcacttgttggtaagcaagagaaaatcgacaaatgacataagctggaaagaatgggttacggcatgagtaggctagaagatgaatactatgagcctgaagtgcaggaaactgatggatctagttcagttaaagtgaatgatgagttctcaaaattacataatgatattttccatatgactcgaatgagatcaggacttagtgaaagcatttataagtccatgggtaccaacagaggcataatatcaatggccaagttgttatctggaagggaagttgattgttctggaaagggaatgttctcttcaggtgaccgtgcatttgttctaggtcgctatgttccaatgaacggtcctgaattcttggataggatggattctcgtgcttatgtttcacagttttctgccgatggtactctttttgttgctggttttcagggaagtcacataagaatatatgatgttgatagaggctggatcgtacacaaggacattcatgctagaagtctgagatggacaatcagtgatgtatccttatcacctgatcaacggtaccttgtctactctagtctggcacctattatccatattgtcaatgttgggaatgcggcaagagaatcatatgctaatgtcactgatattcatgatggattggatttttcacagcatgaagatgttcagtatgcctttggaatattttctgtgaaattttcctctgatggccgggaacttgttgctggcagcaatgatgaatcaatatatgtctacgaccttcacacaaacaaattgacattgcgtttacctgctcatacatctgatgtcaacacggtagcatttgctgatgaaagtggccatctcatatattctggaagtgatgacacattatgcaaggtctgggacagacgttgtttgtccacaggacaagctgccggggttttgactggacatttgcatggaataacgcatattgatagtcatggagatggccggagttttcatatccaatgg

SEQ ID NO: 34977 - protein, 317 aa, Panicum virgatum
  misc_feature: Ceres CLONE 1958404
  misc_feature (243)..(282): Pfam Name: WD40 Pfam Description: WD domain, G-beta repeat
  misc_feature: SWISSPROT Homolog: EC 2.7.11.7 [Myosin heavy-chain] kinase
MGYGMSRLEDEYYEPEVQETDGSSSVKVNDEFSKLHNDIFHMTRMRSGLSESIYKSMGTNRGIISMAKLLSGREVDCSGKGMFSSGDRAFVLGRYVPMNGPEFLDRMDSRAYVSQFSADGTLFVAGFQGSHIRIYDVDRGWIVHKDIHARSLRWTISDVSLSPDQRYLVYSSLAPIIHIVNVGNAARESYANVTDIHDGLDFSQHEDVQYAFGIFSVKFSSDGRELVAGSNDESIYVYDLHTNKLTLRLPAHTSDVNTVAFADESGHLIYSGSDDTLCKVWDRRCLSTGQAAGVLTGHLHGITHIDSHGDGRSFHIQ

SEQ ID NO: 34978 - DNA, 720 bp, Panicum virgatum
  misc_feature: Ceres CLONE 1958406
  misc_feature: Encodes the peptide sequence at SEQ ID NO. 34979
acagagcaccagaccatctcagctttgcttctcagctatctttaggctccggttgctgcgagaagcaaggcaggcatggaggggaaggaggaggacgtccgcctgggcgccaacaatttctccgagcgccagcccatcggcacggcggcgcaaggcaccgatgacaaggactacaaggagcccccgccggcgccgctcttcgagcccggggagctcaagtcctggtccttctaccgcgccggcatcgccgagttcgtcgccaccttcctcttcctctacatcagcatcctcaccgtgatgggcgtcagcaagtcccaatccaagtgcgccctcgtcttctttgccttcttttctccctcgggcgctagggttcttggcttcttcttcttggttgtgaggtgataggagatgtataggaggggagcaggacgagcagggaggcagatctggagagatgggctccaacgaggcggatctggatgaggctgtgatggcgtccgtgcagagggtggccatggcgagaactccttcccgccttggctcacaaatcgggcactcctgagatgctggagcttggtaagtcgatcagcaggagctacaggtagagctctgtttttcttctcttttgtttcgtatgtataatgatgattgttgaattgtggaattaccttttttcctatctattccctacctttcagaggtgaaaagtggatcttagat

SEQ ID NO: 34979 - protein, 108 aa, Panicum virgatum
  misc_feature: Ceres CLONE 1958406
  misc_feature: Functional homolog of the protein sequence given in SEQ ID NO 50195
  misc_feature: Useful for making plants with modulated water use efficiency
MEGKEEDVRLGANNFSERQPIGTAAQGTDDKDYKEPPPAPLFEPGELKSWSFYRAGIAEFVATFLFLYISILTVMGVSKSQSKCALVFFAFFSPSGARVLGFFFLVVR

SEQ ID NO: 34980 - DNA, 616 bp, Panicum virgatum
  misc_feature: Ceres CLONE 1958419
  misc_feature: Encodes the peptide sequence at SEQ ID NO. 34981
tcgcctctcctgcgtttgcatccccattcccccctcgcgcacatcccgtcgtcgagctccgatccgctcgaggaagcagcagcgcgcggccggcccggcaatgacgatgatggcgccgcagccgcatcccctgccgctggcgcagccggcgccgccgccgccgccggcgttcggggacaccacgctgaccaaggtgttcgtgggcgggctggcgtgggagacccacaaggacacgctccgcgagcacttcgagcgcttcggcgacatcctcgaggccgtcatcatctccgacaagctcaccggccgctccaagggctacggcttcgtgacgttcaaggaggcggacgcggcgaagaaagcgtgcgaggacgccacccccgtcatcaacggccgccgcgccaactgcaacctggcgtccctcggcgccaagccgcgggcccagccgccgcacctcctccgcccctcgccgccgtccaccccggcgccgcacgcgcacgcgcacgcccccgcgcccgcgctcccgtccccgcaccaacccgcgccagccatcgcggtggggtccaggggcgtctcgccggtgccgtggtactaccacccctccaccacgccgccgccg

SEQ ID NO: 34981 - protein, 171 aa, Panicum virgatum
  misc_feature: Ceres CLONE 1958419
  misc_feature (32)..(102): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50671
  misc_feature: Useful for making plants with modulated biomass
MTMMAPQPHPLPLAQPAPPPPPAFGDTTLTKVFVGGLAWETHKDTLREHFERFGDILEAVIISDKLTGRSKGYGFVTFKEADAAKKACEDATPVINGRRANCNLASLGAKPRAQPPHLLRPSPPSTPAPHAHAHAPAPALPSPHQPAPAIAVGSRGVSPVPWYYHPSTTPP

SEQ ID NO: 34982 - DNA, 685 bp, Panicum virgatum
  misc_feature: Ceres CLONE 1958420
  misc_feature: Encodes the peptide sequence at SEQ ID NO. 34983
acataccaagtgagctcggtaacctgattcagctgcagattgtgcttgatttgagcagcaactccatgtctggtcctatcccttcaaatcttgagaagctgacgaacctacagaaactgaatttgtcacgcaacgagctcagcggctcaattccagcaggtttctcgcgcatgccaagcctagaaacggttgatttctcttacaatcagctcactggtgagataccatcaggcaatgcttttcagaactcttcggctgaggcttacatcgggaatctggggctttgcggcaatgtgcaaggcattccttcttgcgaccacagcgcctcttcagggcatcacaagagaacagtcattgaaatagttctctcagtagttggagcagtgttgctggcagccattgttgcttaccttatcctagcatgcagaagaagacccagggagcagaaagtgttggaggtgagcacatgtgatccttatgaatccatgatatgggaaaaggagggaaaattcacgttcctcgacatcgtgaacgccactgacagtttcagtgaatccttctgcattgggaaaggtgggtttgggagcgtgtataaggccgaactcgccagtgggcaagttatggccgtgaagcgcttccatgtcgctgagacaggagacatatcggaagtgagcaagaagagctt

SEQ ID NO: 34983 - protein, 227 aa, Panicum virgatum
  misc_feature: Ceres CLONE 1958420
  misc_feature: SWISSPROT Homolog: EC 2.7.11.1 Non-specific serine/threonine protein kinase
IPSELGNLIQLQIVLDLSSNSMSGPIPSNLEKLTNLQKLNLSRNELSGSIPAGFSRMPSLETVDFSYNQLTGEIPSGNAFQNSSAEAYIGNLGLCGNVQGIPSCDHSASSGHHKRTVIEIVLSVVGAVLLAAIVAYLILACRRRPREQKVLEVSTCDPYESMIWEKEGKFTFLDIVNATDSFSESFCIGKGGFGSVYKAELASGQVMAVKRFHVAETGDISEVSKKS

SEQ ID NO: 34984 - DNA, 1277 bp, Panicum virgatum
  misc_feature: Ceres CLONE 1958439
  misc_feature: Encodes the peptide sequence at SEQ ID NO. 34985
atttttcgctccacgaatacgaagctactctctaccgttgagttaactgttgctcaccatggctgaccacctttatgcgagaaagaatgatgctctcaatgtcaaccctgacattgtcaatgggcaacgcagtgacattaatatcaccgtcagaggctctgactggtactgggctgtctgcgcagtcatgaccgtttcaacctttgcgttcctcgggcttggaatgagaaagcctcgcaccgatcgtatcttccactacatcactgcaggtatcaccatgatcgcatctatcgcatacttcacgatggcttcgaacctcggctggactcctatcgcggttgagttccagaggtccaaccacagggtcgccgggatctacagagagatcttctatgcaagatacattgactggttcttgacaactcctcttctactcacagatcttcttcttactgctagcatgccctggccgactgtgctgtgggtgattctcgtggactgggtgatgattgtcactggattggtcggagccctcgtgaagagttcctacaagtggggttatttcgccttcggttgcgctgccctcgcatacatcgtttacrtgctcgcttgggaagctcgtctacatgctaagcacgttggccctgatgtcggccgaacctttgtcatgtgcggttccctcacagccgttgtctggattctctatcccattgcctggggcgtctgtgaaggaggtaacttgattgcccctgactctgaggctgtcttctacggcatcctcgatctcattgcgaagcctgtctttggagccttgcttctctggggacacagaaatatcgaccctgctcgtcttggccttcgtattcgcgacattgacgagcgcatcttcccagatggtcccaacaacaaggttgcatctggacatggtgcccgaaacgatactgccactgcctctggcgctaatgtcaacccaaacgcctgagtggaaggttacaaacagacggaatgggctattagacctttggatcccccattatcttctttatcaatctctagcgcagttttctggtcaattagtcaaccgaccctgttgtatgctgagtcggacacttgcgtatagttttcatgtacaagtactggtctgatgatacccgaagtttgtttcgtggcacggatatgtcttggagccttgttttaatcgtctaatctcaatctttgaatctctcattctattacatagccatatcttcctcaattcactcattgattcaacaccg

SEQ ID NO: 34985 - protein, 307 aa, Panicum virgatum
  misc_feature: Ceres CLONE 1958439
  misc_feature (34)..(271): Pfam Name: Bac_rhodopsin Pfam Description: Bacteriorhodopsin
  misc_feature (182)..(182): Xaa is any aa, unknown, or other
MADHLYARKNDALNVNPDIVNGQRSDINITVRGSDWYWAVCAVMTVSTFAFLGLGMRKPRTDRIFHYITAGITMIASIAYFTMASNLGWTPIAVEFQRSNHRVAGIYREIFYARYIDWFLTTPLLLTDLLLTASMPWPTVLWVILVDWVMIVTGLVGALVKSSYKWGYFAFGCAALAYIVYXLAWEARLHAKHVGPDVGRTFVMCGSLTAVVWILYPIAWGVCEGGNLIAPDSEAVFYGILDLIAKPVFGALLLWGHRNIDPARLGLRIRDIDERIFPDGPNNKVASGHGARNDTATASGANVNPNA

SEQ ID NO: 34986 - DNA, 632 bp, Panicum virgatum
  misc_feature: Ceres CLONE 1958440
  misc_feature: Encodes the peptide sequence at SEQ ID NO. 34987
agctcctccctccctctccttctacctctttctctttcccttccgtttgtgttctaagagggagagagacagagagggcacatgctccgtttgctagcttcagttcgatctgtgtagctctgctaggtcctttcacccgactttcagaattcattatcatcatccgatcgatcggtcgtcggtggtgcagaaggagccggagagtcaggtaggctactgtccaagctaagaagagacactagccgcagtagtcacgctgccaccacacagctagctgcgtacttggactggcagtcgcagtgtgaccggccggtagctcgctgcttgttgcttctcgatctctaccactacatactccagctgctaacgcagcagcaggtgctgccgtgaccaatccaatcgtcaactcgtcagctagctagctgagatcgatcatcgatacatggcggctgcccacctgttcggactcggcgacgcgcagacgatgcagccgccgctgccgcagcaggcggcgcctcctcctccggcggccgcgccggcgcccaagaagaagaggaaccagcccgatcccgacgcggaggtgatcgctctgtccccgaagacgctgctggcgacgaaccggttcgtgtgcg

SEQ ID NO: 34987 - protein, 63 aa, Panicum virgatum
  misc_feature: Ceres CLONE 1958440
  misc_feature: Functional homolog of the protein sequence given in SEQ ID NO 50915
  misc_feature: Useful for making plants with altered lignin content
  misc_feature: The sequence is a functional homolog of SEQ ID NO 650 in the 10/666,642 US patent application
  misc_feature: The sequence is a functional homolog of SEQ ID NO 312 in the 10/666,642 US patent application
MAAAHLFGLGDAQTMQPPLPQQAAPPPPAAAPAPKKKRNQPDPDAEVIALSPKTLLATNRFVC

SEQ ID NO: 34988 - DNA, 546 bp, Panicum virgatum
  misc_feature: Ceres CLONE 1958440-R
ttccgggagcggtggcttccccggcatggacgaggggaagctgagcacgagagacttccttggcgtcggcggcggcgtcgtgcggagcatgggcggcgcggcggggcttccgctgcggcacggcgccgcgggcattggcatgggctcattggacccagaaatgaagtaggagattaatcatcgaatggaaattagcaaccaaggcaaggcatgcattgatcattgagccatggacaaattaaatatctctgtgactcttgcatgcaaggtaagcatatagcagcagcctagctactgactagggttcatggagttgcattggttggtgaatgaagatgatgaggccatcaaccatcatcatctgtgttatggtgctgcaaggtgaatattatagtggtgatgatttgaatgatccatgttgcactgatgtgttgttcaatggtgagttggccatgggatgtattgtagggaactgtagcttctggacaacatgaatttcgaccaagaaataataatagcagaaaggccggaccgtttacattcctt

SEQ ID NO: 34989 - DNA, 711 bp, Panicum virgatum
  misc_feature: Ceres CLONE 1958446
  misc_feature: Encodes the peptide sequence at SEQ ID NO. 34990
gtctttcggagaccacccgtttccaccgtagcggctttgccctgttcgccttgtccgaggagaaggcctcctctgcctcggcgggccgccgtcccagccgcagcggcgcgctctccatggcgtcctaatcagcgacaacgccgccacgagcctgcgtgaaaatgacattcttgtcctgatttgagagtgtactgattggattcgctttctgtgagatattttggacctgcttgccaaaagcagagcctaaggtttcgtgtatgatgccaagcatggatgaagcccttcttggcaatggtgttcagaagaccggaggggtgggagagaacctggtgctgcctgaggtcagaaagcagctgcaccttgctgggccactcattgccgcatggatcctgcagaacatcgtccagatgatatctgtcatgtttgttggtcacctcggtgagcttgcactctcctgtgcctccatcgccacctcttttgcaggtgttactggcttcagcttattgtctggcatggcaagcagcttggacacactgtgtgggcaagcctttggggcaaagcagtactatcttctcggtatctacaagcagagggccatccttgttctcactctggtgagccttgtggttgctgttatctggtcgtacactggccagatccttctagtctttggtcaggacccagagattgcagctggagcagggagct

SEQ ID NO: 34990 - protein, 146 aa, Panicum virgatum
  misc_feature: Ceres CLONE 1958446
  misc_feature (34)..(146): Pfam Name: MatE Pfam Description: MatE
MDEALLGNGVQKTGGVGENLVLPEVRKQLHLAGPLIAAWILQNIVQMISVMFVGHLGELALSCASIATSFAGVTGFSLLSGMASSLDTLCGQAFGAKQYYLLGIYKQRAILVLTLVSLVVAVIWSYTGQILLVFGQDPEIAAGAGS

SEQ ID NO: 34991 - DNA, 598 bp, Panicum virgatum
  misc_feature: Ceres CLONE 1958453
  misc_feature: Encodes the peptide sequence at SEQ ID NO. 34992
gacgtgctcctgggccggcgcgacgcgacgacggcgagcatcgacgacgccaacaacgacatcccgaccccgttcatggacctgccggcgctgctggccaacttcgagtcccacggcctctccctgcacgacctcgtggtgctctccggcggccacacgctgggctactcccggtgcctcttcttccggagccgcctctacaacgagactgacacgctggacccggcctacgcggcgtcgctggacgagcgctgcccggcatcccccggcgatgacgacgacgcgctgtcggcgctggacgacacccccaccaccgtggacaccgactactaccagggcctcatgcagggccgcgcgctgctgcactcggaccagcagctgtacctgggcggcgccggcggcgccgacgacctggtcaagtactacgccgagaaccccagcaagttctgggaggacttcggcgccgccatggtgaagatgggcaacctcagcccgctcaccggcgaccaaggcgaggtcagggagaactgccgggtcgtcaaccagcagtgatcgatcgctttctcgtgatggaacgagacagagcagcttcagtgtc

SEQ ID NO: 34992 - protein, 183 aa, Panicum virgatum
  misc_feature: Ceres CLONE 1958453
  misc_feature (1)..(145): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50828
  misc_feature: Useful for making plants with altered carbohydrate content
DVLLGRRDATTASIDDANNDIPTPFMDLPALLANFESHGLSLHDLVVLSGGHTLGYSRCLFFRSRLYNETDTLDPAYAASLDERCPASPGDDDDALSALDDTPTTVDTDYYQGLMQGRALLHSDQQLYLGGAGGADDLVKYYAENPSKFWEDFGAAMVKMGNLSPLTGDQGEVRENCRVVNQQ

SEQ ID NO: 34993 - DNA, 1733 bp, Panicum virgatum
  misc_feature: Ceres CLONE 1958462
  misc_feature: Encodes the peptide sequence at SEQ ID NO. 34994
atccaacccacacacacacaccaattaggtgacagagacgagttatcccagtagctcatcctccttcctcaccagtcctcccatgagtcaaacactgcagctctgaacagcgaccgctggtcatcaatggcgcaccacggcggccagtccctggagctcgccgccgcccccgagctcgacgacgacggccacgccccgcgcaccgggaacctatggacatgcttcgcgcacatcatcaccggcgtgatcggctgcggcgtgctcgcgctctcgtggagcgtggcgcagctgggatgggtcggcggcaccgtcgccatggtctgcttcgccttcgtcacctacatctcggccttcctgctgtcccactgctacagatcccctgacctggagaaaaggcagaggaactacaactacatggacgccgtcaggacgcacctaggggaaaagcgcacctggctctgtggcctcctccagtacctgaacctgtacgggacttgcattgcttacaccatcaccaccgcgacttgtctcagggcgatcaagagggccaactgctaccacaacgaagggcacgacgctccctgcggcgcacacggcgagcacttctacatgctgctctttggtgcggcgcagctggtgctgtccttcatacccaacttccacagcatggcgtggctctccgtcgtcgcggcgatcatgtccttcacctactccaccatcgggctcggcctcggattcgccaagaccatagagaatgggacgatcaaaggaagcatcgccggcgttccgatgagcaccccggcgcagaaagtctggcgagtggctcaggcaatcggcgacatcgcattcgcgtacccgtacaccttagtcctactggaaatacaggacacgctgaaatcgccaccccctgagagcgagacgatgcagaagggcaacgtgatcgcggtcctggcgaccaccttcttctacctcggcgtggggtgcttcgggtacgccgccttcggcaacgcggcgccgggcaacctgctcaccggcttcggcttctacgagccctactggctcatagacttcgccaacgcctgcatcgtgctccacctgcttggtggctaccagatgttcagccaacaaatcttcacgttcgcggaccggtgctcggcggcgatgttcccggacagcgcgttcgtgaacaggttctacgccgtgagggtgccgggcgtggcggcgagctaccagctgaacctgcagcgggtgtgcttccggacggcgtacgtggcgagcaccacggggctggcgctgctgttcccctacttcaacgaggtgctgggcgtgctgggcgcgctcatcttctggcccctcgtcatctacctccccgtcgagatgtactgcgtccagcgggggatcacgccgtggacgcgcggatggctcgcgctccaggccttcagcgccgtgtgcttcgtcgtcggcaccttcgcgctcgtcggctccgtggaaggcgtcgtcaggaagaggctcggctagtggcctagtgctgctcgatctcccacacggaagatgttaaaaagagaacaaacaaactatgacctagtgctacacttttcatgttccttttacacgtgctgatgatcgtgcgtttgttttcgtcacattaaaaaatatctagtttgttggtgacgtatgttagtttttttaaatatatgtaagttaattggcaataattttacgggagaattcac

SEQ ID NO: 34994 - protein, 463 aa, Panicum virgatum
  misc_feature: Ceres CLONE 1958462
  misc_feature (25)..(459): Pfam Name: Aa_trans Pfam Description: Transmembrane amino acid transporter protein
MAHHGGQSLELAAAPELDDDGHAPRTGNLWTCFAHIITGVIGCGVLALSWSVAQLGWVGGTVAMVCFAFVTYISAFLLSHCYRSPDLEKRQRNYNYMDAVRTHLGEKRTWLCGLLQYLNLYGTCIAYTITTATCLRAIKRANCYHNEGHDAPCGAHGEHFYMLLFGAAQLVLSFIPNFHSMAWLSVVAAIMSFTYSTIGLGLGFAKTIENGTIKGSIAGVPMSTPAQKVWRVAQAIGDIAFAYPYTLVLLEIQDTLKSPPPESETMQKGNVIAVLATTFFYLGVGCFGYAAFGNAAPGNLLTGFGFYEPYWLIDFANACIVLHLLGGYQMFSQQIFTFADRCSAAMFPDSAFVNRFYAVRVPGVAASYQLNLQRVCFRTAYVASTTGLALLFPYFNEVLGVLGALIFWPLVIYLPVEMYCVQRGITPWTRGWLALQAFSAVCFVVGTFALVGSVEGVVRKRLG

SEQ ID NO: 34995 - DNA, 652 bp, Panicum virgatum
  misc_feature: Ceres CLONE 1958465
  misc_feature: Encodes the peptide sequence at SEQ ID NO. 34996
aggcagcatttgtaaaatcaccgagctcgccgtccagtgcggtgcggcgcaggaggcgagagccaaccgacgtcactccaccaaccgcggcgcgcgtgattcggtcaggaggagatgggaatcggttggcatcgtctgctcatctccatctgctccgccccgcccgccgatggacaccccatccatccatccatcctcgcagcaggaaaggatagatagatagagaagatcgatcggctcatcggcagatgctgtccatggtgcggcggccgctctccaccgccgtgcccgccggcaacctcctcggcatccacctcttccagtgccccgacaccgtgggcatcgtcgccaagctgtccgagtgcatcgcgtcccgcggcggcaacatccacagcgtcgacgtcttcgtccccgacgacaagcgcgtcttctactcccgcagtgaattcacctacaacccaaggctctggccgcgtgacgagctgcacaaggatttcctcaacctgtcacactgctttagtgcgcagaggtcgaccgtacgagtgcctgatcttgaccccaaatacaagatctcagtcctcgcttcaaagcaggaccattgtttgtttgatttattgtatagatggcaagaaggcaggcttccagttgacat

SEQ ID NO: 34996 - protein, 134 aa, Panicum virgatum
  misc_feature: Ceres CLONE 1958465
  misc_feature: SWISSPROT Homolog: EC 3.5.1.10 Formyltetrahydrofolate deformylase
MLSMVRRPLSTAVPAGNLLGIHLFQCPDTVGIVAKLSECIASRGGNIHSVDVFVPDDKRVFYSRSEFTYNPRLWPRDELHKDFLNLSHCFSAQRSTVRVPDLDPKYKISVLASKQDHCLFDLLYRWQEGRLPVD

SEQ ID NO: 34997 - DNA, 615 bp, Panicum virgatum
  misc_feature: Ceres CLONE 1958470
  misc_feature: Encodes the peptide sequence at SEQ ID NO. 34998
actcgtcttttttcttcgccccgcccgaagccgagcttgtagggcatttgatccatggcttcttcaccctcgaacagcttaccaattccctctcctgggcctatgaagaaaagaggttcctgctggcagaagaggtggtcgctatcaagctcaatgcccagcatttctggtgggatgaggctcaggatggtgttatccaggatcatatggtcagcagggactcatattttgccgtattgactcctgagcaagtggacgcaatgagacaggccctcgatgtcctcgacgctccggagcaagggctaaactggtggtttaactacaaggccggaggctggaacgaagaaaagtggtgcagcgagaccgcgcgcgcccgagatctccaggaagttgtggcaacatggggctcaccttcacgaagctcttcagccgcctcttctccaagaaggagatgaggatcctcatggtcggtctcgatgcagctggtaacaccaccatcctctacaagctgaagctcggagagatcgtcaccaccattcccacaatcgggttcaatatggagactgtcgaatactataacattagctttactgtctggtatgtcgcgggtcaaga

SEQ ID NO: 34998 - protein, 71 aa, Panicum virgatum
  misc_feature: Ceres CLONE 1958470
  misc_feature (5)..(71): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content
MGLTFTKLFSRLFSKKEMRILMVGLDAAGNTTILYKLKLGEIVTTIPTIGFNMETVEYYNISFTVWYVAGQ

SEQ ID NO: 34999 - DNA, 574 bp, Panicum virgatum
  misc_feature: Ceres CLONE 1958480
  misc_feature: Encodes the peptide sequence at SEQ ID NO. 35000
cgtcgtccggcatcctcttctgccggcactacgtgctcggctggagcttcagcatggacggcgccgccccggcgctcaacatctcctccctgcccaccctgccggtcacggcccccaagccgcggtccaggacgctgcagatcgtgctgccgatcgcttccgcggcgctcgtgctcgcggtgggcgccgccgccttcgcgctcctgcggcggcggcgcatgtacgcggaggtgaaggaggagtgggaggccacgttcggcccgcacaggttctcgtacaaggacctgtaccacgccaccgacgggttcagcgacaagcggctgctcggcatcggcgtcttcgggcgggtgtaccacggcgtcctggcgtccaaggtggaggtcgcggtgaagaaggtggcgcacgggtctcggcaggggatgcgggagttcgtggccgaggtcgtcagcatcggccggctccgccaccgcaacctcgtgcagctgctcggctactgccggcgcaagggcgagctcctcctggtctacgactacatgcccagcggcagcctcgacaggtacctccacgaccagag

SEQ ID NO: 35000 - protein, 190 aa, Panicum virgatum
  misc_feature: Ceres CLONE 1958480
  misc_feature: SWISSPROT Homolog: EC 2.7.11.1 Non-specific serine/threonine protein kinase
SSGILFCRHYVLGWSFSMDGAAPALNISSLPTLPVTAPKPRSRTLQIVLPIASAALVLAVGAAAFALLRRRRMYAEVKEEWEATFGPHRFSYKDLYHATDGFSDKRLLGIGVFGRVYHGVLASKVEVAVKKVAHGSRQGMREFVAEVVSIGRLRHRNLVQLLGYCRRKGELLLVYDYMPSGSLDRYLHDQ

SEQ ID NO: 35001 - DNA, 643 bp, Panicum virgatum
  misc_feature: Ceres CLONE 1958499
  misc_feature: Encodes the peptide sequence at SEQ ID NO. 35002
aagcaagcgcacaccacaactctctcacctgtttcttgaagcagaggcttcagagcttcgcttggccatgggaattgcaattaggctgctcttcctgccgttgatggccgtggcattctgcggctacggcgtttggggaaggagccacttccacaagaagccgccgcgcggcgtcggccggcacaggggcggcggcaaggagcgttccgtggtgtcctccccggcggacgacggcacgcgcccggtcgagccgcagccaccgacgggcaccgtgccctccgacccggccactccggtccagcccgcggagccgtgtgtgttcgacgtccgggcgtacggcgcggtgggcgacggcacgacggacgacacccaggcgttccgggaggcgtggagggcggcctgcgcctccaactccgccgtactgctggtgccgtctgacggcacgttcaccatcaccaccaccaccttctccgggccgtgcaagcccggcctcgtgttccaagtggacggcgtgctgatgccgccggacgggccggactgctggccgccgtcggacaaccggcggcagtgggtcgtcttctccaacatcgacggcatgaccctgcgcggcgccggcacgatcgagggcaacggcgaggactgg

SEQ ID NO: 35002 - protein, 191 aa, Panicum virgatum
  misc_feature: Ceres CLONE 1958499
  misc_feature: SWISSPROT Homolog: EC 3.2.1.15 Polygalacturonase
  misc_feature: Functional homolog of the protein sequence given in SEQ ID NO 51472
  misc_feature: Useful for making plants with altered cell wall content and/or composition
MGIAIRLLFLPLMAVAFCGYGVWGRSHFHKKPPRGVGRHRGGGKERSVVSSPADDGTRPVEPQPPTGTVPSDPATPVQPAEPCVFDVRAYGAVGDGTTDDTQAFREAWRAACASNSAVLLVPSDGTFTITTTTFSGPCKPGLVFQVDGVLMPPDGPDCWPPSDNRRQWVVFSNIDGMTLRGAGTIEGNGED

SEQ ID NO: 35003 - DNA, 1134 bp, Panicum virgatum
  misc_feature: Ceres CLONE 1958509
  misc_feature: Encodes the peptide sequence at SEQ ID NO. 35004
gaaaaaaaaaaactccgaaggagccttccgcgcgacgctccccagggcagcagcaccgcagcagggctccaccccacctaaaaccctagaccacccgcgggagcggagtggagcggagggggagcctcgcccgtctcagattccgcccggcaccggcgcggccccacccgccgccatgaagctgacggtgaagaccctcaagggcacgcacttcgagatccgggtgcagcccaacgacacgattatggctgtgaagaaaaacatcgaagagaaacaaggaaaggatagctatccatggggtcaacaactgctgattttcaacgggcaggttttgaaagatgaaagtacattggatgagaacaaagtcagcgaagatggctttctagttgtcatgctcagtaagagcaaaacatctggttcaagtggaacctcatctgcccagccctcaagcactcctgcaaccaggcagccacctcctgtagatcctccacggcaagctccgcaacccccggtggcagcagctacaacttctcagcctgaaggacttcatgcacagaccccttcaaacacatatgacaattcagcatcaaatctactatcaggaagcaatattgacacaatgattaaccaactgatggagatgggtggaggcagttgggacagagataaagtccaaagggctcttcgtgctgcttacaacaacccagaacgagctgttgaatacctgtactctggtattccagtaacagctgaagttgctgttccagttggtgttcaaggaggaaacacaactgatcaaccttctataggggaagatgatctcactggaattccaaacagtgctccattaaatcttttccctcaggggggttccaatgctggaggtggtgctggaggtggaccacttgagtttcttagaaacaaccaacagtttcaagtacttagggaaatggtccaaacaaatccacaaatcttgcagcctatgctccaggaattgagcaagcagaatcctcaaattctaaggtcgattcaggagaatcatgctgagttccttcagttaataaatgagccctttgaagatggcgagggggacttcttagaacaacctgagcaggatgaaatgcctcttgctat

SEQ ID NO: 35004 - protein, 319 aa, Panicum virgatum
  misc_feature: Ceres CLONE 1958509
  misc_feature (244)..(302): Pfam Name: XPC-binding Pfam Description: XPC-binding domain
  misc_feature (6)..(78): Pfam Name: ubiquitin Pfam Description: Ubiquitin family
  misc_feature (145)..(184): Pfam Name: UBA Pfam Description: UBA/TS-N domain
MKLTVKTLKGTHFEIRVQPNDTIMAVKKNIEEKQGKDSYPWGQQLLIFNGQVLKDESTLDENKVSEDGFLVVMLSKSKTSGSSGTSSAQPSSTPATRQPPPVDPPRQAPQPPVAAATTSQPEGLHAQTPSNTYDNSASNLLSGSNIDTMINQLMEMGGGSWDRDKVQRALRAAYNNPERAVEYLYSGIPVTAEVAVPVGVQGGNTTDQPSIGEDDLTGIPNSAPLNLFPQGGSNAGGGAGGGPLEFLRNNQQFQVLREMVQTNPQILQPMLQELSKQNPQILRSIQENHAEFLQLINEPFEDGEGDFLEQPEQDEMPLA

SEQ ID NO: 35005 - DNA, 636 bp, Panicum virgatum
  misc_feature: Ceres CLONE 1958515
  misc_feature: Encodes the peptide sequence at SEQ ID NO. 35006
actgaggtgcaggaagcaacgctgcccataatccttcaaggcaaggatgttcttgcaaaagcaaagacaggaactggcaaaacagttgcctttttgcttccagctattgaggttctctccacattgcctcaccaacggaatcagttacgaccacctataaatttgctggtgatgtgtcctactagggagcttgcaaaccaagtggctgtcgaggccaggaagcttctcaagtatcatcgctcactgggcgtgcaggttgtaattggtggcacacgagtaactcaagagcaacgaagcatgcaggctaacccatgtcagatccttgttgctacacctggaaggcttaaggatcatctggaaaacacacctgttttttctacccgactcaaaggggttaaggttcttgttcttgatgaagctgaccgcctactggatatgggatttagaagagatattgagaaaataatcgcttcaactcctagagaacgacagacactgttgttttctgctactgttccagaagaggtccgccaaatttcgcacgtggcaatgaagaaggattataggtttatcaacactgttaaagagggagatgaggagacacattcgcaagtgagccagacttacatggttgca

SEQ ID NO: 35006 - protein, 211 aa, Panicum virgatum
  misc_feature: Ceres CLONE 1958515
  misc_feature (1)..(179): Pfam Name: DEAD Pfam Description: DEAD/DEAH box helicase
TEVQEATLPIILQGKDVLAKAKTGTGKTVAFLLPAIEVLSTLPHQRNQLRPPINLLVMCPTRELANQVAVEARKLLKYHRSLGVQVVIGGTRVTQEQRSMQANPCQILVATPGRLKDHLENTPVFSTRLKGVKVLVLDEADRLLDMGFRRDIEKIIASTPRERQTLLFSATVPEEVRQISHVAMKKDYRFINTVKEGDEETHSQVSQTYMV

SEQ ID NO: 35007 - DNA, 694 bp, Panicum virgatum
  misc_feature: Ceres CLONE 1958525
  misc_feature: Encodes the peptide sequence at SEQ ID NO. 35008
atactctgcgatccgcgcacgcgtgagcgtgaacgaatccgccgggcagccgccgacccaaactaatcgtcttcccccagtgcgctccctctccccaccccaaccccaactactaccatctcagcgccaccaactagtcgtaggaggaagcgacccggcgggaagcgatcgggcatggcggcggcgaagatagcaccgtcttatgctctcatcggacttctccaatctcgccacggaggccgagcgcatgctccgcctcggcgccgactggctccacatggacatcatggatgggcactttgttcctaatctgactattggggctccagtgatccagagattgaagaaacataccaaagcatatttggactgccatcttatggtcacaaacccttcagattatgtagaaccattgggaaaggctggtgcctcatgattcacattccatatagaagtaaccagagacaactggcaagagctcatccaaagcattaaatcgaagggaatgcggcctggtgtatcattgaggccaggtactccggtggaggaagtttttcccctggtggaagcggaaaatccggtagaattagttcttgtgatgacagttgagcctggtttcggtggtcagaaattcatgccagaaatgatggataaggtgcgtacactgaagaaataattatcctttcccttgaca

SEQ ID NO: 35008 - protein, 77 aa, Panicum virgatum
  misc_feature: Ceres CLONE 1958525
  misc_feature (1)..(77): Pfam Name: Ribul_P_3_epim Pfam Description: Ribulose-phosphate 3 epimerase family
  misc_feature: SWISSPROT Homolog: EC 5.1.3.1 Ribulose-phosphate 3-epimerase
MLSSDFSNLATEAERMLRLGADWLHMDIMDGHFVPNLTIGAPVIQRLKKHTKAYLDCHLMVTNPSDYVEPLGKAGAS

SEQ ID NO: 35009 - DNA, 742 bp, Panicum virgatum
  misc_feature: Ceres CLONE 1958549
  misc_feature: Encodes the peptide sequence at SEQ ID NO. 35010
gcagggagtaatggacaaccggcccatgaatgttatattccatctcctcagggagtccaatgtctcagctttgcctaaaacccacagtttgcttactcttcaaccatctctcctctcgcaccgagttggggcgcatctgaactacccaatgcatgctttcatgagcaaaaaacctcatgaaaaatccttcaagctgcctcaacagtcattcactccattaactgcttctttgccctgcgatgtacatattgtgaacctaaaggtccctcagcccctaagatttcctcacgctgaagcagccagccaaagatttgccattctgttgcagaggagaggctgggactcatcatattgcaaaaggggtggattgcattgtacaacagttggggaagaaccagttaatctgttctacatgttcaaagatctctcagctctgaatgtgaaggcgacttcgctgaatctcttacatgatgaccctgaaatgctagggtaccttgagcagattggtgatgttgctcaggagggaaatgtacttatctcaccaatggagattcaggcgtacaagttagacctacagctaccatcattacaggaagagtagtttgcctacaacttaaactgaagtctgaagatggatcttcttgaaacaggtgatagtggcagccagattgtgctggaacacatacagtgctgcatgtatatgtgttcatacgttgggtgattgaacctcttgaacttcctg

SEQ ID NO: 35010 - protein, 199 aa, Panicum virgatum
  misc_feature: Ceres CLONE 1958549
  misc_feature: SWISSPROT Homolog: EC 3.2.1.114 Mannosyl-oligosaccharide 1,3-1,6-alpha-mannosidase
QGVMDNRPMNVIFHLLRESNVSALPKTHSLLTLQPSLLSHRVGAHLNYPMHAFMSKKPHEKSFKLPQQSFTPLTASLPCDVHIVNLKVPQPLRFPHAEAASQRFAILLQRRGWDSSYCKRGGLHCTTVGEEPVNLFYMFKDLSALNVKATSLNLLHDDPEMLGYLEQIGDVAQEGNVLISPMEIQAYKLDLQLPSLQEE

SEQ ID NO: 35011 - DNA, 638 bp, Panicum virgatum
  misc_feature: Ceres CLONE 1958553
  misc_feature: Encodes the peptide sequence at SEQ ID NO. 35012
gtctccggcgtgccctcccaaaagcctgcattttcctccgccgccttccgatctctcggccctcgccatgtcggagaaaaagcgccgcgcggggacaaccgcggccggcgccgcatctagctcgaagaagccgcgcgccgccgcgtcctacgccgagtccctccgctcgaagctccgccccgacgcctccatcctcgccaccctccgctccctcgcctccgcctccgcctcctcttccaaatcaaaggccgccgggaagtccctcgcggaccacgacccctcggcggaacccacctcctcgtacatcgtggtggccgaccaggactcctcctccgtcacctcccgcatcaaccgcctcgtcctcgccgccgcgcgcagcatcctctccggccggggcttctccttcgcggtgccctcccgcgccgcctccaaccgggtctacctcccagacctcgaccgcatcgtgctcgtccgccgcgagtccgcgcgccccttcgccaacgtcgccaccgcgcgcaaggccaccgacacggcgcgcgtcctctccctcgtccacgccgtcctccgcaggggcatccacgtcaccaagcgtgacctcttctacgccgacgtctagctcttcggcgaccagtcccaga

SEQ ID NO: 35012 - protein, 182 aa, Panicum virgatum
  misc_feature: Ceres CLONE 1958553
  misc_feature: SWISSPROT Homolog: EC 5.99.1.3 DNA topoisomerase (ATP-hydrolyzing)
MSEKKRRAGTTAAGAASSSKKPRAAASYAESLRSKLRPDASILATLRSLASASASSSKSKAAGKSLADHDPSAEPTSSYIVVADQDSSSVTSRINRLVLAAARSILSGRGFSFAVPSRAASNRVYLPDLDRIVLVRRESARPFANVATARKATDTARVLSLVHAVLRRGIHVTKRDLFYADV

SEQ ID NO: 35013 - DNA, 1315 bp, Panicum virgatum
  misc_feature: Ceres CLONE 1958555
  misc_feature: Encodes the peptide sequence at SEQ ID NO. 35014
tgatcaacaaaactaacacacaagcaagagcactccctaacccaattacacacacaacatgtacaaccgccgcagccagcaaaccgatgctcacgagatctgccgcagggccacgaacatcgtgaagaagaagaacctgcaggacagggatttgcccctcgagcactcacgcatccgcgatgaggtctgctacaagttcggggaggaggaccagcgagcatgccacatgttcctgaagcactacggtgacgacctcgagaggatgctgaacggcaggaagaggctcagcgccaacgagatctgcgatcgcctcgacgtgagcgacctcaacgactacgccgcggcgtcggccggcgttctgggcgccgtgggctccaaggtgaccaacgtcgccaagaccgtctacgagaagggcgaggacctggccgagatggccatggacaagactcgcgatgccgaggagtgggtcgtgcagaagggcgagcgcgcctgggagggcatcaaggacatgggcggccgtgccaaggaggaggcccgtgaggacatcgatgaggccagcgacaaggtgcgccgcaccggccgccagatgcgcgactcgacccagcsccgcagccgtgacctcaaggacgaggccgacgagctctgggaagagggcaaggagaagatgcgcgatgtcggcgaccaggctcgcctgaagcgccgccagtctcaggagtggctgagcgaggagggcaaggagctgcgccgcagcgcccgcgacctcaaggagaacgtcaaggagaaggccgacgccgctggccgcaagctgagcgaggagggcaaggacctgcgccgcagcgcccaggacctcaccgagaacgtgaaggagaaggctgacgccgctggccgcaagctgcgcgagagcggcgagtacgtggtcgacgtcgtcaaggacaaggcccagcgtgctggcaaggcgatcaaggagaccgaggaggagatcatgcgcaagggcgaggacctgggctacaaggcccgcaggaagagccgcgacatgggtgactcgatgcgcgaggccaaggaggacgccaaggagtccttcgatgaggccaagagactcggcaagcagaagycccgcgagctcaagtatgagggkgaggacattgccaaccgcatgaagcgcgccggggaccgcaacaaggccgagwatgaggaggakgagggcgtcatggacaagcycggcgacaagaycaacgagcccaagaccgaggccgccgagcgggggcgcggcaccacccccagccacaggaacaaggacaacaaagccccgacccgc

SEQ ID NO: 35014 - protein, 418 aa, Panicum virgatum
  misc_feature: Ceres CLONE 1958555
  misc_feature: SWISSPROT Homolog: EC 2.7.11.1 Non-specific serine/threonine protein kinase
  misc_feature (183)..(183): Xaa is any aa, unknown, or other
  misc_feature (352)..(352): Xaa is any aa, unknown, or other
  misc_feature (377)..(377): Xaa is any aa, unknown, or other
  misc_feature (380)..(380): Xaa is any aa, unknown, or other
  misc_feature (387)..(387): Xaa is any aa, unknown, or other
  misc_feature (391)..(391): Xaa is any aa, unknown, or other
MYNRRSQQTDAHEICRRATNIVKKKNLQDRDLPLEHSRIRDEVCYKFGEEDQRACHMFLKHYGDDLERMLNGRKRLSANEICDRLDVSDLNDYAAASAGVLGAVGSKVTNVAKTVYEKGEDLAEMAMDKTRDAEEWVVQKGERAWEGIKDMGGRAKEEAREDIDEASDKVRRTGRQMRDSTQXRSRDLKDEADELWEEGKEKMRDVGDQARLKRRQSQEWLSEEGKELRRSARDLKENVKEKADAAGRKLSEEGKDLRRSAQDLTENVKEKADAAGRKLRESGEYVVDVVKDKAQRAGKAIKETEEEIMRKGEDLGYKARRKSRDMGDSMREAKEDAKESFDEAKRLGKQKXRELKYEGEDIANRMKRAGDRNKAEXEEXEGVMDKXGDKXNEPKTEAAERGRGTTPSHRNKDNKAPT

SEQ ID NO: 35015 - DNA, 660 bp, Panicum virgatum
  misc_feature: Ceres CLONE 1958571
  misc_feature: Encodes the peptide sequence at SEQ ID NO. 35016
atcacaagctccaacgcaattagccatctaaaccaattacttctcagctcatcaaaccattcatcttgatctcagtcaaggatagaagaaaaccagtatggcagttcgtgtctccctccttgccgcagcgctcctggcagccgtgtcatgctttcatgccactgcctccgatcctagccttctccaggacttctgtgtagtcgacaagatgtccaaagtgcgtgtcaatgggtttccatgcaaggatgcaaatgatgtagcggctgaagatttcttcttctcgggccttcacatggccggcaacacaaccaacaagcagggctccgccgtcacaccagtcaacgtagctcagattgcagggctcaacacaatgggcatctctctcgctcgtatcgattatgcgccctttggtcaaaatccccctcacactcacccacgcggtactgagatcttgaccgtgctcgagggctcactctacgttggctttgtgacatcaaatccagacaacaagctgttcacaaaagttctcaacaaaggagatgtatttgtgtttcctcaagggttgatccatttccagttcaactatggaacaaaaaatgcagtggcacttgcagcactcagcagccagaacccaggggtgattactgtgggcaattctgt

SEQ ID NO: 35016 - protein, 187 aa, Panicum virgatum
  misc_feature: Ceres CLONE 1958571
  misc_feature (62)..(185): Pfam Name: Cupin_1 Pfam Description: Cupin
  misc_feature: SWISSPROT Homolog: EC 1.15.1.1 Superoxide dismutase
  misc_feature: Functional homolog of the protein sequence given in SEQ ID NO 50204
  misc_feature: Useful for making plants with modulated nitrogen use efficiency
MAVRVSLLAAALLAAVSCFHATASDPSLLQDFCVVDKMSKVRVNGFPCKDANDVAAEDFFFSGLHMAGNTTNKQGSAVTPVNVAQIAGLNTMGISLARIDYAPFGQNPPHTHPRGTEILTVLEGSLYVGFVTSNPDNKLFTKVLNKGDVFVFPQGLIHFQFNYGTKNAVALAALSSQNPGVITVGNS

SEQ ID NO: 35017 - DNA, 568 bp, Panicum virgatum
  misc_feature: Ceres CLONE 1958595
  misc_feature: Encodes the peptide sequence at SEQ ID NO. 35018
actcactttatgatcccatggtttgaacggccaatcatttatgatgtccgcgctcgcccgaatcttgttgagagtacttctggaagcagggatcttcagatggtgaaaattggtcttcgtgtcctcacaaggcctatgccagagaggctaccccatatctacaggactctaggggagaacttcaacgagcgagttctgccttctatcattcatgaaacactgaaagctgttgtcgcccaatacaatgctagccaactgatcacacagagagagactgtgagtagggagattaggaagatactgacggagagggccagaaacttcaacattgctcttgatgatgtctcaattacaatcctgagctttgggaaggagttcacccatgccattgaggccatacaggttgctgcacaggaagctgagcgtgcgaagttcattgtacagaaagccgagcaggataagagaagtgcaattatcatggctcagggagaggccaagtctgctgagctgattggccaggccatcgcaaacaacccatctttccttgccctgaggcagattgaagctg

SEQ ID NO: 35018 - protein, 189 aa, Panicum virgatum
  misc_feature: Ceres CLONE 1958595
  misc_feature (1)..(154): Pfam Name: Band_7 Pfam Description: SPFH domain / Band 7 family
  misc_feature: Functional homolog of the protein sequence given in SEQ ID NO 51073
  misc_feature: Useful for making plants with modulated biomass
THFMIPWFERPIIYDVRARPNLVESTSGSRDLQMVKIGLRVLTRPMPERLPHIYRTLGENFNERVLPSIIHETLKAVVAQYNASQLITQRETVSREIRKILTERARNFNIALDDVSITILSFGKEFTHAIEAIQVAAQEAERAKFIVQKAEQDKRSAIIMAQGEAKSAELIGQAIANNPSFLALRQIEA

SEQ ID NO: 35019 - DNA, 1093 bp, Panicum virgatum
  misc_feature: Ceres CLONE 1958599
  misc_feature: Encodes the peptide sequence at SEQ ID NO. 35020
aacaaacgctaaaaaagtaacagtttctgtactttattgtagcgccgagtttgaccttccaaactcacactttcgtgtttgtcgtcctttctgacaattcaagctcgcccgtcacacaatgcgcaaggtgtactcgagtgtgctgctacgcaccggcatcgtgaaggaccccagcacgcgtggccttgtcagccgcattatggccacatctacgtacgcggtcgcgacgatcgtcggccttggcaccttcggggttgacactagcccggtgctcgcggcgatgggagtttccggtgccacgatcggtttcgcctgcaaagacatcggtgcaaacatcgcggccggcctcagcctcgcggcgcagcgtccgttccactacggcacgcggctcacgatcgcggaaaagttcacaggcacggtggaccactgggatatgcgctacctgtacctgcgcggcgacaacaacaacttgatccacgtcccgaacgccgtggtcttcacgagcgtgctcacggtccacgatccgaggggcaccgcgttccaccgcgacgagcacggcgaggtggtcccgcgcctcccgcatattttccggcggcgggcggaggcgcttgccgccggcgccgagcccgaaacgacgactgcggaggaaatcgcggccgcagggccggagtccgcggtcagcgcggacggtaagcctgtgccgccagaagaggcgatggcgcaggattccgataagctcggcgaagtcgtcaggctggtgttctgggtgctggcggtcgtgctcggcacgatcggcgtcatgtcgcaccttctagcaggacaaattgcaaagcacgcggacgatcccagatcgatttaccgaaaaggcccggtgaagcccgtcgcgcaggcggtgaccacggtggaccatttgtacaccggcacggtcaacaagatcttccacacgcgccaggagctcgaacaagcgaagcgcgacgcggaagaggggctgcgcgagcttgaccggaaagaagacgagctgcaacgtgtcccacctcgacacaactagcgcgtctgacgtatcaatcacgaatactgctcaattgctccgccc

SEQ ID NO: 35020 - protein, 309 aa, Panicum virgatum
  misc_feature: Ceres CLONE 1958599
  misc_feature (25)..(294): Pfam Name: MS_channel Pfam Description: Mechanosensitive ion channel
MRKVYSSVLLRTGIVKDPSTRGLVSRIMATSTYAVATIVGLGTFGVDTSPVLAAMGVSGATIGFACKDIGANIAAGLSLAAQRPFHYGTRLTIAEKFTGTVDHWDMRYLYLRGDNNNLIHVPNAVVFTSVLTVHDPRGTAFHRDEHGEVVPRLPHIFRRRAEALAAGAEPETTTAEEIAAAGPESAVSADGKPVPPEEAMAQDSDKLGEVVRLVFWVLAVVLGTIGVMSHLLAGQIAKHADDPRSIYRKGPVKPVAQAVTTVDHLYTGTVNKIFHTRQELEQAKRDAEEGLRELDRKEDELQRVPPRHN

SEQ ID NO: 35021 - DNA, 667 bp, Panicum virgatum
  misc_feature: Ceres CLONE 1958603
  misc_feature: Encodes the peptide sequence at SEQ ID NO. 35022
gaccgacggttgatgagggaagcagcgtctccgccgggaggatctgcatccaacccaagccggccgcatcaacctccgccgggcgccagcgaagaccggccggccggcggccgtagtcgggtgacgccgccgcagcttcaacctcagcgcgcgtgccttaacgtacccaaccgcagccgcgccatggcctcggtcaccgaaatcagcgctttcacggccgcggccgcgcatgtgctctgcttcgccggcctcgctgccgcccactcgctcgctggccgcggagctctcgtctccgatcctgcgcgcgccctccgcctcctcgtggtttgtgaagcgcccgtggtcatcgcagtgttcagctacctccggcgtgaccccaaaagctgctcgcttttcaaggctgctgcgagaggattgatcggcttgcctgtgggagcattccttaatgcgtttggagcaattgttcttggtgcacctgttggaatcaagtactggatggttactatttattggtcacttctcatgtccctgtttacctttgttcctgcagcatgtgtctttggagcatccaagattgattggcagaatgtgctttctcactccatttatttcacgccaactgaagttgagaactacatgatttctgcaccttgtcatggagctgtgc

SEQ ID NO: 35022 - protein, 161 aa, Panicum virgatum
  misc_feature: Ceres CLONE 1958603
  misc_feature (1)..(158): Pfam Name: PIG-F Pfam Description: Phospho-ethanolamine N-methyltransferase
MASVTEISAFTAAAAHVLCFAGLAAAHSLAGRGALVSDPARALRLLVVCEAPVVIAVFSYLRRDPKSCSLFKAAARGLIGLPVGAFLNAFGAIVLGAPVGIKYWMVTIYWSLLMSLFTFVPAACVFGASKIDWQNVLSHSIYFTPTEVENYMISAPCHGAV

SEQ ID NO: 35023 - DNA, 432 bp, Panicum virgatum
  misc_feature: Ceres CLONE 1958613
  misc_feature: Encodes the peptide sequence at SEQ ID NO. 35024
acacgacgaggggacgccgtccgcgagatcccaccacaccaaaaatcccgcccccaatccctccgcccgccgatcgccgccgctgcctatccaatatccatccggatctcgggtggtccttcgccggcgatggaggggcggccaggtggcgcgtggcgggtgcaggggcccgccggggcgcccgtcgcggggctgcccatcggcttccgcttctgccccactgacgacgagctgctgctgcactacctccgccgcaaggcgctcgcctgcccgctccccgccggcatcatctccgacgccgacctcgctcgcctccacccctgggacctcctcccgccagcgccagcaggcggcgccgacggggagcgcttcttcttccaccgcccggccacgcggtgctggcggaagggcggcggcgcggcgagggctgct

SEQ ID NO: 35024 - protein, 100 aa, Panicum virgatum
  misc_feature: Ceres CLONE 1958613
  misc_feature (22)..(98): Pfam Name: NAM Pfam Description: No apical meristem (NAM) protein
MEGRPGGAWRVQGPAGAPVAGLPIGFRFCPTDDELLLHYLRRKALACPLPAGIISDADLARLHPWDLLPPAPAGGADGERFFFHRPATRCWRKGGGAARA

SEQ ID NO: 35025 - DNA, 474 bp, Panicum virgatum
  misc_feature: Ceres CLONE 1958628
  misc_feature: Encodes the peptide sequence at SEQ ID NO. 35026
gtactctgcagcaaaatttcttccaactcccggcagtcgttcgtaccataactccataagcccctccgcctcttcaaccagctccagaaccctcgaaaggcaagcgacgaaggcaagatacgcccacccaccggctccggcgatgcagcagcagatgcccatgcagccggcgcccgccggcgccgcggcggcggcgcccccggcggccggcatcaccaccgagcagatccaaaagtatttggatgaaaataagcagcttattttggccatcctggaaaatcagaacttaggaaagttggctgaatgtgctcagtatcaagctcagcttcaaaagaatctcttgtacctggctgcaattgcagatgcccaaccccaaccaccacagaaccctgcaagtcgcccacagatgatgcaacctggcatggtaccaggtgcagggcattacatgtcccaagtaccaatgttcccgccaag

SEQ ID NO: 35026 - protein, 110 aa, Panicum virgatum
  misc_feature: Ceres CLONE 1958628
  misc_feature (21)..(84): Pfam Name: SSXT Pfam Description: SSXT protein (N-terminal region)
MQQQMPMQPAPAGAAAAAPPAAGITTEQIQKYLDENKQLILAILENQNLGKLAECAQYQAQLQKNLLYLAAIADAQPQPPQNPASRPQMMQPGMVPGAGHYMSQVPMFPP

SEQ ID NO: 35027 - DNA, 598 bp, Panicum virgatum
  misc_feature: Ceres CLONE 1958679
  misc_feature: Encodes the peptide sequence at SEQ ID NO. 35028
acaacctcttgagaatcagcacactcaggacaccgtcaaaatggtcaagaagagaaagaacaacggccgcaacaagaagggccgcggccacgtcaagcccatccggtgctccaactgctcgcgatgcacccccaaggacaaggccatcaagaggttcaccatccgcaacatggttgagtcagcggcgatccgtgatatttcggacgcctctgtctttgcagagtacactgttcccaagatgtaccttaaactgcagtactgtgtgtcttgcgcgatccacggcaagattgtccgtgtccgctccaccgaaggccgtcgcaaccgtgctcctcccccgcgcgtccgctacaacaaggatggcaagaaggtggttcctacccagaaccccaagaccgcctagatggtcttccgctttcttgctttggcgttctgagttggcggcatttggctttgggcggggttttaacgatcgagcattaacgaggtcatgattggaccacacgacagacccggcgcccatggaaaccaaataagggtttccttcagcccagtgggcttcatagcgccatagcaccaattcagaacacttgttgtgtag

SEQ ID NO: 35028 - protein, 119 aa, Panicum virgatum
  misc_feature: Ceres CLONE 1958679
  misc_feature (1)..(114): Pfam Name: Ribosomal_S26e Pfam Description: Ribosomal protein S26e
  misc_feature: Functional homolog of the protein sequence given in SEQ ID NO 50755
  misc_feature: Useful for making plants with modulated nitrogen use efficiency
MVKKRKNNGRNKKGRGHVKPIRCSNCSRCTPKDKAIKRFTIRNMVESAAIRDISDASVFAEYTVPKMYLKLQYCVSCAIHGKIVRVRSTEGRRNRAPPPRVRYNKDGKKVVPTQNPKTA

SEQ ID NO: 35029 - DNA, 518 bp, Panicum virgatum
  misc_feature: Ceres CLONE 1958687
  misc_feature: Encodes the peptide sequence at SEQ ID NO. 35030
gcaatctctggataccgctaccctaccagcaactctttttgttatttatatgactcggttcacactgagatccacctatatgctggacaaacacaacttcaaattgtactatgtgggagtggcttgtgccgtgctaacctttgttgcccatcctacaacatcgcacaacatactgaacagactttgctgggccttttgtgtttatttcgaagctgtttccctgctgcctccgttgcgcttgatgcaaaataccaagattgttgagccattcacagctcattatgtgtttgcactgggtgttgcaaggtttctgagctgtgcacactgggtccttcaggttttggatacccgtggccggttgttgactgctctgggctatggactgtggccatcaatggtacttctttccgaaatcgtccaaactttcatcctcgcagatttctgctactactatgtgaagagtgtttttggtgggcaactggtgctgcgcctcccctccggggtggtctagaaactgc

SEQ ID NO: 35030 - protein, 169 aa, Panicum virgatum
  misc_feature: Ceres CLONE 1958687
  misc_feature (3)..(155): Pfam Name: ER_lumen_recept Pfam Description: ER lumen protein retaining receptor
QSLDTATLPATLFVIYMTRFTLRSTYMLDKHNFKLYYVGVACAVLTFVAHPTTSHNILNRLCWAFCVYFEAVSLLPPLRLMQNTKIVEPFTAHYVFALGVARFLSCAHWVLQVLDTRGRLLTALGYGLWPSMVLLSEIVQTFILADFCYYYVKSVFGGQLVLRLPSGVV

SEQ ID NO: 35031 - DNA, 919 bp, Panicum virgatum
  misc_feature: Ceres CLONE 1958711
  misc_feature: Encodes the peptide sequence at SEQ ID NO. 35032
ccccttgtttcccggcccccgcctcccgcctcccgccgccgaccacgcaccaaaccctagccgcctcaccctaccgcgccatggccgacccgcggatgttcccgtcaggatccgacgaccgcgccggatcctccgaggccggccgccgtctgtacaacccgtaccaggacctcaacatgccctacagctaccggaccctctacgacctccccacctcgccggagttcctcttcattgaggaggaacgggtgcagcgccgctcgtggggcgagaacctcaccttctacacgggggtcgggtacctctctggcgccgtcggcggcgccgccctgggcctgcgcgacgccgccaggggcgccgagcccggggagaccgccaagatccgcgccaaccgcgtgctcaactcctgcggcagctccggtcgccgcgtcggcaacacgctgggcgtcatcgggctcatgtacgccgggattgagagcgccatggtcgcggcccgcgaccgcgacgattggatcaacagcgtcgctgccgggctcggcaccggcgcgctcttccgcgccgccaacggcccgcggtccgccgtcgtcgcgggcgccctcggtgggatcctcgccgcggccgccacggggggcaagcagctcgccaagcgatacgtgcctactgtcatatgatcgcgtctgtggtaggaacaatgaaacaatctgtcccaaaaaaaaaatcgaagtagtcttttttttttgttcgtgttatgatcttcaggctagcaactccatcgttgaagtggtttaccttctccgtccgaatgataaatccatgctgtgctagtcacttgagagcatagtctggatgggaacttttgatctgcattgcaatgtaacaccatgctcaatgaaagaacatgcattgtacttggcgttgc

SEQ ID NO: 35032 - protein, 196 aa, Panicum virgatum
  misc_feature: Ceres CLONE 1958711
  misc_feature (55)..(188): Pfam Name: Tim17 Pfam Description: Tim17/Tim22/Tim23 family
MADPRMFPSGSDDRAGSSEAGRRLYNPYQDLNMPYSYRTLYDLPTSPEFLFIEEERVQRRSWGENLTFYTGVGYLSGAVGGAALGLRDAARGAEPGETAKIRANRVLNSCGSSGRRVGNTLGVIGLMYAGIESAMVAARDRDDWINSVAAGLGTGALFRAANGPRSAVVAGALGGILAAAATGGKQLAKRYVPTVI

SEQ ID NO: 35033 - DNA, 522 bp, Panicum virgatum
  misc_feature: Ceres CLONE 1958719
  misc_feature: Encodes the peptide sequence at SEQ ID NO. 35034
ctctttcagctctcccataagcatccattcataacaatgaagcttgagatttgttctttctctggtcaaaagatctatcctgccaagggtaagacctatgttcgtatcgattctagaactttccgtttcatcaacggtaagaccgaatcttactttctccaacgtttgaaccctcgtaagatcagatggaccgctatttaccgtcgtttgaacaagaagggtatgaccgaagaagttcaaaagaagcgttctcgtcgtactgtcaagcacgaacgtgctgttgttggtgcctcttgggatgccatccgtgccaagcgtaaccaaaagcctgatgcccgtgctgctgctcgtcaagctgctattgccaagagcaaggaagccaagaagtctgctgctgccgctaagaaggctaacccctctgctgcttctcaatccaaggtcagcaagcaacaagccaagggtttcgcccctaaggctgctgccacttcccgttaaacaaaataaaaaaataggttttgatat

SEQ ID NO: 35034 - protein, 152 aa, Panicum virgatum
  misc_feature: Ceres CLONE 1958719
  misc_feature (1)..(71): Pfam Name: Ribosomal_L24e Pfam Description: Ribosomal protein L24e
MKLEICSFSGQKIYPAKGKTYVRIDSRTFRFINGKTESYFLQRLNPRKIRWTAIYRRLNKKGMTEEVQKKRSRRTVKHERAVVGASWDAIRAKRNQKPDARAAARQAAIAKSKEAKKSAAAAKKANPSAASQSKVSKQQAKGFAPKAAATSR

SEQ ID NO: 35035 - DNA, 698 bp, Panicum virgatum
  misc_feature: Ceres CLONE 1958728
  misc_feature: Encodes the peptide sequence at SEQ ID NO. 35036
acggccgcatccgccgaaatccgcaagggcagcgaggccaagcgacgacagagaggaaaacgagagagggtagtagagggagaaaaaaaaaatgctgcgccacgccgcccgccgtctcgcctcccgcgccgccgtggcgcccgccgcccgccgggcgctcgccacggcggaggtgcccgcggaggccgccgaggactccacgttcgtggaggcgtggaagaaggtcgcccccaacctcgagccccccaagacgcccctctccctgatgcagccgcgcccgcccacgccggccaccatccccaccaaactcaccgtcaacttcgtcctcccctacaagtccgagatcgccaacaaggaggttgacatggtgattgtaccagctacaactggtcagatgggtgttttgccaggccatgttgccacaatcgctgagctcaagcctggtgttctctcagtacacgaggggaatgatgtgaccaagtactttgtgagcagtgggtttgcatttgtccatgcaaactccatagctgacattgtggctgttgaggcggtccctgtggatcagattgaccctgccttggtccagaagggtctcgctgatttcactgccaagcttgggtcagcctcaactgacttggagaaggctgaggctcagatcggagtcgatgtccacagtgcactcaatgctgcattgacca

SEQ ID NO: 35036 - protein, 202 aa, Panicum virgatum
  misc_feature: Ceres CLONE 1958728
  misc_feature (72)..(155): Pfam Name: ATP-synt_DE_N Pfam Description: ATP synthase, Delta/Epsilon chain, beta-sandwich domain
  misc_feature: SWISSPROT Homolog: EC 3.6.3.14 H(+)-transporting two-sector ATPase
MLRHAARRLASRAAVAPAARRALATAEVPAEAAEDSTFVEAWKKVAPNLEPPKTPLSLMQPRPPTPATIPTKLTVNFVLPYKSEIANKEVDMVIVPATTGQMGVLPGHVATIAELKPGVLSVHEGNDVTKYFVSSGFAFVHANSIADIVAVEAVPVDQIDPALVQKGLADFTAKLGSASTDLEKAEAQIGVDVHSALNAALT

SEQ ID NO: 35037 - DNA, 684 bp, Panicum virgatum
  misc_feature: Ceres CLONE 1958729
  misc_feature: Encodes the peptide sequence at SEQ ID NO. 35038
ctcccaggaggtcaatggtgatgctctgggcgaggagttcaagggttatgttttcaagatcatggggggttgtgacaagcaaggttttcccatgaagcaaggagtgctaactcctggccgtgttcgccttctgctacacaggggtaagtggctgcagtcttgtttccacagtacccttaatcccttatcatcgatcaggttgtatcttccctcttttctagattttcttcgctgaacatttgttatgagttctgtaggcactccatgcttccgtggttatggtaggcgtgatggtgagcgcaggcggaagtctgtccgtggttgcattgtcagccaagacctctctgttatcaacttggtgattgtcaagaagggcgaaaatgatctgcctggtctgactgacactgagaagcccaggatgaggggacccaagagggcctccaagatcaggaagctgttcaacctgtcgaaggatgatgatgtccgcaagtatgtgaacacataccgcaggacattcactaccaagaatggcaagaaggtgagcaaggctcctaagatccagcgtctggtgacccccttgaccctccagaggaagcgcgctagaattgctgacaagaagaagaggatttgccagaagaagtccgaggctgctgagtaccagaggcttcttgcccagaggcttaa

SEQ ID NO: 35038 - protein, 146 aa, Panicum virgatum
  misc_feature: Ceres CLONE 1958729
  misc_feature (2)..(54): Pfam Name: Ribosomal_S6e Pfam Description: Ribosomal protein S6e
MSSVGTPCFRGYGRRDGERRRKSVRGCIVSQDLSVINLVIVKKGENDLPGLTDTEKPRMRGPKRASKIRKLFNLSKDDDVRKYVNTYRRTFTTKNGKKVSKAPKIQRLVTPLTLQRKRARIADKKKRICQKKSEAAEYQRLLAQRL

SEQ ID NO: 35039 - DNA, 693 bp, Panicum virgatum
  misc_feature: Ceres CLONE 1958730
  misc_feature: Encodes the peptide sequence at SEQ ID NO. 35040
tcatcgtgatggggatagatcattgcaattgttggtcttcaacgaggaatgcctagtaagcgcgagtcatcagctcgcgttgactacgtccctgccctttgtacacaccgcccgtcgctcctaccgattgaatggtccggtgaagtgttcggatcgcggcgacggaggcggttcgccgcccccgacgtcgcgagaagtccattgaaccttatcatttagaggaaggagaagtcgtaacaaggtttccgtaggtgaacctgcggaaggatcattggaacaacgactactgcgaccggggcaacacgcagtggccgtgcgcggcggggaagaagtactacgggcgcggcccgctgcagatctcgtggaactacaactacgggcccgccgggcgggacaacggcttcgacgggctgcgggacccggacgcggtggcgcgggacgccgtggtcgcgttcaagacggcgctttggttctggatgaacaacgtgcacggggtgatgccgcaggggttcggcgcgacgaccagggccatcaacggcgccctcgagtgcaacgggaagaaccaggcgcagatgaacgcgcgggtgggctactacaggcagtactgccagcagctcggcgtcgacccggggaacaatctcacctgctagacgaagtcagcttcgttgatgcatggtagcttgtggcttggtg

SEQ ID NO: 35040 - protein, 57 aa, Panicum virgatum
  misc_feature: Ceres CLONE 1958730
  misc_feature: SWISSPROT Homolog: EC 3.2.1.14 Chitinase
  misc_feature: The sequence is a functional homolog of SEQ ID NO 12 in US patent 7087810
MNNVHGVMPQGFGATTRAINGALECNGKNQAQMNARVGYYRQYCQQLGVDPGNNLTC

SEQ ID NO: 35041 - DNA, 612 bp, Panicum virgatum
  misc_feature: Ceres CLONE 1958741
  misc_feature: Encodes the peptide sequence at SEQ ID NO. 35042
atttgatgagagtaggagaatggaatttggtaaggagcttcttatactttctcgagtcaaacacgaaaacattgtccagcttttaggttgcagtttgcaatttgaagctccagttctggtgtatgaatacgtgccaaaccgaaccctaaactatctgattcatacccaagatgatgcatccatcagaactctggagatccgtcttaaaattgccgctgagatcgctacagcacttgcatacctgcattctcttagccacccagtctttcatggagatgtcaagtccgtcaacattctcctaggccatgatctctctgcgagagtttctgattttgggtgctcgatgattaggtcagctgatgaaaatgttcaagtagtgaaggggacaatgggctacttagatccggagtacttattgaactttgagcttacagataagagtgatgtttacagctttggtgttgttcttttggagctcatcacacgcaggacagcactatccaaaacaaaggatagcctcgtgtctgtcttcacggaagcagtgaaggagagtaggcttagcgagctcatagatggggagatagccagcaatggaaacctggattttggact

SEQ ID NO: 35042 - protein, 203 aa, Panicum virgatum
  misc_feature: Ceres CLONE 1958741
  misc_feature (1)..(190): Pfam Name: Pkinase_Tyr Pfam Description: Protein tyrosine kinase
  misc_feature: SWISSPROT Homolog: EC 2.7.11.1 Non-specific serine/threonine protein kinase
FDESRRMEFGKELLILSRVKHENIVQLLGCSLQFEAPVLVYEYVPNRTLNYLIHTQDDASIRTLEIRLKIAAEIATALAYLHSLSHPVFHGDVKSVNILLGHDLSARVSDFGCSMIRSADENVQVVKGTMGYLDPEYLLNFELTDKSDVYSFGVVLLELITRRTALSKTKDSLVSVFTEAVKESRLSELIDGEIASNGNLDFG

SEQ ID NO: 35043 - DNA, 623 bp, Panicum virgatum
  misc_feature: Ceres CLONE 1958748
  misc_feature: Encodes the peptide sequence at SEQ ID NO. 35044
attcggctgattgtgctctatcatcaagcaatcaacaaagcctcccaattatcctttcatcagatcatcttccttcttccaagatgtcttgcagctgcggatcaagctgcaactgcggctccaactgcaagtgccgcaagatgtaccctgaccttgaggagaagagcaagggcagcgctcaggcccccatcaacctcagcgaggccccggagaagaaggccggccacctcgaggcggcggcagactccggcgagaccgcccacccctgcaagtgccgtaacacctgcagctgcgacccctgcaactgctgatttcaacggggaacgacagaacacacctgcgtgcatgcatggtaactactacctactactctgcttgtgggtgacttgatgattgaaccagaataaggatgatcctgatccatcatgtctcatgcatcggtgtggctccggcctcatcaaacatgcatgcgtcgtctgcccctctgtgtgctttacgaccgtcctgtgtctgtatgtgttgatcattgcaaagaacccatgcacgcatacatctttgcatgtgtctctgtaatgatcggtccagagtgatgaatatataatactggtttgccttatcagcct

SEQ ID NO: 35044 - protein, 75 aa, Panicum virgatum
  misc_feature: Ceres CLONE 1958748
  misc_feature (1)..(75): Pfam Name: Metallothio_2 Pfam Description: Metallothionein
MSCSCGSSCNCGSNCKCRKMYPDLEEKSKGSAQAPINLSEAPEKKAGHLEAAADSGETAHPCKCRNTCSCDPCNC

SEQ ID NO: 35045 - DNA, 1173 bp, Panicum virgatum
  misc_feature: Ceres CLONE 1958755
  misc_feature: Encodes the peptide sequence at SEQ ID NO. 35046
cacaagaccgacggcttctgctcgcgttcggcgccatttccgcgagtttaccgtacccgctccgctccgccccgccaatccccttgccccccccgtgggcgaaattcctcgacggatcgatcttgatttctcgccgccgtccgcgcatctctgccaccgcctccaccacctgcctgtttgggaggttgcctggccgcgcgcccatggccgtccccgtgtgcgtcaccggcgccggcggcttcatcgggtcttggatagtcaagctcctcctcgaccgcgggtacgccgtccggggcactacccgccgcgcagatgaccccaagaacgcgaacctgtgggcgctcgacgacgcggcggagcgcctcacgatgctgcaggtggacctgctcgaccgggccagcctccgcgccgccttcgacggctgcgacggcgtcatccacaccgcctcgccgatgcacggcaaccccgaggagatcatcgagccawttatcgccgggacgcggaacgtcgttgaggccgcggccgacgccggcgtgcggcgcctggtgatctcctccaccatcggcaccatgtacatgaacccgcaccgcgaccccgacgcgcccctggaggagtggagctggagcgacctcgagcactgcaagaagaccgcgaactggtattgctacgccaagacgatcgcggagcagagcgcatggcaggcggcgcgggcgcaggggctggacctggccgtggtcatcccggtggtggtgctcggcgaactgatgcagccaagcatgaacaccagcaacctgcacatactcaagtacctcaccggccaggccaaggactatgtcaacgagtcgcacgcgtacgtgaacgtcaaggacgccgccgaggcgcacgtccgggtgctcgaggcacccggcgccggagggcatcgctacgtctgcgccgagcggactctgcaccgtggcgagctgtgccgcatcctcgctcaactcttcccagagtaccctattccgacgaggtgcaaggatgaggtgaatccaccaaagaagggctacaagtttacaaaccagcctctgaaggacctaggcatcaggttcacacctacgcatgagtacctctatgaagcagtaaaatccctgcaggaaaagggttttctccccaaggcttctgtcacagaggtaa

SEQ ID NO: 35046 - protein, 323 aa, Panicum virgatum
  misc_feature: Ceres CLONE 1958755
  misc_feature (5)..(244): Pfam Name: Epimerase Pfam Description: NAD dependent epimerase/dehydratase family
  misc_feature: SWISSPROT Homolog: EC 1.1.1.219 Dihydrokaempferol 4-reductase
  misc_feature: Functional homolog of the protein sequence given in SEQ ID NO 51017
  misc_feature: Useful for making plants with altered carbohydrate content
  misc_feature: Functional homolog of the protein sequence given in SEQ ID NO 50647
  misc_feature: Useful for making plants with altered cell wall content and/or composition
  misc_feature: Useful for making plants with altered lignin content
  misc_feature (95)..(95): Xaa is any aa, unknown, or other
MAVPVCVTGAGGFIGSWIVKLLLDRGYAVRGTTRRADDPKNANLWALDDAAERLTMLQVDLLDRASLRAAFDGCDGVIHTASPMHGNPEEIIEPXIAGTRNVVEAAADAGVRRLVISSTIGTMYMNPHRDPDAPLEEWSWSDLEHCKKTANWYCYAKTIAEQSAWQAARAQGLDLAVVIPVVVLGELMQPSMNTSNLHILKYLTGQAKDYVNESHAYVNVKDAAEAHVRVLEAPGAGGHRYVCAERTLHRGELCRILAQLFPEYPIPTRCKDEVNPPKKGYKFTNQPLKDLGIRFTPTHEYLYEAVKSLQEKGFLPKASVTEV

SEQ ID NO: 35047 - DNA, 679 bp, Panicum virgatum
  misc_feature: Ceres CLONE 1958758
  misc_feature: Encodes the peptide sequence at SEQ ID NO. 35048
agtttgcatccacctccttcttcctcccttaacttccccaaccactacctgcgacattccctttgctgtgttttcgcttcagagttcactctcttacaacgaaatcgccttcgtcctcttatcaccaacaacaaaatggatcgcatcaaggagaaaatgaaccagctccgcctggacgccgaggaggcggcagccaaggtcgacgagctccagagcaaagtcaagacgctcgagcaggagaacctccagaaggagcaggagattgtctcccttacgcacaagaacagcgtgcttgagacggaggccgaggaagcagacaggactttgcgcgaggccaacgagaagctgcggcagaccgacgtcaaggctggacacttcgagcggaaagtccaggccctcgagcaggagcgcgaccagtgggagtccaagtacgaggagatgcccaagaaatacaccgccgtgcagaaggagctggatgatttccaagctgagatcggcgccatctaagtctagcgcgattcggttggagagagggttttgttgggtccagctggttatcacggcttccggttctttacatgtgccgggccacatcgatgggcgagggtttgaggtggacgggtcactagcactgactccagtacttacattctgcgacaatccaaacacatacacccct

SEQ ID NO: 35048 - protein, 123 aa, Panicum virgatum
  misc_feature: Ceres CLONE 1958758
  misc_feature: SWISSPROT Homolog: EC 2.7.11.1 Non-specific serine/threonine protein kinase
MDRIKEKMNQLRLDAEEAAAKVDELQSKVKTLEQENLQKEQEIVSLTHKNSVLETEAEEADRTLREANEKLRQTDVKAGHFERKVQALEQERDQWESKYEEMPKKYTAVQKELDDFQAEIGAI

SEQ ID NO: 35049 - DNA, 556 bp, Panicum virgatum
  misc_feature: Ceres CLONE 1958784
  misc_feature: Encodes the peptide sequence at SEQ ID NO. 35050
attaattctcactcgtaaataagatagaaaatggccgtcagacctttgagacacaagaagatcgttcacaagagaaccaacagattcaccagattcgaatatgaagactacccaggcaaactcagccccagctggagaagaccaagaggtattgataacagagtgagaagaaggttcagaggcaacaagcctatgccaaaagtcggttatcgtactgataaggccaccagacatatgactaagagtggcttcaagaagttcttggttaccaaccttaaggacttggaacttttgttgatgaacaacagagtcttctgcgctgaaatcgcctccaacatctctgctagaaagagagctcaaatcgtcagaagagctgctgaattgaacgtcagacttaccaacggcaagggcaagcttagagttgaggaaaagaaaaatgaagcataaaaacattttctatattgtccagttgtttttaaataagtcaaaagttcgttgtggcaatcctcgtgctggtttatataaactattgaaccaaacaaaatcgatttttacc

SEQ ID NO: 35050 - protein, 138 aa, Panicum virgatum
  misc_feature: Ceres CLONE 1958784
  misc_feature (15)..(125): Pfam Name: Ribosomal_L32e Pfam Description: Ribosomal protein L32
MAVRPLRHKKIVHKRTNRFTRFEYEDYPGKLSPSWRRPRGIDNRVRRRFRGNKPMPKVGYRTDKATRHMTKSGFKKFLVTNLKDLELLLMNNRVFCAEIASNISARKRAQIVRRAAELNVRLTNGKGKLRVEEKKNEA

SEQ ID NO: 35051 - DNA, 501 bp, Panicum virgatum
  misc_feature: Ceres CLONE 1958785
  misc_feature: Encodes the peptide sequence at SEQ ID NO. 35052
gcgatcgatctggtcccccccacttgcacatgttctccttttcttctattataccggacctcttcactttcaccaggagctccgtggacgccaccggcggcgagaacaacacctcgtgtttggaggaggtgggtctgcctgtcgaggacgacaagaacatcatcctctccgacgtgcccgacgcccacgtcgacggcctgcccaccggctcgccggtgaccatggactggaggtcccacctcctcctcctcttcatcgactccgtcgctcaaacccccatcgtgggctgactgatcagcgtatcccctgtctgctggatcgccgctggtagctaccgcctacccccttggtgttccttcctgattgcccttacggggttagcttttaactcttactccataaaagggaatatctacacatctcatacttgaagttcatccactgccatggggaatggatctagctgctgtctagaatactactgatggagtgcatgaataa

SEQ ID NO: 35052 - protein, 86 aa, Panicum virgatum
  misc_feature: Ceres CLONE 1958785
  misc_feature (27)..(86): Pfam Name: potato_inhibit Pfam Description: Potato inhibitor I family
MFSFSSIIPDLFTFTRSSVDATGGENNTSCLEEVGLPVEDDKNIILSDVPDAHVDGLPTGSPVTMDWRSHLLLLFIDSVAQTPIVG

SEQ ID NO: 35053 - DNA, 600 bp, Panicum virgatum
  misc_feature: Ceres CLONE 1958792
  misc_feature: Encodes the peptide sequence at SEQ ID NO. 35054
aaaaccagaagaagaaaaagaaaaagctttttttcgagatatttcggaagaaagaggagtgcctgcctcgcaggcgcgcacctcattcgccgagcgcacgagatcctctagagtttttgagtattttgccgtcaaatttcgtgggggatttgcgcgtatgggggatcatgtcgcggtggatgttggggagctcgtggcgtcccgagccggcgaggcagcggggttggtgcccggcggcaaggaggaagccgaggcgctgattgggatggtggagtgccgcatttgccaggaggaggacctggtcaagaacctcgagagcccctgcgcttgcaacggtagcctcaagtatgcccacagggaatgtgtgcaacgttggtgctatgagaaaggagacataacctgtgaaatctgccatcagtcgtactagcctggctacactgctccaccccatgtgcatcatgatgaaactaccatagagataagtggtggagattggactatctctggcgaccgtttggatctacatgatcctagaatcttggcaatggctgctgctcaacaccgtttgcttgaagatcagtatgatgaatatactgcaac

SEQ ID NO: 35054 - protein, 89 aa, Panicum virgatum
  misc_feature: Ceres CLONE 1958792
  misc_feature (40)..(85): Pfam Name: zf-C3HC4 Pfam Description: Zinc finger, C3HC4 type (RING finger)
MGDHVAVDVGELVASRAGEAAGLVPGGKEEAEALIGMVECRICQEEDLVKNLESPCACNGSLKYAHRECVQRWCYEKGDITCEICHQSY

SEQ ID NO: 35055 - DNA, 400 bp, Panicum virgatum
  misc_feature: Ceres CLONE 1958806
  misc_feature: Encodes the peptide sequence at SEQ ID NO. 35056
gcctctcttgctctcctactacgtttatggttccggcaaggtcttgcccagctcgccgcatctgcggcggagatgggtgtcccggcgttctaccgggggctggcggacaaatacccgatggtggtggtggacgtggtggaggaggagcccgtggaaatggagggcgtcaaggtgcccgtcgacacctccaagcccaaccccgacggtctctatttctacaacctctacctagatatgaatgggatcatactgccctgcttccacccggaggacaggccctccccaactacattcggtgaggttttccagtgcatgtttgattacatatacagattattcctcatggttcgccctcgaaggcttttatacatggccattgatggtgttgctcctcatgcta

SEQ ID NO: 35056 - protein, 109 aa, Panicum virgatum
  misc_feature: Ceres CLONE 1958806
  misc_feature (1)..(109): Pfam Name: XRN_N Pfam Description: XRN 5'-3' exonuclease N-terminus
MGVPAFYRGLADKYPMVVVDVVEEEPVEMEGVKVPVDTSKPNPDGLYFYNLYLDMNGIILPCFHPEDRPSPTTFGEVFQCMFDYIYRLFLMVRPRRLLYMAIDGVAPHA

SEQ ID NO: 35057 - DNA, 887 bp, Panicum virgatum
  misc_feature: Ceres CLONE 1958819
  misc_feature: Encodes the peptide sequence at SEQ ID NO. 35058
cattccatattcgtaggcgatcttgcttctgatgtcaatgatgctacacttctggagactttctccagcaggcccatgagaattggccctgcaactcccagaaaatcatcaggtacttctggatcaaatggttcatctgcccgttcagatggaggagacttgacaaacacaactgtatttgtcggcgggctcgacccaaatgttagtgaagaggaccttaggcagaccttctcccagtatggcgaaatatcttctgtaaagattccagtcggtaaacaatgcggcttcgtgcaatttgctcagagaaagaatgcagaggatgcattgcaaggactaaacggaagcaccattggcaagcagaccgtgcgcctttcatggggccgcaacccagcaaacaagcagtttaggggcgacaacgggaaccagtggaacaacgggatgtactacgcggcgtccccgttctacaacggctacggctaccctgcggcgccgttccctgaccccggcatgtacgccgctccggcctacggcgcctacccgttctacggcaaccagcaacaagtgagctgagctgctcgttctgaactgaactgccggcgcgtcccgggcgaagctggagctggaggtattaggctgttaggtgtagcaaagctcatggtagaagaaggtagacgacgacggtttcttaggtgagctagatgcggtgacttgcctttgtaaagtgcgctacacgatctagcgcctagcgccaccaagagtccgagacacctattgattggccaccactgtctgtcggattcaacggcaaaaaaagaatttttgatgacctggagctgtatgcgaccttgaagcagaacaataaagctaatgaaatccttgtgtctgct

SEQ ID NO: 35058 - protein, 189 aa, Panicum virgatum
  misc_feature: Ceres CLONE 1958819
  misc_feature (59)..(124): Pfam Name: RRM_1 Pfam Description: RNA recognition motif. (a.k.a. RRM, RBD, or RNP domain)
  misc_feature: Functional homolog of the protein sequence given in SEQ ID NO 50786
  misc_feature: Useful for making plants with altered terpenoid content
  misc_feature: The sequence is a functional homolog of SEQ ID NO 536 in the 10/666,642 US patent application
HSIFVGDLASDVNDATLLETFSSRPMRIGPATPRKSSGTSGSNGSSARSDGGDLTNTTVFVGGLDPNVSEEDLRQTFSQYGEISSVKIPVGKQCGFVQFAQRKNAEDALQGLNGSTIGKQTVRLSWGRNPANKQFRGDNGNQWNNGMYYAASPFYNGYGYPAAPFPDPGMYAAPAYGAYPFYGNQQQVS

SEQ ID NO: 35059 - DNA, 640 bp, Panicum virgatum
  misc_feature: Ceres CLONE 1958820
  misc_feature: Encodes the peptide sequence at SEQ ID NO. 35060
  misc_feature (513)..(513): n is a, c, t, g, unknown, or other
tatgatacctcgatagtctggaaggtttttcagccgttacttgatccaatggtaacgctggacacccttccaatgcatcctgttagggagctccaagagcgctgccagcagcaagctgaaggattagaatacaaagcatcccgtgcaggcaatgttgctaccgttgaagtctttgttgatggtattcagattggtgtagctcagaacccacagaagaagatggcacaaaagttggcagcgagaaatgcgcttgttgtcctgaaggagaaggaaactgcagcgaagaaagataccgaaaaggatggtgagaagaaaaatggttctcagatgttcactaggcagaccctgaacgacatctgcttgagaaggcagtggccaatgccacaatacaggtgcgttaacgagggcggccctgcccatgccaaaagatttgtttattcagtaagggtgaatacatctgaccgtggatggactgacgagtgcattggagagccaatgccgagtgtgaagaangctaaggactctgctgccgttcttctccttgagcttttgaataggaattatcaacacaagcctgacggcaaatagtttagttgatgttcttggtagtggtgatgtgggggcattcagcattcttata

SEQ ID NO: 35060 - protein, 195 aa, Panicum virgatum
  misc_feature: Ceres CLONE 1958820
  misc_feature (112)..(184): Pfam Name: dsrm Pfam Description: Double-stranded RNA binding motif
  misc_feature (27)..(87): Pfam Name: dsrm Pfam Description: Double-stranded RNA binding motif
  misc_feature (171)..(171): Xaa is any aa, unknown, or other
YDTSIVWKVFQPLLDPMVTLDTLPMHPVRELQERCQQQAEGLEYKASRAGNVATVEVFVDGIQIGVAQNPQKKMAQKLAARNALVVLKEKETAAKKDTEKDGEKKNGSQMFTRQTLNDICLRRQWPMPQYRCVNEGGPAHAKRFVYSVRVNTSDRGWTDECIGEPMPSVKXAKDSAAVLLLELLNRNYQHKPDGK

SEQ ID NO: 35061 - DNA, 392 bp, Panicum virgatum
  misc_feature: Ceres CLONE 1958824
  misc_feature: Encodes the peptide sequence at SEQ ID NO. 35062
gttttctgtcggcccgtcgaatctcaaaaatcaaatcaagatgagcgagaccactgctactgatggattggcctacgtcaaggtcgagaagctcctcggccgtaccggctcgcgtggtggtgtgacccaggttcgctgcagcttcgtcaactcgactcgccgcgagatcatccgcaacgtcgtcggccccgtgcgcgtcggtgatatcctcatcctcctcgaaactgagcgtgaagcccgccgactccgctaagtgtgctgacctcatgctgctcactcgtttggagactatgccaatcgaaatgctgcggcctacgacgacaggcattttctacttcgatggacgtcgagcagggtgctagccgccgaagagaataaattattacctcatc

SEQ ID NO: 35062 - protein, 70 aa, Panicum virgatum
  misc_feature: Ceres CLONE 1958824
  misc_feature (2)..(70): Pfam Name: Ribosomal_S28e Pfam Description: Ribosomal protein S28e
MSETTATDGLAYVKVEKLLGRTGSRGGVTQVRCSFVNSTRREIIRNVVGPVRVGDILILLETEREARRLR

SEQ ID NO: 35063 - DNA, 657 bp, Panicum virgatum
  misc_feature: Ceres CLONE 1958834
  misc_feature: Encodes the peptide sequence at SEQ ID NO. 35064
gcagccgcttctggaagagcattggcctgggcttcaagacccccagggaagcaattgaagggacctacattgacaagaagtgcccattcactggaactgtttccatcagaggcaggattattgccggagcatgccatagtgcaaagatgaacagaaccatcattgttcgcaggaactacctccactttgttaagaaatatcagaggtacgagaagaggcactccaacattccggctcacatctccccatgcttccgtgtcaaggaaggtgaccatgtcatcattggccagtgcaggcccctctccaaaactgtgaggttcaacgtggtgaaagtcatcccagctggatccactgatggcagaggcgggaagaaggcgttcaccgcggcctgagctttagactatgttccaagagtagtctatagaatgatgtctttttgctaaaaatcctgctaggctggtgttttcgattatggtttggagattgttcgctgctgctggagtcactattgtctagttcctattaaggcattcaatgtcatgtcatccataaattggaggacagcagatacctcttattaaaagtaccttatgagtgattggtgatggcttggtatgtgtatggtttatgagtgttgcatcacccctgtttgatgtt

SEQ ID NO: 35064 - protein, 129 aa, Panicum virgatum
  misc_feature: Ceres CLONE 1958834
  misc_feature (42)..(111): Pfam Name: Ribosomal_S17 Pfam Description: Ribosomal protein S17
SRFWKSIGLGFKTPREAIEGTYIDKKCPFTGTVSIRGRIIAGACHSAKMNRTIIVRRNYLHFVKKYQRYEKRHSNIPAHISPCFRVKEGDHVIIGQCRPLSKTVRFNVVKVIPAGSTDGRGGKKAFTAA

SEQ ID NO: 35065 - DNA, 646 bp, Panicum virgatum
  misc_feature: Ceres CLONE 1958843
  misc_feature: Encodes the peptide sequence at SEQ ID NO. 35066
ggtgggggtcaggtcattccaactgccaggagggtcatctatgcttctcagctcacggccaagccaagactgctggagccagtgtaccttgtggagatccaggctcctgagaatgcacttggtggtatctacggtgttctgaaccagaagagagggcacgtgtttgaggagatgcagaggccgggtaccccgctctacaacgtcaaggcttacctccctgtcattgagtcctttgggttctccagccagctgagggctgcaacctctggtcaggcgttccctcagtgtgtgttcgaccactgggacatgatgggctctgatcctttggaggctggctcccacgctgctcagctggtgttggacatccgcaagaggaagggtctcaaggagcagatgaccccgctttctgagttcgaggacaagctctaaatttttggccttttgtggtactgttaccccctgatggtttaatcgtccattcgtctgctgtaatggaactatttttgtatttcatttcctttagtggtcaaatgcttctgtttctgaacatcattagccatatggtagtgccctgctaaaactgttgttatcctttgcgatgtaacagatgaaacagagttggtatttgtagcataatcttgtttct

SEQ ID NO: 35066 - protein, 142 aa, Panicum virgatum
  misc_feature: Ceres CLONE 1958843
  misc_feature (23)..(111): Pfam Name: EFG_C Pfam Description: Elongation factor G C-terminus
GGGQVIPTARRVIYASQLTAKPRLLEPVYLVEIQAPENALGGIYGVLNQKRGHVFEEMQRPGTPLYNVKAYLPVIESFGFSSQLRAATSGQAFPQCVFDHWDMMGSDPLEAGSHAAQLVLDIRKRKGLKEQMTPLSEFEDKL

SEQ ID NO: 35067 - DNA, 564 bp, Panicum virgatum
  misc_feature: Ceres CLONE 1958859
  misc_feature: Encodes the peptide sequence at SEQ ID NO. 35068
aaaagttattatttataaacttaattgcccaagaaataaattcacaggaagtcatgaaatacatcgctgcttatgcccttttggtcctcggtggaaacgaaaccccctctgatgctgatgtcagaaaggtcctccaagaaatcggtggtgaagtcaatgaagaagaactcaccagagttgtaaatgctcttaagggcaagcaactccacgaagttattgctgccggatctaagaagctctctaccgtctccttcggtggaagctctgcccccgctggtaacactgctgcccccgccaaggttgaagccaagaaggaagaaaagcccgctgctaaagaagaagaagctgctgatgttggcttgggcggtggtctcttcggtgatgacgaagaatggtaagctgcagaaagttgattgtatgcatgaagttctctctcatatgtgttgctactcgtatgtaataagaacatgaaaccctaaataagcaaaatagttttgttgttttgtgaagaaagtaatctcaacatgtattagagttagcaaacttgctctattttgacaacgg

SEQ ID NO: 35068 - protein, 114 aa, Panicum virgatum
  misc_feature: Ceres CLONE 1958859
  misc_feature (17)..(108): Pfam Name: Ribosomal_60s Pfam Description: 60s Acidic ribosomal protein
MKYIAAYALLVLGGNETPSDADVRKVLQEIGGEVNEEELTRVVNALKGKQLHEVIAAGSKKLSTVSFGGSSAPAGNTAAPAKVEAKKEEKPAAKEEEAADVGLGGGLFGDDEEW

SEQ ID NO: 35069 - DNA, 385 bp, Panicum virgatum
  misc_feature: Ceres CLONE 1958882
  misc_feature: Encodes the peptide sequence at SEQ ID NO. 35070
gtaattttgcccccgtcccccttgcgaaccccttattgaatggcgaggttggacccaaaacaatccatgttccgtctggggagaaccttgctgtttttgatgctgctatgaaataccacaatgaagggcatgatactataattctggctggtgctgaatatggtagtggaagctctcgggattgagctgcccacggccccctgctacacggagtccaggctgtgataccaaacagctttcacaggattcaccgtagcaatcttgctggtatgggaattatccctctttgcttccagggaagggaggatgcccacacccttggcttaactggccatgagagctacacgatccaccttccaatcaatgtgagtgacatacagctctg

SEQ ID NO: 35070 - protein, 60 aa, Panicum virgatum
  misc_feature: Ceres CLONE 1958882
  misc_feature: SWISSPROT Homolog: EC 4.2.1.3 Aconitate hydratase
NFAPVPLANPLLNGEVGPKTIHVPSGENLAVFDAAMKYHNEGHDTIILAGAEYGSGSSRD

SEQ ID NO: 35071 - DNA, 1016 bp, Panicum virgatum
  misc_feature: Ceres CLONE 1958889
  misc_feature: Encodes the peptide sequence at SEQ ID NO. 35072
atgctgagtggatagcaggtcggtccctaatcgcagccagggaggcggagcggccggccggggcgaggagaccggcgtccgtgcagaggggggccgccgcgccgcgccagactgagatgctggagcaatgtcagattcaaagggcggcggcggcggcggcggcatgaacatggtgaccacggcgatggccttctcggtcagcgccttcttcgtgctcttcgtcttcaccaggctgctctgcgcgcgcctccacctgtccagggccgccgcggccgacgaccgcgccgccggcgacgccttcgtcktctckgcctacaacgtggagcgcgggatccacgggctggagccctccgtggtgacgaccttccccaccgtcaagctcggcgacggcggcccgcagcggccgccggtgcaggaggcgcagtgcacggtgtgcctggaggagtacgaggccaaggacgtggtgcgcgtgctgccggcctgcggccacgccttccacgcgccctgcatcgacgcctggctccggcagcaccccacctgcccggtctgccgcgcctccctgcgctccaaggccagcggcggcaaccgcgccgcggcgccggactacagcgtcctcgtcgccggcgccgccgacgccgcgagggaggcctcctcccaccatgttccggcgtcctcgtccgacgacaccgcgtcaccgcgggcggccgacgcggatggccggctggagatcatcaccgaagagcctgcctcccccgacagcccgagccctgccgccgccgtcggtgccgaccgccattctccctgcgccgagacggcgaggcagagcgggagcgccgccgccggcgcgtcggagcattgctaggtagcgcacgctgacacacgctgtgtttacatggaacggccggaacagtgttgtgaattgagatcgcgaccgtgtttaggggcagtctttggggaaaaggaaatctggttttaacaggcttctttattctgatttcgtgaagctcattgcgctt

SEQ ID NO: 35072 - protein, 244 aa, Panicum virgatum
  misc_feature: Ceres CLONE 1958889
  misc_feature (100)..(141): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature (60)..(60): Xaa is any aa, unknown, or other
MSDSKGGGGGGGMNMVTTAMAFSVSAFFVLFVFTRLLCARLHLSRAAAADDRAAGDAFVXSAYNVERGIHGLEPSVVTTFPTVKLGDGGPQRPPVQEAQCTVCLEEYEAKDVVRVLPACGHAFHAPCIDAWLRQHPTCPVCRASLRSKASGGNRAAAPDYSVLVAGAADAAREASSHHVPASSSDDTASPRAADADGRLEIITEEPASPDSPSPAAAVGADRHSPCAETARQSGSAAAGASEHC

SEQ ID NO: 35073 - DNA, 728 bp, Panicum virgatum
  misc_feature: Ceres CLONE 1958890
  misc_feature: Encodes the peptide sequence at SEQ ID NO. 35074
tagcgaaacggtggtgggtatagctagctcgagcaggcagccacacctggcgccggagcggagcacaatacatccgatccatcgatcgctgtaggtgtccttctctgagatggccggagggaagctgtactcgttcgaggaggtgaggaagcacaacgaccgcaaggattgctggctcatcatcgccggcaaggtgtacgacgtcacgccgtacatggaggagcaccccggcggcgacgaggtcctgctggcgtgcacaggcaaggacgcgacggccgactacgaggacatcggccacagcgccgacgccaaggagctcatgaagcagtactgcatcggcgaggtcgacgcggccaccgtcccggccaagctcacctacacctaccccagcgactcgagcgcccagaaggcgtcggcgagcgcgggcgcctgggccacgacgctcctgcagctcggcgcgcccctcctgctgctggcgctggccctggcgagctacggcaagggctgggccaaggcagagtaggaggcgagcacgagatgccgtcgttgattccgcgggggcgcatatctgcagcctcttggaagcatctgggagttgtttttgggtccttaaaaaagtacgagtggttcgtgtgttcacctcaaccgctgggtggtgtcgtcaattttaaattcctgggtattgtgtatcgaacatgatgtatacagcatactgctataattacgtg

SEQ ID NO: 35074 - protein, 137 aa, Panicum virgatum
  misc_feature: Ceres CLONE 1958890
  misc_feature: SWISSPROT Homolog: EC 1.7.1.1 Nitrate reductase (NADH)
MAGGKLYSFEEVRKHNDRKDCWLIIAGKVYDVTPYMEEHPGGDEVLLACTGKDATADYEDIGHSADAKELMKQYCIGEVDAATVPAKLTYTYPSDSSAQKASASAGAWATTLLQLGAPLLLLALALASYGKGWAKAE

SEQ ID NO: 35075 - DNA, 1734 bp, Panicum virgatum
  misc_feature: Ceres CLONE 1958904
  misc_feature: Encodes the peptide sequence at SEQ ID NO. 35076
aaccggcgcacagtaaactgctgcaactgacaacagagaagaccccccaaatggacactaccgtcgtcgccatcgccggcgacggagacgactccttccgccgccccctcctctcccagaccgaagagatccacccctatgaagaacccccttcctcccagcgcgcgcctccggacgccgcggcggcgcagcccgagcaggagcggaagccgcagcgggtggcctcgctggacgtgttccgtggcttcaccgtcgctatgatgatactcgtagacgacgcgggcggggcgtggccgggcatcaaccacgcgccatggttcggggtgacggtggcggacttcgtcatgcccgccttcctcttcatcatcggcgtctccgccgcacttgtcttcaagaaaatcccaaataagacagcagcaactaagaaggctatggttagggctatcaagcttttcatcttgggtgtgattttgcaaggaggatacattcatggacggcacaaattaacatatggtgttgatttggatcaaattcgatggctaggtgtgcttcagcggatagctattggatactttctagcagcaatttcagagatttggcttgtcaacggtaatttggtggattcatttgtatcgtttgtgaagaaatacttcatggagtggatcatggccatgatgattacaatactttatgttgccttagtattcggcctttatgttccaaactggcaattcaaagttaaagttagcaatccaaccctttcgaccccaattagtttagttgaaatgaagacgatccactgtggagttagaggtagtcttggaccaccttgcaatgcagttggcttggtagatcgagttttgcttggtgaaaatcacctgtacaagaatccagtctacaaaaggacaaaggaatgcagtattaattctcctgattatggaccgcttccttcgaatgcaccagactggtgcctggctccatttgatcctgagggtttgttaagtacactgatggctgcagtaacttgctttgttggattgcactttggtcatgttttaattcattgcaagaatcattcacagcgaatgctattctggctgctagcttcgatggtgttgacaatctttgcatttttactgctactattaggcatgcctttcagcaagcctttgtatacagtgagttacatgctactcagtgctggagtatctggattcttgttgctgctgttatactacatagttgatgttattcatatcaagaagccatttattctcttccagtggatgggcatgaatgcgcttatagtctatgttctggctgcctgtgagctgtttcctactcttattcaagggttttattggcggtcacctgagaacaacctggtggacattacagagtctttgctccaggccatcttccactcgaaacgatggggcaccttggcgttcgtcctcctggagatagtcttttggtgcctggccgctggtttcctccacatgaaaggcgtctacttaaagctgtagaaccaatcatggacacatagaactacggctgcttggctacattgtttcatctgtaaatgctgtgtgggttgggacccatgggtgttgtggttgatttcgggatagagaagctgttaagttgtagatagtgctgctgtggggggttttttgtttaccaaaatttgtgctcccatgatctatatcatgctcctccaatttctgagcttgc

SEQ ID NO: 35076 - protein, 491 aa, Panicum virgatum
  misc_feature: Ceres CLONE 1958904
  misc_feature: SWISSPROT Homolog: EC 2.3.1.78 Heparan-alpha-glucosaminide N-acetyltransferase
MDTTVVAIAGDGDDSFRRPLLSQTEEIHPYEEPPSSQRAPPDAAAAQPEQERKPQRVASLDVFRGFTVAMMILVDDAGGAWPGINHAPWFGVTVADFVMPAFLFIIGVSAALVFKKIPNKTAATKKAMVRAIKLFILGVILQGGYIHGRHKLTYGVDLDQIRWLGVLQRIAIGYFLAAISEIWLVNGNLVDSFVSFVKKYFMEWIMAMMITILYVALVFGLYVPNWQFKVKVSNPTLSTPISLVEMKTIHCGVRGSLGPPCNAVGLVDRVLLGENHLYKNPVYKRTKECSINSPDYGPLPSNAPDWCLAPFDPEGLLSTLMAAVTCFVGLHFGHVLIHCKNHSQRMLFWLLASMVLTIFAFLLLLLGMPFSKPLYTVSYMLLSAGVSGFLLLLLYYIVDVIHIKKPFILFQWMGMNALIVYVLAACELFPTLIQGFYWRSPENNLVDITESLLQAIFHSKRWGTLAFVLLEIVFWCLAAGFLHMKGVYLKL

SEQ ID NO: 35077 - DNA, 1055 bp, Panicum virgatum
  misc_feature: Ceres CLONE 1958919
  misc_feature: Encodes the peptide sequence at SEQ ID NO. 35078
gtcgcagacacaacacacacacacagagcaacaagctaacaaaaaccttgtagcgccagtccagtcttgaaacgttcttcgagcttagcaagacgagcttacagttccgttcgatccaccggtccagcttctagcttttggcacagcaagctcgcgatggcttctcgtcaggagcaggctagctaccacgccggcgagaccaaggcccgtgccgaggagaaggcggggcaggtgatgggcgcggcgcaggagaaagggcgggaggccaagtccatggcgtccggcgccgccgaccgcgccgtgggcaggggccacgacgccagggaggccaccagggagaaggcgcgcgaggccgcggaccgcaccatgggggtgggccgcgacgccgcgggggcgaccagggacaaggcctaccgggccaaggacgcggcctccgacgccgcgggccgcgccgcggacaagggccgcggcgccgcggaggccaccagggacacggcctgcgaggccaaggacgtcgcgcagacggccgaggccgccaagcagaaggcggcgggcgccgcgcagtacgccaaggagaccgtggtggctggcaaggacaagaccggtgccctcctgcagcaggcaggggagacggtgatgaacacggcggcgggggccaaggacaaggtggtgagcaccgccgtgggggccaaggacgccgtgatgaactcgctcgggatggccggggagaacgacgacggcaccaccaccaatcccggcaaggacaccagtacctacaagcctggaagggactactaatcaaaggatggatggagatgctgctgcttgctgccaaactgtatctttaggctcaaagtttcagttacgtatcttacgtgtgcgtttcactttgctttgatttcaacctgtgtttgcctccctggtcatttggaggtttgtaacttttttttaattagaacataggtgatgtaggggacattgtctaaccggacgcctcttgtcttgtgttttcgtttcacgatctaataaaaagttgcaaagctggtgttttgttt

SEQ ID NO: 35078 - protein, 213 aa, Panicum virgatum
  misc_feature: Ceres CLONE 1958919
  misc_feature (56)..(99): Pfam Name: LEA_4 Pfam Description: Late embryogenesis abundant protein
MASRQEQASYHAGETKARAEEKAGQVMGAAQEKGREAKSMASGAADRAVGRGHDAREATREKAREAADRTMGVGRDAAGATRDKAYRAKDAASDAAGRAADKGRGAAEATRDTACEAKDVAQTAEAAKQKAAGAAQYAKETVVAGKDKTGALLQQAGETVMNTAAGAKDKVVSTAVGAKDAVMNSLGMAGENDDGTTTNPGKDTSTYKPGRDY

SEQ ID NO: 35079 - DNA, 621 bp, Panicum virgatum
  misc_feature: Ceres CLONE 1958937
  misc_feature: Encodes the peptide sequence at SEQ ID NO. 35080
aggagcacaaaaaagtttcatcgcagaatgtaatgctttgagaaatgtgcggcatcgcaatctagttcatatcctaactgcatgctcaagcattgatcctaatggaaatgatttcaaagccttggtgtatgagttcatgccacgaggagacctgcataacttactgtactcaactcgagacagagaaggttcgtcatattttattccactagttcaaaggttaagcatcatggtggatgtatcagaagctttggcgtatctacaccatcaccaccaaggaaccattgtacattgtgatctgaaacctagcaacattcttctagatgatgatatggtagcacatgttggagactttgggctagcaaggttcaaatttgatacaacatcaccatctcttgttgactcaacttccatttcttcactcgcaatcaagggaaccattggatacattgctccagaatatgctgcgggcggtcaggtttccactgcggctgatatatacagcttcggagttattctccttgagatattcattcgaaggagcccgacagatgacatgttcaaggatgggatgaccattgcaaagtttacggagatcaacttctccgataatgtgttcca

SEQ ID NO: 35080 - protein, 206 aa, Panicum virgatum
  misc_feature: Ceres CLONE 1958937
  misc_feature (1)..(206): Pfam Name: Pkinase_Tyr Pfam Description: Protein tyrosine kinase
  misc_feature: SWISSPROT Homolog: EC 2.7.11.1 Non-specific serine/threonine protein kinase
GAQKSFIAECNALRNVRHRNLVHILTACSSIDPNGNDFKALVYEFMPRGDLHNLLYSTRDREGSSYFIPLVQRLSIMVDVSEALAYLHHHHQGTIVHCDLKPSNILLDDDMVAHVGDFGLARFKFDTTSPSLVDSTSISSLAIKGTIGYIAPEYAAGGQVSTAADIYSFGVILLEIFIRRSPTDDMFKDGMTIAKFTEINFSDNVF

SEQ ID NO: 35081 - DNA, 507 bp, Panicum virgatum
  misc_feature: Ceres CLONE 1958956
  misc_feature: Encodes the peptide sequence at SEQ ID NO. 35082
aggaaccgcggcccgcaaagactccaaagaacagccaccgacggacaagtcgcctccgggtctagctagggtttccgttccgcttcctctccccgcacgcgaagcagggcgcagcgttgatggcaacggcaccggcgccggcggacccgaaggcggaggcggccaagatggacctcctggaggacgacgacgagttcgaggagttcgagatcgaccaagaatgggacgacaaggaagaaggcaatgaagctgtccagcagtgggaggacgactgggatgatgatgacgttaatgatgatttctcgcagcagctgaggaaagaactggagggagcccagaagagctgaagtgttttcttccgtagtataaatgttactcttgtatggccgttactttctgaaccgctgtgtgcttcagacagttatgggtgcgcgtctgggagcaccacctaatttgcggaatatttctacggggaagtttatggtcgtgctgtagtttccatattag

SEQ ID NO: 35082 - protein, 75 aa, Panicum virgatum; identical to SEQ ID NO: 13071
  misc_feature: Ceres CLONE 1958956
  misc_feature (10)..(72): Pfam Name: DSS1_SEM1 Pfam Description: DSS1/SEM1 family

SEQ ID NO: 35083 - DNA, 764 bp, Panicum virgatum
  misc_feature: Ceres CLONE 1958997
  misc_feature: Encodes the peptide sequence at SEQ ID NO. 35084
ggttcattggcttcccgccgccgccgccgcctcacatcgagcgaaaggcattcgccggaacggagcgcggagatgagcgggacagcgttcaacgcgttcaagtcgcgggtgccggtggcgtggagcccgcggctgtacatcacgctggtgcgggggctccccgggacgcggcgcctccaccgccgcacgctcgaggccatgcgactccgccgctgccaccgcaccgtcgagcaccgtaccacgccgtcgcttctcggaatgctcacccaggtaaagcgcctcgtcgtcgtcgagaccgaggagatgtataacgagcggaggcaggcagaggaggagcgacgcgcgcccaggccgccgcttctcatctcccaccaccagccagcgccaactgcgaacccgggagcagccacggcagagggttctgctgccacttcgccgtagcctctgggcatgagaagcctttcatgacagttcaacgtcataataattaatttgccttttgactctagaagatatcattggatcctcgtgctcaacaagctccagcaacccatactctatgaaaaattgcagtatggtccaaactactgtttccttcgccctgtatttagatttgtttatggacaggtattggtgtttcagtgcctgtggtcaatcttgctcggtgtaatttcaattacaaaaatttctaaaaatgctctttaagatgtcatattggtttcttccctaatttaacgtaaggatgtatctcagattttaaatct

SEQ ID NO: 35084 - protein, 122 aa, Panicum virgatum
  misc_feature: Ceres CLONE 1958997
  misc_feature (20)..(71): Pfam Name: Ribosomal_L30 Pfam Description: Ribosomal protein L30p/L7e
MSGTAFNAFKSRVPVAWSPRLYITLVRGLPGTRRLHRRTLEAMRLRRCHRTVEHRTTPSLLGMLTQVKRLVVVETEEMYNERRQAEEERRAPRPPLLISHHQPAPTANPGAATAEGSAATSP

SEQ ID NO: 35085 - DNA, 669 bp, Panicum virgatum
  misc_feature: Ceres CLONE 1959004
  misc_feature: Encodes the peptide sequence at SEQ ID NO. 35086
acaaaaccctagcgccggcgccgcagacacctcccttccctcgcgccgccgccgagaatggtgcgttgtctccctttcccccgcgccactggacgcagctgattctagtctgctccttgtgtctaatctgctcgcgtgccccgttgcaggccccgaagaaggacaaggccccgccgccgtcctccaagccggccaagtccggcggtggcaagcagaagaagaagaagtggagcaagggaaagcaaaaggagaaggtgaacaacgcggtgctcttcgaccaggccacctacgacaagctgctctcggaggtgcccaagtacaagcagatcaccccctcagtcctctccgagcgtctcaggatcaatggctccctggctcggagggccatcaaggacctgatggctcgtggcctcatccgaatggtctcagtgcactcaagccagcagatctacaccagggcaaccaacacctaaggattcgggaagctgtaatgcctctgtttgccctctgtaggaggagctcctctgccttagaacagttgtcatctttgtcaagggtttgctaatgttatgttacctgtgatgagtatctccatgtggctgaaacatttcagtgattttgcgaattagttcagtactatggtttacctaatataagttgccttgcatc

SEQ ID NO: 35086 - protein, 156 aa, Panicum virgatum
  misc_feature: Ceres CLONE 1959004
  misc_feature (50)..(154): Pfam Name: Ribosomal_S25 Pfam Description: S25 ribosomal protein
KTLAPAPQTPPFPRAAAENGALSPFPPRHWTQLILVCSLCLICSRAPLQAPKKDKAPPPSSKPAKSGGGKQKKKKWSKGKQKEKVNNAVLFDQATYDKLLSEVPKYKQITPSVLSERLRINGSLARRAIKDLMARGLIRMVSVHSSQQIYTRATNT

SEQ ID NO: 35087 - DNA, 419 bp, Panicum virgatum
  misc_feature: Ceres CLONE 1959031
  misc_feature: Encodes the peptide sequence at SEQ ID NO. 35088
agacatcggcgagcagattccccgcattccggttctcaatccacccacccgcctgctgcggatcttgaagatggggaagccatccgcagggaacgcgatgtccgtgacgaccgtcgtggtgcccttctggcgcgcggcgggtatgacctacatcggctactcccccgtctgcgccgccctggtgctcaactgcctcaaggactccttcaagtccgaggccgtctcccgcgagacggtccccttctccgtcgccgggtgcacggactgcaaccagtgagaaccccactgtccgcgctgagtcagatgaataaaaatctggtgccctgatgacatgcctttctgtatatgtcttgttttgtcttgttgttcctctatttggaacttgctgtttatctgccttgattttatggtcaactttg

SEQ ID NO: 35088 - protein, 59 aa, Panicum virgatum
  misc_feature: Ceres CLONE 1959031
  misc_feature (9)..(53): Pfam Name: ATP-synt_Eps Pfam Description: Mitochondrial ATP synthase epsilon chain
MSVTTVVVPFWRAAGMTYIGYSPVCAALVLNCLKDSFKSEAVSRETVPFSVAGCTDCNQ

SEQ ID NO: 35089 - DNA, 682 bp, Panicum virgatum
  misc_feature: Ceres CLONE 1959034
  misc_feature: Encodes the peptide sequence at SEQ ID NO. 35090
agaacccgaagccaaacgggacaaagaggcaggaaacgagaggggaattccagagacgcctcatctcaggtccaaacttatcggcgatgatgctgcgcgcggcgggcaagaggctcctcggcgccgcgtccggcgtcacaggcggcgaggcggcgccggcgccggcggtggcggctgcgggcgcggcgaggcggggctaccacgagcgggtcgtggatcactacaacaacccgcgcaacgttgggtccttcgacaaggacgacgcggacgtcggcacggggatcgtcggcgcgccggcgtgcggggacgtcatgaagctgcagatccgtgtcgacgaggggtccggcaagatcgtcgacgcgcgcttcaagaccttcgggtgcggctccgccatcgcgtcctcctccgtcgctactgagtgggttaagggcaagcaaatggaggaggtagtcgcaatcaagaacactgaaattgcaaagcacctatctcttccaccggtgaagctccactgcagcatgctcgctgaggatgcaatcaaagccgccgtgaaggactacgaagcaaagaaggggaagctggccaaggcagacgagtaggaacaccccacaagagcgcggccacctctagatgactagctctggctggcagagtactttgcaacgagagcatgtacttaaacaag

SEQ ID NO: 35090 - protein, 169 aa, Panicum virgatum
  misc_feature: Ceres CLONE 1959034
  misc_feature (37)..(164): Pfam Name: NifU_N Pfam Description: NifU-like N terminal domain
MMLRAAGKRLLGAASGVTGGEAAPAPAVAAAGAARRGYHERVVDHYNNPRNVGSFDKDDADVGTGIVGAPACGDVMKLQIRVDEGSGKIVDARFKTFGCGSAIASSSVATEWVKGKQMEEVVAIKNTEIAKHLSLPPVKLHCSMLAEDAIKAAVKDYEAKKGKLAKADE

SEQ ID NO: 35091 - DNA, 619 bp, Panicum virgatum
  misc_feature: Ceres CLONE 1959039
  misc_feature: Encodes the peptide sequence at SEQ ID NO. 35092
gcggaacatcctcctgacggcggatctcagggctaagatatcgggcttctccctggccaagccagccacggtcgacgccgccgcgacgagctccgacgtgttcgccttcgggcttctgctcctggagctcctctccgggcggagggcgatggaggcgcgcatcggctcggagatcggcatgctgtcgcgggagatccgcgccgtgctggaggccggcgacaagcgggaggcgaagctgatcaagtggatggaccccgccctgggaagcgagtaccaggtcgacgcggctctcagcgtggccggcatggcgagggcctgcaccgaggaggacgcggcgcggcggcccaagatggccgaggtcgtgttcagcctctccgttctggtgcagccgttgtcggtgggcgacgcgttcgagaagctgtggcagcccagctcggaggataacatccggatcgccggctcggtggcagcccgataggatcaattgaaagcagagcttcgtttaacagaatagtttttttttttagtttcctcgacttcaacctccactgtaactagtttactgctacttctccttttaaaatgtgtatcaattgtacgatagtttacttcagttgta

SEQ ID NO: 35092 - protein, 158 aa, Panicum virgatum
  misc_feature: Ceres CLONE 1959039
  misc_feature: SWISSPROT Homolog: EC 2.7.11.1 Non-specific serine/threonine protein kinase
RNILLTADLRAKISGFSLAKPATVDAAATSSDVFAFGLLLLELLSGRRAMEARIGSEIGMLSREIRAVLEAGDKREAKLIKWMDPALGSEYQVDAALSVAGMARACTEEDAARRPKMAEVVFSLSVLVQPLSVGDAFEKLWQPSSEDNIRIAGSVAAR

SEQ ID NO: 35093 - DNA, 601 bp, Panicum virgatum
  misc_feature: Ceres CLONE 1959047
  misc_feature: Encodes the peptide sequence at SEQ ID NO. 35094
ctcgccgcgagggtgacggaaagcgacgcggcgcgagcgcgagaggagggccagggcaagggacgccctagtagacactccgcgccgccgatctccgcgccgccgccgcctcagggctcgagattgtgtcagctttcaagatgtcgatcagcacatttgctactccctgcgtgctgttgagcaatgttagaacacagagctcccagacagcggtgaagagcccttcatctctaaacttcttcagccaaggcatgaaggttccaagcctgaagacctccaagaaactcgatgtctctgcgatggctgtgtacaaggtgaagctcgtcacaccagaaggggtagagcatgagtttgaggctccagatgacacctacatcctcgacgcagctgagaccgccggagtggagttgccatactcatgccgtgctggagcttgctccacctgtgctggcaaaattgaggctggcgaggtcgaccagtcagatgggtccttccttgatgacgggcagcaggctgagggctatgtgctgacatgcgtctcctaccccaagtctgactgtgtcatccacacccacaaggaaggtgacctgtactagggctt

SEQ ID NO: 35094 - protein, 151 aa, Panicum virgatum; identical to SEQ ID NO: 12312
  misc_feature: Ceres CLONE 1959047
  misc_feature (62)..(138): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase

SEQ ID NO: 35095 - DNA, 700 bp, Panicum virgatum
  misc_feature: Ceres CLONE 1959051
  misc_feature: Encodes the peptide sequence at SEQ ID NO. 35096
cccctcatcctagacttcagtcatggccactccagctgcaaccccagctgttactcctgccaagaaggctgacaaactcgccaatcctatgcgtaaactcaagatctccaaacttgtcttgaacatttgtgttggtgaatctggtgataaacttgtccgtgcagccaaagtgctagaacaactcaccagtcaagatggtgtctacggaaaagctagatttacagtgagaaccttcgctattcgaagaaatgagcaaatttctgtgtacacaacagtccgtggaccaaaagcagaagaaattcttaaaaaagctctccgtgttaaagaatttgaactgagggaaaacaatttctcagatactggaaattttggatttggaattgacgaacatatcgatctcggaattaaatatgatcctactattggaatttacggaatggatctctatgttgtccttggtcgacctggtgctcgtattgctctgaaaaaacgaaaagctggccgaattggtaaaaaacacaaggtaaccaaagctgatgcaatcaaatggttccaagaaaaccacgagggtattgttctaccacctctcaaaaaagtttcaagaacccaatacagatccaagaagaagggaggaaagaagccacaaaagaagaagtaaatgtcagtttaattgcaataataataaattgcattatttttc

SEQ ID NO: 35096 - protein, 211 aa, Panicum virgatum
  misc_feature: Ceres CLONE 1959051
  misc_feature (78)..(177): Pfam Name: Ribosomal_L5_C Pfam Description: ribosomal L5P family C-terminus
  misc_feature (21)..(74): Pfam Name: Ribosomal_L5 Pfam Description: Ribosomal protein L5
MATPAATPAVTPAKKADKLANPMRKLKISKLVLNICVGESGDKLVRAAKVLEQLTSQDGVYGKARFTVRTFAIRRNEQISVYTTVRGPKAEEILKKALRVKEFELRENNFSDTGNFGFGIDEHIDLGIKYDPTIGIYGMDLYVVLGRPGARIALKKRKAGRIGKKHKVTKADAIKWFQENHEGIVLPPLKKVSRTQYRSKKKGGKKPQKKK

SEQ ID NO: 35097 - DNA, 655 bp, Panicum virgatum
  misc_feature: Ceres CLONE 1959054
  misc_feature: Encodes the peptide sequence at SEQ ID NO. 35098
gattattccgtagtttttgttagaatgtgtttcaaatcaaggaagaagaaacaaatcgacggactacgtgttaatgttgacgccaacatgccagttttcaagttcctgatggtgggcgatgtaggggttggaaaaagctcgattctggtacggtacgccgacaacaagttttttgaagttgcgccatcctctctgggtgtcgattatagaaatcgtgatatagaccttgcaaacggatcaaaaatccaggctacaatctgggacactgctggtcaagagagatttagaacaattacaagctcgtattacagaggtgcacacggaatggtgctttcttttgatatgagtaacccacaatcattctcaacagtagataaatggctcacagaagtccaaagatacggtgaagattcagccgttgttattgtcgttggaaacaaatctgatatagcttctcccgatggtccttccgatcaacaaatgcaagaatggtgtacaaacaaaaatctaacttttatgaaaacttctgcaaaggacggaactggtacagatcaactttttcaaaaacttgcacaagaagttgtggatgtgtttgtacatacttagccctttgtacaaatcgcatatatattacaaaaaaattctctatgttcca

SEQ ID NO: 35098 - protein, 201 aa, Panicum virgatum
  misc_feature: Ceres CLONE 1959054
  misc_feature (34)..(196): Pfam Name: Ras Pfam Description: Ras family
  misc_feature (34)..(149): Pfam Name: Miro Pfam Description: Miro-like protein
  misc_feature: SWISSPROT Homolog: EC 2.7.11.1 Non-specific serine/threonine protein kinase
DYSVVFVRMCFKSRKKKQIDGLRVNVDANMPVFKFLMVGDVGVGKSSILVRYADNKFFEVAPSSLGVDYRNRDIDLANGSKIQATIWDTAGQERFRTITSSYYRGAHGMVLSFDMSNPQSFSTVDKWLTEVQRYGEDSAVVIVVGNKSDIASPDGPSDQQMQEWCTNKNLTFMKTSAKDGTGTDQLFQKLAQEVVDVFVHT

SEQ ID NO: 35099 - DNA, 648 bp, Panicum virgatum
  misc_feature: Ceres CLONE 1959056
  misc_feature: Encodes the peptide sequence at SEQ ID NO. 35100
atccctatcctctactccgacccctcgccccggccgcgcccgccttcgcatccggcacccccccacctcgccctctccctctcccctctgaacccacgcccgccgccgccaccaccgccgccggcgcgatggccatgcgggtggtgcggaacctggacctggagcggtacgcggggcggtggtacgagatcgcttgcttcccgtcggcattccagcccaagacgggcaccaacacgcgcgccacctacgcgctcaacccggacggcaccgtgcgggtgctcaacgagacgtggaccgacggccgccgcggccacatcgagggcacggcgtggcgcgccgacccggccggcgacgaggccaagctccgggtccgcttcttcgtcccgcccttcctccccgtcttccccgtcaccggcgactactgggtgctccacgtcgacgccgactaccagtacgcgctcgtcggccagccctccaggaagtacctctggatcctgtgcaggcagccgcacatggacgaggccgtgtacggcgagctggtgaggcgggccgaggaggaggggtacgacgtgtcggagctccgcaggacggcgcacccggacccgccgccggagagcgaggagagccccagggacggcgggatgtggt

SEQ ID NO: 35100 - protein, 173 aa, Panicum virgatum
  misc_feature: Ceres CLONE 1959056
  misc_feature (9)..(156): Pfam Name: Lipocalin_2 Pfam Description: Lipocalin-like domain
MAMRVVRNLDLERYAGRWYEIACFPSAFQPKTGTNTRATYALNPDGTVRVLNETWTDGRRGHIEGTAWRADPAGDEAKLRVRFFVPPFLPVFPVTGDYWVLHVDADYQYALVGQPSRKYLWILCRQPHMDEAVYGELVRRAEEEGYDVSELRRTAHPDPPPESEESPRDGGMW

SEQ ID NO: 35101 - DNA, 530 bp, Panicum virgatum
  misc_feature: Ceres CLONE 1959058
  misc_feature: Encodes the peptide sequence at SEQ ID NO. 35102
agaaccaacaactctcaagcccccaccagacccttcaccactcccccttcaacatcaacaacaatgtcgtggcagacgtacgtcgacaccaacctcgtgggcactggcgccgtgactcaggctgccatcctcggcctcgacggtaacacctgggccacctcggccggcttcgccgtgacccccgcgcagggctccaccctcgccagcgccttcaccaacgctgaccccatccgcgcgtccggcttcgatctcgctggcgtccactacgtgaccctccgcgccgacgaccgctccatctacggtaagaagggcgccgctggtgtcatcaccgtcaagacctccaaggccatcctcgtgggcgtctacaacgagaagatccagcccggtaccgccgccaacgtcgtcgagaagctcgccgactacctcatcggccagggcttctaagtgcctgtaaaacaccacctctactataaaaaacataagcgagagagcattcaaaagccccccctactcgctcatatttaatcccc

SEQ ID NO: 35102 - protein, 126 aa, Panicum virgatum
  misc_feature: Ceres CLONE 1959058
  misc_feature (2)..(121): Pfam Name: Profilin Pfam Description: Profilin
MSWQTYVDTNLVGTGAVTQAAILGLDGNTWATSAGFAVTPAQGSTLASAFTNADPIRASGFDLAGVHYVTLRADDRSIYGKKGAAGVITVKTSKAILVGVYNEKIQPGTAANVVEKLADYLIGQGF

SEQ ID NO: 35103 - DNA, 676 bp, Panicum virgatum
  misc_feature: Ceres CLONE 1959060
  misc_feature: Encodes the peptide sequence at SEQ ID NO. 35104
gtaagataaattttggtgttttcccttcaatgcaaggagggccccataataatcatattgctgccctggcaataaccctgaagcaggtagcaactcctgagtataaagcatacattcaacaagtcaagaaaaatgcccaggctttggcatcagccttgctcagaagaaaatgcagattggttactgggggcacagataatcacttagtgctatgggatctcagaactcttggcttgaccggcaagatctttgaaaaggtctgtgaggcatgccacatatctatcaacaagacaccaatttacggggataatggctcgatatcaccaggaggtgttcgaattggaactcctgcaatgactactagaggttgcttagagaatgatttcgagttgattgctgagttcctcatcagggcaactcagattgctagcaatgttctaaaagaacgtgggaaactacaaaaggagtttctacgaggagtacagaacaataaggatgttgtagaactccgtaatcaggtcgaggcatttgcatcacagtttgcgatgccaggttttgatgtatgaatgtgcatatataccacagttgcaattatccagattcatcgctcatcagctacattatcgtccttaagctcacccatactatcagtctcagcttcagaacgaatagcaga

SEQ ID NO: 35104 - protein, 187 aa, Panicum virgatum
  misc_feature: Ceres CLONE 1959060
  misc_feature (1)..(135): Pfam Name: SHMT Pfam Description: Serine hydroxymethyltransferase
  misc_feature: SWISSPROT Homolog: EC 2.1.2.1 Glycine hydroxymethyltransferase
KINFGVFPSMQGGPHNNHIAALAITLKQVATPEYKAYIQQVKKNAQALASALLRRKCRLVTGGTDNHLVLWDLRTLGLTGKIFEKVCEACHISINKTPIYGDNGSISPGGVRIGTPAMTTRGCLENDFELIAEFLIRATQIASNVLKERGKLQKEFLRGVQNNKDVVELRNQVEAFASQFAMPGFDV

SEQ ID NO: 35105 - DNA, 600 bp, Panicum virgatum
  misc_feature: Ceres CLONE 1959065
  misc_feature: Encodes the peptide sequence at SEQ ID NO. 35106
  misc_feature (518)..(518): n is a, c, t, g, unknown, or other
gcgggagagagtgaaaggccaacgagtcggccaggacctccacgtccagctccagctccatgggtccgattccgatccttgaggcgaggagctgaggccgggaggaggagctgctggccgggaccgggaggggtaccaatcgtagcactgctcagcggcagccatgagctggagacgaggcggaggaggggatggaggcgtctccaggaggtgggccttcctgctctgcgtcgggagcttctgcctcggcctgctcttcaccaacagaatgtggacgctgcctgaggcaagcgagattgctagaccaaatgcaaatgtagaggaaagcaacatgccagttgctgcagagtgcggttctaaaaagatccaagaaaaacaagattacagggatattttacaagttcaagatgctcatcatgatgtgcagtcactagacaagacgatagcaagcttagagacagagctctcagctgcaagatctctgcaagagtccttgctcaatggttcccctgttgcanaagacttcaaagtttctgaatcgattgggagaagaaagtaccttatggtaatagggatcaacaccgcatttagcagccgcaa

SEQ ID NO: 35106 - protein, 145 aa, Panicum virgatum
  misc_feature: Ceres CLONE 1959065
  misc_feature: Functional homolog of the protein sequence given in SEQ ID NO 51473
  misc_feature: Useful for making plants with altered carbohydrate content
  misc_feature (119)..(119): Xaa is any aa, unknown, or other
MSWRRGGGGDGGVSRRWAFLLCVGSFCLGLLFTNRMWTLPEASEIARPNANVEESNMPVAAECGSKKIQEKQDYRDILQVQDAHHDVQSLDKTIASLETELSAARSLQESLLNGSPVAXDFKVSESIGRRKYLMVIGINTAFSSR

SEQ ID NO: 35107 - DNA, 870 bp, Panicum virgatum
  misc_feature: Ceres CLONE 1959071
  misc_feature: Encodes the peptide sequence at SEQ ID NO. 35108
acaaccccaacccaaaaaccttccactctctcttctcgtctcatcttctgcatctccaatcaaggtacaaagcagcacacggagatagccatggtgactagagctctcctcgtcctcaccgtggccgtcgcggcggtgctcgggacagcgcacggggccagctacaccgtcggtgctccggcggggtcgtgggatctccggaccaactacaccagctgggcatccggcatcaacttccgtgctggcgaccagcttgtgttcaagtactcccccgcggcgcacgacgtgctggaggtgagcaaggcggaccacgactcgtgcaccgcctccaggcccctcgccaccttcgccaccggcgacgacaccgtcccgctccccgccggcggcgtcacccgatacttcatctgcggcgtccccggccactgcgccggcggcatgaagctcgccgtcagagtcgaggccgccagcgctccagcgccggtggccatgcccccccgtgctgcgcgcccgccgactgcgtctccgtccccggcgccgatggccgtgccccctcgcgctgggcgtccgccagctgcagctccgcctgctccagcgccactgggcatggcccctgctgtgccgccgccgatggtgacgccaggcgccaaggccccggcggccgccggtggcatgccggccgtgcctcctccgagctctgcggcggccccggctggtgttgggtctctagtggggcttggattgggtgctgccgtggctgctctcatggtcttccattagagtcaacggctgcctttttttttgtaatttattactcacgtgtgtactcaatttttactctatgatattgatatgtacgtaacaactgaggtc

SEQ ID NO: 35108 - protein, 228 aa, Panicum virgatum
  misc_feature: Ceres CLONE 1959071
  misc_feature (34)..(116): Pfam Name: Cu_bind_like Pfam Description: Plastocyanin-like domain
MVTRALLVLTVAVAAVLGTAHGASYTVGAPAGSWDLRTNYTSWASGINFRAGDQLVFKYSPAAHDVLEVSKADHDSCTASRPLATFATGDDTVPLPAGGVTRYFICGVPGHCAGGMKLAVRVEAASAPAPVAMPPRAARPPTASPSPAPMAVPPRAGRPPAAAPPAPAPLGMAPAVPPPMVTPGAKAPAAAGGMPAVPPPSSAAAPAGVGSLVGLGLGAAVAALMVFH

SEQ ID NO: 35109 - DNA, 535 bp, Panicum virgatum
  misc_feature: Ceres CLONE 1959079
  misc_feature: Encodes the peptide sequence at SEQ ID NO. 35110
gcttctgcctcctctctcacacacgacttgctcccgccgccgccgccgccgacgacatagaagaagtcaccgtgaccagcaaccggacaaagtatggatacccaggttaagattgctgttgtggtgaaagtgatgggccgcactggctccaggggtcaggtgacccaggtcaaggtgaagttcctggacgaccacaaccgtctcatcatgaggaacgtcaagggccctgtccgtgagggtgacatcctcaccctcctcgagtctgagagggaggccaggaggctgcgctgaagcagctggtggttgcgccagttgttggccattcctgttttaaacaagttaaatgatgaattgaatccccccttgcctagtgtactgctttcgtatcaagttattgaacaatgctactttgtcctttgagtaggctatggagaatgggcttaagcaatggaattgtaatttgagtactcgtcttgttgcaagttttggtctgttattgcctgaatgaatttaagtgcacttgatgatgtgtgac

SEQ ID NO: 35110 - protein, 65 aa, Panicum virgatum
  misc_feature: Ceres CLONE 1959079
  misc_feature (1)..(65): Pfam Name: Ribosomal_S28e Pfam Description: Ribosomal protein S28e
MDTQVKIAVVVKVMGRTGSRGQVTQVKVKFLDDHNRLIMRNVKGPVREGDILTLLESEREARRLR

SEQ ID NO: 35111 - DNA, 459 bp, Panicum virgatum
  misc_feature: Ceres CLONE 1959095
  misc_feature: Encodes the peptide sequence at SEQ ID NO. 35112
cccgtggaggacgccgaggaagaagaggccgggaggaggagagggacctgcgggaggcgttcgacgtcttcgacggcaacaaggacgggctcatctccgctgaggagctcggcaccgtgctgggctccctcggcctgcgccgcgccggcgccggcaggcccgccgtcgccgagtgccgcgacatgatacgcctcgtcgacagcgacggcgacggcatggtcagcttcgaggagttcaagcgcatgatgaccgtcgtcaaggcctaagctcctcctcttctcctcacagatcaaatacggagtataaccaaaacctggagcggatttatttgcaaaggcaagtaacgttattttgttcttggatcggaacagtttcatcgtgttgttagtagaagcgcgatcaattaacaccaggagctcgtatttgtttatggggagttgaaagctggatcgagtagct

SEQ ID NO: 35112 - protein, 87 aa, Panicum virgatum
  misc_feature: Ceres CLONE 1959095
  misc_feature (57)..(85): Pfam Name: efhand Pfam Description: EF hand
  misc_feature (15)..(43): Pfam Name: efhand Pfam Description: EF hand
RGGRRGRRGREEERDLREAFDVFDGNKDGLISAEELGTVLGSLGLRRAGAGRPAVAECRDMIRLVDSDGDGMVSFEEFKRMMTVVKA

SEQ ID NO: 35113 - DNA, 640 bp, Panicum virgatum
  misc_feature: Ceres CLONE 1959096
  misc_feature: Encodes the peptide sequence at SEQ ID NO. 35114
ggcactcccccctcgtctcgctccctcccttcccaaatcctccttgtcctctgcaatcgccaaggccaggcccgccgcgcagagtggactgactggtcactgtagctcgatcgatcggatcatcggaggcaggcatggcgtccgggaagcacttcaagtacgtcatcctcggcggcggcgtcgcggcggggtacgcggcccgggagttcgccaagcagggagttcagccaggggagctcgccatcatctccaaggaggcggtggcaccatacgagcgtcctgccctcagcaagggttacctcttccctcagaatgctgcaaggctcccaggattttatgtatgtgtcggaagtggtggagagaggctattgcctgaatggtactcagagaaaggtggaatcaagactgatgctttcttcgaaacaagtgttcctggagtatatgctattggcgatgttgctaccttccccttgaagatgtacaatgagttgaggagagtagaacacgttgaccatgctaggaagtctgcagagcaggctgtaaaggcaatcaagggaaaggagtccggggaatcagttccagagtacgactacctgccgtacttctactcccgatctttcgacctggggtggcagttcta

SEQ ID NO: 35114 - protein, 168 aa, Panicum virgatum
  misc_feature: Ceres CLONE 1959096
  misc_feature (8)..(113): Pfam Name: Pyr_redox_2 Pfam Description: Pyridine nucleotide-disulphide oxidoreductase
  misc_feature (5)..(87): SWISSPROT Homolog: EC 1.6.5.4 Monodehydroascorbate reductase (NADH)
  misc_feature (69)..(149): SWISSPROT Homolog: EC 1.18.1.3 Ferredoxin--NAD(+) reductase
MASGKHFKYVILGGGVAAGYAAREFAKQGVQPGELAIISKEAVAPYERPALSKGYLFPQNAARLPGFYVCVGSGGERLLPEWYSEKGGIKTDAFFETSVPGVYAIGDVATFPLKMYNELRRVEHVDHARKSAEQAVKAIKGKESGESVPEYDYLPYFYSRSFDLGWQF

SEQ ID NO: 35115 - DNA, 636 bp, Panicum virgatum
  misc_feature: Ceres CLONE 1959103
  misc_feature: Encodes the peptide sequence at SEQ ID NO. 35116
ggtggagctggtggacgggtcgtcctacctggggcagccgctgcccttctccatctcgacgctcatctggatcgaggtgctggtgatcgggtacatcgagttccgcaacgcggagctggacccggagaagaggctctacccggggggctcctacttcgacccgctcggcctgtcggccgacccggagaagaaggagcggctgcagctggcggagatcaagcacgcgcgcctcgccatggtcgccttcctcggcttcgccgtgcaggccgccgccaccggcaagggcccgctcaacaactgggccacccacctcagtgacccgctgcacaccaccatcttcgacacgttcggagcaggatcctcttaagcccgcccgcccgccgccattgctagctccgtccatcgatccaagccttgagttaactgtgatctcggtctcggctatcatacgctggagacgatggatgtgaatccgtccgtggtatcattttgtgatgagtgagagggtgtgggaagatccatcctatcctttgttaatggaggacttgttgattaggagaaccgctgctagctgctgggacttggtgatttgtaatatatgaaccagtgatgatgaattaatgcattcacttgtac

SEQ ID NO: 35116 - protein, 121 aa, Panicum virgatum
  misc_feature: Ceres CLONE 1959103
  misc_feature (1)..(90): Pfam Name: Chloroa_b-bind Pfam Description: Chlorophyll A-B binding protein
  misc_feature: Functional homolog of the protein sequence given in SEQ ID NO 50114
  misc_feature: Useful for making plants with modulated water use efficiency
  misc_feature: Functional homolog of the protein sequence given in SEQ ID NO 50115
  misc_feature: Useful for making plants with modulated biomass
  misc_feature: Useful for making plants with modulated drought sensitivity
  misc_feature: Useful for making plants with modulated phosphate use efficiency
VELVDGSSYLGQPLPFSISTLIWIEVLVIGYIEFRNAELDPEKRLYPGGSYFDPLGLSADPEKKERLQLAEIKHARLAMVAFLGFAVQAAATGKGPLNNWATHLSDPLHTTIFDTFGAGSS

SEQ ID NO: 35117 - DNA, 496 bp, Panicum virgatum
  misc_feature: Ceres CLONE 1959104
  misc_feature: Encodes the peptide sequence at SEQ ID NO. 35118
tggaaagagtctcagagagtgcaaccgattatagttgatgccggaatatatttggcagggaggaatcagttcttccaagccacagagaaacgggatactccagatggtttcaaatttttcacaggttctccatgggtcattttaaacagacgcttcatcgagtattgtgtttttggttgggataatctccctagaacactcctcatgtacttcacaaacgtgatgctacctctggaggggtatttccactcagttgcatgcaactctgacttccgaaatttcacagtgaacaacgacttgcggtatatggtgtgggatgatcctcctcagatggaaccccatttcctaaatgttacacattatgatgagctagtggggagtggagttccttttgcccggaagtttaaggagaatgaacccctgttggacaagattgatgataaaatacttcgacgttggcatcacagacctgttcctggtgcctggtgcacaggca

SEQ ID NO: 35118 - protein, 165 aa, Panicum virgatum
  misc_feature: Ceres CLONE 1959104
  misc_feature: SWISSPROT Homolog: EC 2.4.2.26 Protein xylosyltransferase
  misc_feature: Functional homolog of the protein sequence given in SEQ ID NO 50636
  misc_feature: Useful for making plants with altered carbohydrate content
WKESQRVQPIIVDAGIYLAGRNQFFQATEKRDTPDGFKFFTGSPWVILNRRFIEYCVFGWDNLPRTLLMYFTNVMLPLEGYFHSVACNSDFRNFTVNNDLRYMVWDDPPQMEPHFLNVTHYDELVGSGVPFARKFKENEPLLDKIDDKILRRWHHRPVPGAWCTG

SEQ ID NO: 35119 - DNA, 593 bp, Panicum virgatum
  misc_feature: Ceres CLONE 1959128
  misc_feature: Encodes the peptide sequence at SEQ ID NO. 35120
gcgcacaatactcaagcctagatcgacacacgcagaccaatggcggaggctgctgccggcagggacaagatcacggacgccaccgcggccctgttcgccgactccgccaagatccccgagaggttcatccgaaccaacgaggtccaggcggccggcacggtcgtcgtcggcgagggcgaggcgtcctccgagctgccggtggtggacatggcgcgcctccttgatccggaactgtcggcgcaagagacggcgaagctcggctccgcgtgcagagagcggggtttcttccaactcctgaaccatggggtcgaggaagcggcggtgcaacaaatcaaggacagcgtcccgcagttcttcagcttgccgctggaggccaagaacaccgtggcggtcccagaaagagacgggttccaaggattccgccaccacttcagcggacgagcctcgactgataagctggactgggcggagtgtctactcctcttcacgcggccggtccaaatcaagaacatggattccttctggccgacgaacccacccacattcaggcacgcgctcgacaagtactcggtggagatcgagaatctcacaag

SEQ ID NO: 35120 - protein, 184 aa, Panicum virgatum
  misc_feature: Ceres CLONE 1959128
  misc_feature: SWISSPROT Homolog: EC 1.14.11.9 Flavanone 3-dioxygenase
MAEAAAGRDKITDATAALFADSAKIPERFIRTNEVQAAGTVVVGEGEASSELPVVDMARLLDPELSAQETAKLGSACRERGFFQLLNHGVEEAAVQQIKDSVPQFFSLPLEAKNTVAVPERDGFQGFRHHFSGRASTDKLDWAECLLLFTRPVQIKNMDSFWPTNPPTFRHALDKYSVEIENLT

SEQ ID NO: 35121 - DNA, 352 bp, Panicum virgatum
  misc_feature: Ceres CLONE 1959134
  misc_feature: Encodes the peptide sequence at SEQ ID NO. 35122
aactatccctactcctacaggcactgaaatacctcccagtcctctccatgaatgcggtgcaggaaatggacagcgcgaccagcctctggttggacgacacccgtggtggcggtgcgtgctcggactatatcaaggccctggccgccgcggcccctgagggggcgagtctgtagagcatgggccgcggagccagggctgtcgtggactcggccaatactggtcgccgaggcggactcgggtcacatcggctctggcgtgggtctgggcggtaaactggcgtcttacagatacaaaggtgtggtgtcgcatccctccgggcggtggggcgctcatatatacgatcgcggccggc

SEQ ID NO: 35122 - protein, 41 aa, Panicum virgatum
  misc_feature: Ceres CLONE 1959134
  misc_feature: The sequence is a functional homolog of SEQ ID NO 36 in the 10/838,616 US patent application
  misc_feature: The sequence is a functional homolog of SEQ ID NO 738 in the 11/435,388 US patent application
  misc_feature: The sequence is a functional homolog of SEQ ID NO 1178 in the 10/374,780 US patent application
  misc_feature: The sequence is a functional homolog of SEQ ID NO 1374 in the 10/412,699 US patent application
  misc_feature: The sequence is a functional homolog of SEQ ID NO 53 in the 10/838,616 US patent application
  misc_feature: The sequence is a functional homolog of SEQ ID NO 1186 in the 10/374,780 US patent application
MNAVQEMDSATSLWLDDTRGGGACSDYIKALAAAAPEGASL

SEQ ID NO: 35123 - DNA, 623 bp, Panicum virgatum
  misc_feature: Ceres CLONE 1959145
  misc_feature: Encodes the peptide sequence at SEQ ID NO. 35124
acacttcaactttacttctcccactccaaatacaaagtcttgagaaggcaacattctaagttcagcattcaaaaaaccagcacagattgcccatcatgccttacaacaagaagcggcagattgagcccgagagcgatggtgagcagcaggtcgtcaaaaagtccaagagcgagaaggcggccaagaaggacctcacccagggcaaagatgcagagggcaacccatactgggagatcggcaacaaccggcgcataggctgctccaagttcaagggtgccaccttggttaacatccgcgagtactacactgcaccagacggggagctgaggccaggcaaaaagggcatctccctctcactggaacaatacaaggccctcctcaaggtcatcccacagctgaaccaggagcttctctcgcaaggacatgccctgccggttgccgagacaagtggcgcgctggtgaaggccgagaagccaaaggccaagaagtcgacgaagtccaacatcgacgtgaccagcgaagaggaggaggaggaggaggcagaggatgacgacgaggagtgacgagaaacgacctccacatgcggtgctttttttctagccatctttacgcctgatttctgg

SEQ ID NO: 35124 - protein, 155 aa, Panicum virgatum
  misc_feature: Ceres CLONE 1959145
  misc_feature (12)..(105): Pfam Name: PC4 Pfam Description: Transcriptional Coactivator p15 (PC4)
MPYNKKRQIEPESDGEQQVVKKSKSEKAAKKDLTQGKDAEGNPYWEIGNNRRIGCSKFKGATLVNIREYYTAPDGELRPGKKGISLSLEQYKALLKVIPQLNQELLSQGHALPVAETSGALVKAEKPKAKKSTKSNIDVTSEEEEEEEAEDDDEE

SEQ ID NO: 35125 - DNA, 612 bp, Panicum virgatum
  misc_feature: Ceres CLONE 1959150
  misc_feature: Encodes the peptide sequence at SEQ ID NO. 35126
acagctgagccatggacgccgctgccgccgccgccgccgccacggccgccggcgacgaggagcaggaccaggcgcggatggacgccatcgccgacgtcctacagacccgagacgcgatgcggctgtacaactggctcacgcagcgctgcttctccgactgcgtcgtctccttctaccgccgggcgctcggcaagcgcgaggaggagtgcgtccgctcctgcgtccgcaagtaccagctcttatccaccgcgtccgccgcgcgcttcgcccacttcgccgaccccaacaactcctctccggcagcattcgacgattgattcaccgctgctcttgcccgtcgacgcctctgtacgatcccagttcgttgtcctcttcttgcctgccggctgccggcccgctactttgtttgcttcagttcttcagtctagcttagcttttgctttgtgatctcaaggaaactgaaacacgacggcataatacgagagtagcatttactattgttgacgccgaaattttcattagaaattggaaggccaagaccaagagtgactgatttgtaccacacaaaaaaagtttggaattttgatgaatgaatcgatggatggattcttc

SEQ ID NO: 35126 - protein, 101 aa, Panicum virgatum
  misc_feature: Ceres CLONE 1959150
  misc_feature (23)..(84): Pfam Name: zf-Tim10_DDP Pfam Description: Tim10/DDP family zinc finger
MDAAAAAAAATAAGDEEQDQARMDAIADVLQTRDAMRLYNWLTQRCFSDCVVSFYRRALGKREEECVRSCVRKYQLLSTASAARFAHFADPNNSSPAAFDD

SEQ ID NO: 35127 - DNA, 456 bp, Panicum virgatum
  misc_feature: Ceres CLONE 1959162
  misc_feature: Encodes the peptide sequence at SEQ ID NO. 35128
ggcagagcaagcgaccgcagcactgcagcagcagctgtagcttgtacgtgcacaagcagctcgcccggtcgcgatggcagctagagcggcgctcctcctggctgtgggcctggtcctggccgccgtggcgaacgcgaccaactgcccgcccccgccggccccgacgccgccgacgccgacgcccagcggcggccaccactgccccagggacgcgctgaagctgggcgtgtgcgccaacgtgctgggcctcgtcaaggccaaaattggctcgccgccgtacctgccctgctgctcgctgctggacgggctcgtcgacctggaggccgccatctgcctctgcactgccatcaaggccaacatcctcggcatcaacctcaacctccccatcgacctcagcctcatcctcaacaactgcggcaagagctgccccaacgacttccactgcgcatagatcgt

SEQ ID NO: 35128 - protein, 125 aa, Panicum virgatum
  misc_feature: Ceres CLONE 1959162
  misc_feature (43)..(124): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
  misc_feature: Functional homolog of the protein sequence given in SEQ ID NO 50545
  misc_feature: Useful for making plants with modulated oxidative stress sensitivity
  misc_feature: Functional homolog of the protein sequence given in SEQ ID NO 50191
  misc_feature: Useful for making plants with modulated salt sensitivity
MAARAALLLAVGLVLAAVANATNCPPPPAPTPPTPTPSGGHHCPRDALKLGVCANVLGLVKAKIGSPPYLPCCSLLDGLVDLEAAICLCTAIKANILGINLNLPIDLSLILNNCGKSCPNDFHCA

SEQ ID NO: 35129 - DNA, 669 bp, Panicum virgatum
  misc_feature: Ceres CLONE 1959168
  misc_feature: Encodes the peptide sequence at SEQ ID NO. 35130
cacccacccttcgcctgccaacccatttctcccgagccccgacgcgcgctgcctgctccctcgccgccgccgccgcctctccagctcggaccccatggcttccctcgccggatccgccctctccctcgcgatgcccgtcaaggcaatcaacattaagtccgtctctttctctggtttaaggaaagataatgtaacattctgtcttcagccagtgccacaaagatttgcagtctgctgtcccgctaaaaaggagacagtggaccaggtttgtgatattgtcaagaagcagcttgcacttgctgatggcactgaagtttgtggctcctccaagttccaagatcttggtgctgattcgttggacactgttgagattgttatgggcctcgaggaagcttttgggatcagtgtggaggagtcgagcgcgcagtcaattgcaaccgtggaagatgctgctaatctcatcgatgaccttgttgctgcaaaatcgtcctaaacttgcagctgtagtacttatcctggccctgaactaaggcatctcttgtcccatgctccttccctgctagattttaccctggagagccatttctttgtcattactatcattgtggatcttgcaatattattacattgaagcgtttgtgttcaaggaaagttttgttgcgactatat

SEQ ID NO: 35130 - protein, 132 aa, Panicum virgatum
  misc_feature: Ceres CLONE 1959168
  misc_feature (56)..(123): Pfam Name: PP-binding Pfam Description: Phosphopantetheine attachment site
MASLAGSALSLAMPVKAINIKSVSFSGLRKDNVTFCLQPVPQRFAVCCPAKKETVDQVCDIVKKQLALADGTEVCGSSKFQDLGADSLDTVEIVMGLEEAFGISVEESSAQSIATVEDAANLIDDLVAAKSS

SEQ ID NO: 35131 - DNA, 686 bp, Panicum virgatum
  misc_feature: Ceres CLONE 1959199
  misc_feature: Encodes the peptide sequence at SEQ ID NO. 35132
agcgtctgccccaacctgcacgagctctcgtctccggcggcggaagcggaaggaagcaggcggccaccatggtgaagggacgcacggggcagcgcgtcaggctctacgtccggggcactatcctcggatacaagaggtctaagtcgaaccagtacgagaacacgtcgctggtgcagatcgagggggtgaacaccaaggaggacgtcgcgtggtacgccggcaagcgcttggcgtacatctacaaggccaagaccaagagcagcgagacccgctacaggtgcatctggggcaaggtcacccgcccgcacggcaactccggcgtcgtccgcgccaagttcaagtccaacctcccgccggagtccatgggacgcaaggtcagagtgttcatgtacccgagcagcatctaaggttttgttggagctgaaaattccatgttttggtgaaccactgctgtgttggcaacttagtttgttcatgtactgagaacatgtgtaagttttgccaaaatttattgtctaaaggatgaaccattatcgtaatgttatgccagcaccagagcttattttcagcatcagatgccttgccatttttttttattatcttcaatttcctacggaaatattttccctgtggtcagtttgccatgttcatgctccataatatatattatgtatcaaataacgtgc

SEQ ID NO: 35132 - protein, 112 aa, Panicum virgatum; identical to SEQ ID NO: 14629
  misc_feature: Ceres CLONE 1959199
  misc_feature (12)..(106): Pfam Name: Ribosomal_L35Ae Pfam Description: Ribosomal protein L35Ae

SEQ ID NO: 35133 - DNA, 1076 bp, Panicum virgatum
  misc_feature: Ceres CLONE 1959203
  misc_feature: Encodes the peptide sequence at SEQ ID NO. 35134
atctcaattcgcattcgtgtaaccaaagccgacagagagacatggcgaccggcggcgctctccccatggtggatctggcgcctttcttcacccaagacgacagcgacggcgtcgcccgcgccaccgaggccgtgcgcgaggcgtgcctgacgcacggcttcttccgcgtcgtcaaccacggcgtgccggccgagctcatggcgcgcgcgctcgagctgtcgcccgtgttcttcgcgctgccggacgacgagaaggccaaggcccggcaggccgaggggaccgcggcgcccttccgggctggctactttcgggcgccggtgccggcgcactcgcccgacaagcacgagttcgtgctggtgtttgatccgaagctcgggttcaatgagtaccccgctgagccagccggattcagagaagcagtggaggagtgttacgccaagttgaccgagctggggctgctcctccaggacgtcctgaacgagtgcatgggtctgccgccgggcttcctcaggggctacaacggcgaccgcagcttcgacttcatggcggtgcatcactacttcccggggacggaggaggagaacagcgggctywasgcgcacgaggacggcagctgcatcagcttcgtcatccaggacggcgccgggggccttgacgtcctcaaggacggtgactgggtcccggcggagcctgtcgagggcagcatcatcgtcaacatcggcgacctcataaaggtgctgagcaacaacaagtttaagagcccgacgcaccgggtggtgaggaagccggtgcacaggcacgcgttcgccttcttcttcaacatgcacggcgacaaaagggtcgagccgctgccggagttcacgacgaagatcagcaaggcgccacgctacagggggttcctgctcgacaagtacctgcaaatgcggaggagtggcctgatccatccaccgaccaagcccgaggacgtcgtccccaacgagatcaaaatcacccactatgcaatctagcctgaaaaatcgatcggaatcaatcgcagaaatgtataagagctgcacgccggtctgctacatcaattc

SEQ ID NO: 35134 - protein, 321 aa, Panicum virgatum
  misc_feature: Ceres CLONE 1959203
  misc_feature (165)..(261): Pfam Name: 2OG-FeII_Oxy Pfam Description: 2OG-Fe(II) oxygenase superfamily
  misc_feature: SWISSPROT Homolog: EC 1.14.17.4 Aminocyclopropanecarboxylate oxidase
  misc_feature (185)..(185): Xaa is any aa, unknown, or other
MATGGALPMVDLAPFFTQDDSDGVARATEAVREACLTHGFFRVVNHGVPAELMARALELSPVFFALPDDEKAKARQAEGTAAPFRAGYFRAPVPAHSPDKHEFVLVFDPKLGFNEYPAEPAGFREAVEECYAKLTELGLLLQDVLNECMGLPPGFLRGYNGDRSFDFMAVHHYFPGTEEENSGLXAHEDGSCISFVIQDGAGGLDVLKDGDWVPAEPVEGSIIVNIGDLIKVLSNNKFKSPTHRVVRKPVHRHAFAFFFNMHGDKRVEPLPEFTTKISKAPRYRGFLLDKYLQMRRSGLIHPPTKPEDVVPNEIKITHYAI

SEQ ID NO: 35135 - DNA, 644 bp, Panicum virgatum
  misc_feature: Ceres CLONE 1959207
  misc_feature: Encodes the peptide sequence at SEQ ID NO. 35136
aatgtacacgaaatatctccaagccccctgtactctcctcccccttctcgcacggccctcctcgcttctcccttccctctccccgcgccgccgcccgccgccgcagcctcccacctcgccgtgcccaggatgtggggcagcaccgacggcggcactccggaggttaccctcgagacctccatgggcgccataacagtcgagatgtactataagcacgcacccaagacctgccggaacttcgtcgagctcgcgcggcgaggctactacgacaacgtcatcttccaccgcatcatcaaggatttcattgtgcaaggtggggatcctacgggaaccggcagaggtggtgagtccatctacggagcaaagtttgaggatgagataaagtcagagttgaagcacactggagctggaattctgtccatggcaaatgctggtccaaatacaaatggaagccagttcttcataactctcgcaccttgtcagtctcttgatggaaagcatacaatttttgggagggtatgcagaggaatggaaatcgttaagcgccttggaagtgtgcagaccgacaaaaatgacaggcccatccatgaagtaaaaatccttcgagccatcgtcaaagattgagttgaagcatcacgtgccga

SEQ ID NO: 35136 - protein, 164 aa, Panicum virgatum; identical to SEQ ID NO: 12518
  misc_feature: Ceres CLONE 1959207
  misc_feature (11)..(163): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase

SEQ ID NO: 35137 - DNA, 759 bp, Panicum virgatum
  misc_feature: Ceres CLONE 1959213
  misc_feature: Encodes the peptide sequence at SEQ ID NO. 35138
tctaatggtggagcgtatgctcagggaggtggtcaaggtggtggaggaggaggtggacaaaatggtggctctggctctggttctggttccgggtatggtcaagcaggtgggtatgggccctatggcggagggtacgcgcagggtagtggtcaaggtggaggtggtggcggtggacaaaatggtggttctggaagtggatctggttctggttctgggtatggtcaagccggtggctatggcccgtatggtggtgggtatgctcaagcaggtggccaaggtggtggtggaggtggtggacagtacggtggttctggacaaggttccggttccggttcaggttatggccaagctggtggatatggaccttatggtggtggatatgctcaggctggtggtcaaggcggtggtgggcaaagtggtccaggtggcagcggatatgggaatggctcaggaagtggttctggatctgctggtagtggcactggacacccataaaactttaaagttattatagaagtgcagtttgttgccgcatacttacccgcctgtactatggttcatgtgtagatgtgttgtatactcatataaggaataattggccattccatggattctgtaataattgtagcacgtggcattgtactacaatatataccaatatatatgccatgtaagtgttaatctttttgcattgtgttttcctcattgtctctatacatcaatgtttgtaattcaatatatatacatatgtttttttat

SEQ ID NO: 35138 - protein, 164 aa, Panicum virgatum
  misc_feature: Ceres CLONE 1959213
  misc_feature: Functional homolog of the protein sequence given in SEQ ID NO 50178
  misc_feature: Useful for making plants with modulated nitrogen use efficiency
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50142
  misc_feature: Useful for making plants with altered lignin content
  misc_feature: Functional homolog of the protein sequence given in SEQ ID NO 50144
  misc_feature: Useful for making plants with altered terpenoid content
SNGGAYAQGGGQGGGGGGGQNGGSGSGSGSGYGQAGGYGPYGGGYAQGSGQGGGGGGGQNGGSGSGSGSGSGYGQAGGYGPYGGGYAQAGGQGGGGGGGQYGGSGQGSGSGSGYGQAGGYGPYGGGYAQAGGQGGGGQSGPGGSGYGNGSGSGSGSAGSGTGHP

SEQ ID NO: 35139 - DNA, 1097 bp, Panicum virgatum
  misc_feature: Ceres CLONE 1959215
  misc_feature: Encodes the peptide sequence at SEQ ID NO. 35140
aaaacctcacctcgccaccgccgtgtagcgccgcgcccccgtcaagagttcgccgccgccgcccctcgccgcccgccgcgccgccggcggcacctagccatgacgacacgcatcgcgccgggcgtgggcgcgaacctgctcgggcagcactcggcagagcgcaaccaggacgccaccacctacgtcggcaacctcgacccgcaggtttctgaggagctactatgggaattgtttgtccaagcgggccctgttgttaacgtgtatgtcccaaaagacagagttacaaatctgcaccagggatatggatttgtagaattcagaagcgaggaagatgcagattatgccattaagattttgagcatgatcaaactatacggaaagcccataagagtaaacaaggcttcccaggataagaaaagcttggatgttggagcaaatctttttattggcaatcttgatccagatgttgatgagaagctcctctacgataccttcagtgcatttggagtgattgtcactaatcctaagataatgcgagaccctgaaactggaaattctcgaggttttggcttcgtgagctatgactccttckagtcatctgatcaagctatagaggccatgaacaaccaacatttatgcaaccggccaatcactgtctcttatgcttataagaaagacacaaagggagagcgccatggtacaccagcagagcgattgctggcagcaaacaacccaggatctcagaggaataggccacacacaatgtttgcaagtggtccaccaacccaaggactggcaaatggcggtccaccagtgccacggccctatggcaatggcacagttccaggacagattcaacacattcggccaccgccaccaggacctgttggacaattccctcctccgatgcagatgcacgggcagcctgcttggcctgctcctccacacagtgcgccaccccccatggcacaacagctccagtacaggcttccagtgaggccacctccaccaaacatgatgcctcctccggttggcatggtaaggccgccgccacctcccgctggtatgtctgcaccgcctatgtggatgccacctac

SEQ ID NO: 35140 - protein, 332 aa, Panicum virgatum
  misc_feature: Ceres CLONE 1959215
  misc_feature (114)..(186): Pfam Name: RRM_1 Pfam Description: RNA recognition motif. (a.k.a. RRM, RBD, or RNP domain)
  misc_feature (27)..(98): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (165)..(165): Xaa is any aa, unknown, or other
MTTRIAPGVGANLLGQHSAERNQDATTYVGNLDPQVSEELLWELFVQAGPVVNVYVPKDRVTNLHQGYGFVEFRSEEDADYAIKILSMIKLYGKPIRVNKASQDKKSLDVGANLFIGNLDPDVDEKLLYDTFSAFGVIVTNPKIMRDPETGNSRGFGFVSYDSFXSSDQAIEAMNNQHLCNRPITVSYAYKKDTKGERHGTPAERLLAANNPGSQRNRPHTMFASGPPTQGLANGGPPVPRPYGNGTVPGQIQHIRPPPPGPVGQFPPPMQMHGQPAWPAPPHSAPPPMAQQLQYRLPVRPPPPNMMPPPVGMVRPPPPPAGMSAPPMWMPP

SEQ ID NO: 35141 - DNA, 587 bp, Panicum virgatum
  misc_feature: Ceres CLONE 1959221
  misc_feature: Encodes the peptide sequence at SEQ ID NO. 35142
aagagcccaaaacagcaagcggtgtccattgatctatctcgtcctcatgtctcccccctttcactttcccaattccaccgacctaccttttagtttttcttctctcctctctactcgattgagccatgggacaaggtggatctcgtatggtgagcgacgaggcaaggcggagtgatggctccgggggtccggggaagaagctgcagtccaccacaggcgagaactgcggaggcgccgaggagtgtagatcaatccgccgctgccaatccttcaagactcttccggagtccgatccggatcgggctgccgccatggccgacgagaggaaggcgaagggtaatgcggcgttcttggccggatgcttcgaggaggcggcgttaacagtcgccatcgcgctagcacccaataaccacatcctctactccaaccgctcggcggcgcgcgcctcactccaccgctatgccgacgcgctcgccgatgcgcagaagaccatcgagctcaggcccgactgggccgagggctactctcggctcggcacggcgcacctcggactcggcgccgccaccatcgctgtcgctgcctacgcg

SEQ ID NO: 35142 - protein, 153 aa, Panicum virgatum
  misc_feature: Ceres CLONE 1959221
  misc_feature: SWISSPROT Homolog: EC 3.1.3.16 Phosphoprotein phosphatase
MGQGGSRMVSDEARRSDGSGGPGKKLQSTTGENCGGAEECRSIRRCQSFKTLPESDPDRAAAMADERKAKGNAAFLAGCFEEAALTVAIALAPNNHILYSNRSAARASLHRYADALADAQKTIELRPDWAEGYSRLGTAHLGLGAATIAVAAY

SEQ ID NO: 35143 - DNA, 639 bp, Panicum virgatum
  misc_feature: Ceres CLONE 1959221-R
  misc_feature: Encodes the peptide sequence at SEQ ID NO. 35144
ggaagggccttttgcttgagcccgataacgagggcctcaaggtcgggctcgaggacgccaagaaggagcggaaggagatgaaagcagctgcacaggaggcagggaatgcagcttacaagaaggactgtgagacggcgatccagcattacatgaaagccatggaacttggtgacgaggatatttcctatcttactaaccgcgcagcggtcgactttgagacgggaaagtacgatgaatgcattaaggactgcgataaggctgtggagaggggaagagaactccgggctgacttcaaggtgatctcaagggcattgacaaggaaaggaactgctttagccaaacacgccaagtgctctaaggactatgatgtcgccattgagaccttccagaaggctctaagagagcatcggaacccagacactcttaaaaagttgaatgaggctgagagggcaaagaaagagttgttgcaacaagagtactatgacccaaagttgttggcagaggaggagagagagaaaggtactgagtttttcaaggagcaaaaatacccagaagcaataaaacattacactgaggctctcaggagaaatccgaaggatcccaggggttttgatgacaaggggagtgtatattactcag

SEQ ID NO: 35144 - protein, 212 aa, Panicum virgatum
  misc_feature: Ceres CLONE 1959221-R
  misc_feature (166)..(199): Pfam Name: TPR_1 Pfam Description: Tetratricopeptide repeat
  misc_feature: SWISSPROT Homolog: EC 3.1.3.16 Phosphoprotein phosphatase
KGLLLEPDNEGLKVGLEDAKKERKEMKAAAQEAGNAAYKKDCETAIQHYMKAMELGDEDISYLTNRAAVDFETGKYDECIKDCDKAVERGRELRADFKVISRALTRKGTALAKHAKCSKDYDVAIETFQKALREHRNPDTLKKLNEAERAKKELLQQEYYDPKLLAEEEREKGTEFFKEQKYPEAIKHYTEALRRNPKDPRGFDDKGSVYYS

SEQ ID NO: 35145 - DNA, 701 bp, Panicum virgatum
  misc_feature: Ceres CLONE 1959223
  misc_feature: Encodes the peptide sequence at SEQ ID NO. 35146
ctttttcccggccctattaggtgtaattgaatagacatggctcacgctcccagaaattccgttcttgttcccggtgtcagccgttacagccgttccactgtttactccaaaaaggccttgtataagcgccaaaaaaccaatgttgctgctcctgccaagcaaaccgttgctgaaaagactgttgaagtcaagggtgccaagaatggcggtaagcgtactgttcctgcccaaaaggctcctcgtttctaccctgctgaagatgttcctcaacccaaggtcaaccgtaagtctgctaagaagactgctcttcgctccaacatcacccctggtaccgttttgatccttttggctggtcgctaccgtggaaagcgtgttgtcttcttgaagcaattggactctggactcttgcttgtcactggtcccttcaaggtcaacggcgttcctcttcgtcgtgtcaatcaagcttatgttattgccacctccaccaagattgatctctcttccgccaagattgatgaaaagttcaacgatgcttacttcaagaaatctgccaaaactgaaaaggccttccttgaaggtgaacagaagaaggctgctttccctgaatccaaggctgccgaccagaaggctcttgacaaggaaatccttgccgctgctgccaaggatgctttacctcgtctcttacttgaagtctactttca

SEQ ID NO: 35146 - protein, 221 aa, Panicum virgatum
  misc_feature: Ceres CLONE 1959223
  misc_feature (132)..(221): Pfam Name: Ribosomal_L6e Pfam Description: Ribosomal protein L6e
  misc_feature (1)..(49): Pfam Name: Ribosomal_L6e_N Pfam Description: Ribosomal protein L6, N-terminal domain
MAHAPRNSVLVPGVSRYSRSTVYSKKALYKRQKTNVAAPAKQTVAEKTVEVKGAKNGGKRTVPAQKAPRFYPAEDVPQPKVNRKSAKKTALRSNITPGTVLILLAGRYRGKRVVFLKQLDSGLLLVTGPFKVNGVPLRRVNQAYVIATSTKIDLSSAKIDEKFNDAYFKKSAKTEKAFLEGEQKKAAFPESKAADQKALDKEILAAAAKDALPRLLLEVYF

SEQ ID NO: 35147 - DNA, 597 bp, Panicum virgatum
  misc_feature: Ceres CLONE 1959229
  misc_feature: Encodes the peptide sequence at SEQ ID NO. 35148
gaccactcactgccttccccctgcgtgaattcatccccaactcgacctccgccgtctcaatctgtctttctcctcctgctcctatctctcgccaccacttgtcccccctcctccggaacggcatcaccatggcccgcttcgcgcgctgctcctatgaggaacccactccaccccgcccgcccggctcctcctgccccccctgctacgagcggtgctggatccatcatgggaccaattgcgtcccctattgctcggggtatggcctttggcactggcactgccatggcacacagagctgttgatgctgtagtgggcccccgtaccattcaacatgagactgttgtctcggaggctgctgctgctgctcctgcttctccaatgatgaacgctgatgcttgcggcaaccattctaaggccttcgaagattgtctcaaccactatggcagcgacatcagcaagtgccagttctaccttgacatgctgaacgagtgccgccgcggtggcgcaactgcataagctgctgcttcattggagttgattcgtgggttcccttttcactttcatgatatcttattaataagactaagtgaaactatg

SEQ ID NO: 35148 - protein, 120 aa, Panicum virgatum
  misc_feature: Ceres CLONE 1959229
  misc_feature (75)..(116): Pfam Name: CHCH Pfam Description: CHCH domain
MRNPLHPARPAPPAPPATSGAGSIMGPIASPIARGMAFGTGTAMAHRAVDAVVGPRTIQHETVVSEAAAAAPASPMMNADACGNHSKAFEDCLNHYGSDISKCQFYLDMLNECRRGGATA

SEQ ID NO: 35149 - DNA, 1548 bp, Panicum virgatum
  misc_feature: Ceres CLONE 1959245
  misc_feature: Encodes the peptide sequence at SEQ ID NO. 35150
actaatcacattccccacctacgttataacaccctccttctcccccacccccgcgcccccttccaatctgaaattctcctcccaaccctagccgcccgccgccatggccgaatccggcgcctcgtccccgcactccgccgcggccacggacgacacgcaccacgacggctcggagtccgcggcggcggcggcggcggcgacggccacggcggcagggcacgcgccgcctctgccgccggcgaaggtgcggctgatggtgagctacggggggcgcatccagccgcggccccacgacaaccagctcgcgtacgtcaacggcgagaccaagatcctctcgctcgagaggccgctccgcttcgccgacttcgccgcgcgcctcgccgcgctcgccggaaacctcggggacatctgcgtcaagtaccagctgcccggggaggacctcgacgcgcttgtctccgtcaccaacgacgaggatctggagcacctcgtcctcgagtacgaccgcctccacctgctccgccccgctccgggctccggcggcggctccaaccgcggatccacgctccggctgagggtcttcctcttccccgtccagtcgcccccgccaccgccgcagccagccggcctcctcgagcccaagccgcagcgccactggttcgtcgaggcgctcaacaacgtccctcagccaaagcaggagacgtcaccgtcgcccgtccccgtgcagcagtcgccgccgcagcagatgcaggagtcggtgttcgcccagcagtcgtcgccgccgcaggcgaagcacgagacggtgttcgttcagcagcctccaccgcagacggtggtgcacatgccgccgcctcagccgcacatggtgcttgcggcggcgagccccgactacctgttcggcctcgacaacggcttcgtgcctccctcggcagtgaaggtgaaggatccggccggcgagccgccgacggtgagggagaacgtccccgtcgagttacccgccaaaaacgacgaccgccatcccaaccccgcgggcgagcacgtacgacagcaacggccgcgccatctactacaccagcatgctcccccagtatccttctgctgtcaatggcatgtcggcgtcgggtgcagtactcggcacagagcctacgaagccggtggctgtgaagccgaccgtctcctgatcaccacagcttacctcaccttacctatcgcccatggatcaaaggagttttccaaattttctttcatccgtcgcccgtcaatatccgttaataccgtgtctgttggattcgttattgtctctagtattcacctatattttttcctcccctttttaattgtctagagtttttggtttggcgttccgggtctatgatatgatgcaaaaactattagtagttctttggtgtgcttagatgtacatacagggtctgtggacataatggataagtattatattagcttattggagagttgaattccagtcgagttgtataacaatcttgaggtgtcagctgctatatttgttaattctttgggggttgctactgt

SEQ ID NO: 35150 - protein, 412 aa, Panicum virgatum
  misc_feature: Ceres CLONE 1959245
  misc_feature (62)..(163): Pfam Name: PB1 Pfam Description: PB1 domain
MAESGASSPHSAAATDDTHHDGSESAAAAAAATATAAGHAPPLPPAKVRLMVSYGGRIQPRPHDNQLAYVNGETKILSLERPLRFADFAARLAALAGNLGDICVKYQLPGEDLDALVSVTNDEDLEHLVLEYDRLHLLRPAPGSGGGSNRGSTLRLRVFLFPVQSPPPPPQPAGLLEPKPQRHWFVEALNNVPQPKQETSPSPVPVQQSPPQQMQESVFAQQSSPPQAKHETVFVQQPPPQTVVHMPPPQPHMVLAAASPDYLFGLDNGFVPPSAVKVKDPAGEPPTVRENVPVELPAKNDDRHPNPAGEHVRQQRPRHLLHQHAPPVSFCCQWHVGVGCSTRHRAYEAGGCEADRLLITTAYLTLPIAHGSKEFSKFSFIRRPSISVNTVSVGFVIVSSIHLYFFLPFLIV

SEQ ID NO: 35151 - DNA, 360 bp, Panicum virgatum
  misc_feature: Ceres CLONE 1959248
  misc_feature: Encodes the peptide sequence at SEQ ID NO. 35152
aggagagacgcactggaagcgccctgcccacggacgaaaccgcggcgagaggaggagagggaggaccaccgctggacggcgagacagatgagaaagataatccgcatccgcatcggccaggcccggatcccgggtggcaccgcctgctgggagctctcttggctcaaggagagcatcgagcccgatcgccccctgcccactgttccctcggttggcgtccccctcgatgccttcggcggcttcttcagcgagaccggttctggccaccctgtgccgagggccatctttgtcgaccttgagcccactgtcatcgatgaggtgcgcactggctcgtaccgccagctctttcacccagaccac

SEQ ID NO: 35152 - protein, 90 aa, Panicum virgatum
  misc_feature: Ceres CLONE 1959248
  misc_feature: Functional homolog of the protein sequence given in SEQ ID NO 50141
  misc_feature: Useful for making plants with altered cell wall content and/or composition
MRKIIRIRIGQARIPGGTACWELSWLKESIEPDRPLPTVPSVGVPLDAFGGFFSETGSGHPVPRAIFVDLEPTVIDEVRTGSYRQLFHPD

SEQ ID NO: 35153 - DNA, 586 bp, Panicum virgatum
  misc_feature: Ceres CLONE 1959272
  misc_feature: Encodes the peptide sequence at SEQ ID NO. 35154
cttcactaaattcgaaatgaataatgttcgcacgcagaggaggtacggctgccgcgcgatgatgttggagacggtggccgcggtgcctggcatggtggccggcgcggtgctccacctccggtcgctgcggcgcttcgagcagagcggcgggtggatccgggcgctgctggaggaggccgagaacgagcgcatgcaccttatgaccttcatggaggtgtcccagccgcggtggcacgagcgggcgctcgtggtcgccgtgcagggcgtcttcctccacgcgtacctcgctgcctacctcctctcccccgcgaccgcgcaccgcatggtcggctacctcgaggaggaggccgtgcactcctacaccgagttcctccgcgacatcgacgccggcaagatcgaggacgtgccagcgcccgccattgccatcgactactggcgcctccccgccggcgcgacgctcagggacgtcgtcaaggttgtccgagcggacgaggcgcaccaccgcgacgtcaaccactacgcatcggacatccatcaccaggggcatgcgctgcgggagatagcggcgccgatagggtaccactga

SEQ ID NO: 35154 - protein, 194 aa, Panicum virgatum
  misc_feature: Ceres CLONE 1959272
  misc_feature (1)..(192): Pfam Name: AOX Pfam Description: Alternative oxidase
FTKFEMNNVRTQRRYGCRAMMLETVAAVPGMVAGAVLHLRSLRRFEQSGGWIRALLEEAENERMHLMTFMEVSQPRWHERALVVAVQGVFLHAYLAAYLLSPATAHRMVGYLEEEAVHSYTEFLRDIDAGKIEDVPAPAIAIDYWRLPAGATLRDVVKVVRADEAHHRDVNHYASDIHHQGHALREIAAPIGYH

SEQ ID NO: 35155 - DNA, 661 bp, Panicum virgatum
  misc_feature: Ceres CLONE 1959294
  misc_feature: Encodes the peptide sequence at SEQ ID NO. 35156
ctctctcccccgtgtggtctctatcgtttcgtcatggcccatcgcgaatatcaggtcgtcggtcgccgcatccccactgatgctgaccccacccccaaggtgtaccgcatgcgcatcttcgcgcagaacgacgtcgtggctaagtcgcgcttctggtacttcctgagcaagctcgccaaggtcaagaaggcgaacggcgagctcctctccatcaacgagctgactgagaagaagcccaccaccgtcaagaacttcggcatcttcctccgctaccgatcgaggactggtatccacaacctgcacaaggagttcagggacaccagccgcgtcggtgccgtcaaccagatgtacaacgagatggcttccgtccacaaggccacctggaacaacatcaacatcatcgaggtcaaccagcttaaggctgcccagaccgtccgccccaacatcaagcagttccacgactcgaagatcaagttccctcttcctcacagagtgcagcgcgtgcccatgaagaggtacaggagcaccttcgtcgccaagaggccgtccaccttctggtaaagaagtcagacgaggcgatacacccttactccttctgtcggatcgatcaaatggggcgcgttgtgcggctgacgacgcgaatagaatccataacaaactc

SEQ ID NO: 35156 - protein, 175 aa, Panicum virgatum
  misc_feature: Ceres CLONE 1959294
  misc_feature (2)..(175): Pfam Name: Ribosomal_L18ae Pfam Description: Ribosomal L18ae protein family
MAHREYQVVGRRIPTDADPTPKVYRMRIFAQNDVVAKSRFWYFLSKLAKVKKANGELLSINELTEKKPTTVKNFGIFLRYRSRTGIHNLHKEFRDTSRVGAVNQMYNEMASVHKATWNNINIIEVNQLKAAQTVRPNIKQFHDSKIKFPLPHRVQRVPMKRYRSTFVAKRPSTFW

SEQ ID NO: 35157 - DNA, 677 bp, Panicum virgatum
  misc_feature: Ceres CLONE 1959296
  misc_feature: Encodes the peptide sequence at SEQ ID NO. 35158
atcactaccgatctgccacctgctgatagcaatctcggtctcggctggtggcatcgtccggtaccgagttgccgaccaaccggccatggcgaggatccacctctacgtcgccgcggcctgcgccgtggtgctcgcgctcgccgccccggccctcgccggcgaccccgacttgctccaggacgtctgcgtcgcggacctcgcgtccccgatcaaaatcaacgggttcccgtgcaaggcgaacatctcggcggacgacttcttcttcgcggggctgcggaaccccggcaacaccaacaacccggcgggctccgtggtgacggcggccaacgtggagaagttccccggcgtcaacaccctgggcgtctccatcgcgcgcatcgactacgccccgggcggccagaacccgccgcacacgcacccgcgcgccaccgagatcatcttcgtcctcgagggcacgctcgaggtcggcttcatcaccaccgccaacaagctcttcaccaaggtcgtcggcaagggggacgtcttcgtcttccccagggggctcgtccacttccagcagaacagggggcacggccccgccgccgtcgtcgccgcctttcacagccagctccagggcacgcaggccatcgccatgacgctcttcggcgccacgccgccggtgtcctccgacatcctcg

SEQ ID NO: 35158 - protein, 197 aa, Panicum virgatum
  misc_feature: Ceres CLONE 1959296
  misc_feature (61)..(193): Pfam Name: Cupin_1 Pfam Description: Cupin
  misc_feature (96)..(171): Pfam Name: Cupin_2 Pfam Description: Cupin domain
  misc_feature: SWISSPROT Homolog: EC 1.15.1.1 Superoxide dismutase
  misc_feature: Functional homolog of the protein sequence given in SEQ ID NO 50204
  misc_feature: Useful for making plants with modulated nitrogen use efficiency
MARIHLYVAAACAVVLALAAPALAGDPDLLQDVCVADLASPIKINGFPCKANISADDFFFAGLRNPGNTNNPAGSVVTAANVEKFPGVNTLGVSIARIDYAPGGQNPPHTHPRATEIIFVLEGTLEVGFITTANKLFTKVVGKGDVFVFPRGLVHFQQNRGHGPAAVVAAFHSQLQGTQAIAMTLFGATPPVSSDIL

SEQ ID NO: 35159 - DNA, 1183 bp, Panicum virgatum
  misc_feature: Ceres CLONE 1959299
  misc_feature: Encodes the peptide sequence at SEQ ID NO. 35160
gctaaaaaaatctttgtttctgctacaataggagagtggagcctgtgattgttgcgacctcccaggcatttgacttcctctcttcccctctcactttttttttgaaagaactctctctccccctcttactccacggagcagcaaagcagcagggaggataagcttggaatgccctggtagcgagagggtgcagcgggagccgacggcgtccatggtggagagcgagagaggcgaggaagaagccattgccctcaccggcggcggtggcggtggacagctgcagcaggatggcgtggtctccggcgcggcggagggcgagagggacggcgaggagggagacgcggaggacggcgaacgggaggaggaggaggaaggccgggacgacgtggacgggtggtcggagataaggctggccatcgacgagctgtccccggcgaggctcatcaagcaccgcggccgcggcggcgatggggatgacgacaagccggccgcgccgtccccgcccacgctgcccttcctggcgctgtcccacctccttctccgcgtgctcgataagatcggcccgaccatggccgtgctgcggctcgacgtccaacggaacatcgagaggctgcaggagctgtacttgatggacccagccaagtactccacgctaacggagatagtggagaaggaggtcaaggagggcactgcaaggaaggtcgatagctgtgcaagggctgtcctgtggcttgctagatccatggatttcacaattgcgctgttacagaaattagaggaggacactgccgagcagagtcttgcacagcttgtcgaagctgcgtacgaggtcagcctaaagccatggcacggctggatctcctcggcggcatgcaagatagcgctgcaactcatccccgagaggaaggtcttcaccagcttgctcctagggatgggtcaagactgctccgctctgaaggatgagatcgagaagctcgcattactgctccggccccttcttgatgacatccactccatgatggccaagttcagactggacaggctcaagtcgacgtgatccatggcactggccggcaaggcccaatgtcccaagctatcagttgccgctctgtgaatattgccctgattgtatttcccagtcctgtaaaggttccatgtccgttttgcagcagctgttctagtt

SEQ ID NO: 35160 - protein, 281 aa, Panicum virgatum
  misc_feature: Ceres CLONE 1959299
  misc_feature (91)..(277): Pfam Name: GLTP Pfam Description: Glycolipid transfer protein (GLTP)
MVESERGEEEAIALTGGGGGGQLQQDGVVSGAAEGERDGEEGDAEDGEREEEEEGRDDVDGWSEIRLAIDELSPARLIKHRGRGGDGDDDKPAAPSPPTLPFLALSHLLLRVLDKIGPTMAVLRLDVQRNIERLQELYLMDPAKYSTLTEIVEKEVKEGTARKVDSCARAVLWLARSMDFTIALLQKLEEDTAEQSLAQLVEAAYEVSLKPWHGWISSAACKIALQLIPERKVFTSLLLGMGQDCSALKDEIEKLALLLRPLLDDIHSMMAKFRLDRLKST

SEQ ID NO: 35161 - DNA, 513 bp, Panicum virgatum
  misc_feature: Ceres CLONE 1959310
  misc_feature: Encodes the peptide sequence at SEQ ID NO. 35162
attctcgtcacctcacgatccaactaacccatccagcaacaatggccgctgaaaccgctcgatctggcctggccgccggcctcaacaagggtcacaaaaccactccccgtgtcgtcaagccccgtgtttcccgaaccaagggtcacctgagcaagcgcaccgctttcgtccgtgaggtcgtcaaggaggttgctggccttgccccctacgagcgccgagtcattgagttgctccgcaactccaaggacaagcgtgcccgtaagctcgccaagaagagactcggtaccttcggtcgtgccaaggccaaggttgacgagctccagcgcgtcatcgctgaggcccgccgtactggtcactaaatcaactcggtttgatctgatttttgggaatctggcaccgaacggggttcgcatggattggcgtggtcacgatttgatcgattaaaaaaaattaacggcttggacgctccgtggcagggatttagctgcgggtcaccagaataccaacactttc

SEQ ID NO: 35162 - protein, 105 aa, Panicum virgatum
  misc_feature: Ceres CLONE 1959310
  misc_feature (5)..(103): Pfam Name: Ribosomal_L36e Pfam Description: Ribosomal protein L36e
MAAETARSGLAAGLNKGHKTTPRVVKPRVSRTKGHLSKRTAFVREVVKEVAGLAPYERRVIELLRNSKDKRARKLAKKRLGTFGRAKAKVDELQRVIAEARRTGH

SEQ ID NO: 35163 - DNA, 575 bp, Panicum virgatum
  misc_feature: Ceres CLONE 1959311
  misc_feature: Encodes the peptide sequence at SEQ ID NO. 35164
gaacgatctcggccggagtaccgtgctgtgcatgtcagcaagatgaagacggcggcgatgcggatgcgcgccatccttgtcctcctcgccgccgcttcagccgccgccgccgccgccagccgctgccacaccggcgacaaggccgcgctgctggccatcaaggcggcgctcggcaacccctaccacttcgcgtcctggacggccgcctccccgtgctgcgactggtacgacgtcgactgcgacgcctccaccggccgcgtcgtcggcctctccttgttccaggacgccaacctcaccggcgccatccccgacgccgtcgccggcctcgcccacctccggagcctcaggctgcaccacctcccgggcatctccggccccatcccgccggccatcgccaggctctccaacctcgccttcctcaccatctcctggacggccgtctccgggcccgtgccgtccttcctcggcgcgctcgccaggctcagccagctcgacctctccttcaacgcgctcgccggcgccgtcccggcctggctcgccgcgctcccgagcctgtacagcgtcgacctcagccg

SEQ ID NO: 35164 - protein, 177 aa, Panicum virgatum
  misc_feature: Ceres CLONE 1959311
  misc_feature (29)..(67): Pfam Name: LRRNT_2 Pfam Description: Leucine rich repeat N-terminal domain
  misc_feature: SWISSPROT Homolog: EC 2.7.11.1 Non-specific serine/threonine protein kinase
MKTAAMRMRAILVLLAAASAAAAAASRCHTGDKAALLAIKAALGNPYHFASWTAASPCCDWYDVDCDASTGRVVGLSLFQDANLTGAIPDAVAGLAHLRSLRLHHLPGISGPIPPAIARLSNLAFLTISWTAVSGPVPSFLGALARLSQLDLSFNALAGAVPAWLAALPSLYSVDLS

SEQ ID NO: 35165 - DNA, 702 bp, Panicum virgatum
  misc_feature: Ceres CLONE 1959319
  misc_feature: Encodes the peptide sequence at SEQ ID NO. 35166
aaccacctcgctatcggcacctcgattcgtcctcagcatcatcttgtacttctccggcctgcgccacagccgtcgagctcttctactcctggttctccgtccatggagctggccgcctccacgtccgcctccgtctgctccgcgtacaaccacctctcggccgccggcggtgacagcggagaccaggcggcggcatcaacgcagcaccagcagctcgcgcggcggcagaggaagcacggcggcggccgcggctgcgcggggctccggcggcggtgctacgcggtgctgaagcagcagcggacgcggctctacatcctccggcgctgcgtcaccatgctcctgtgctggcacgagcacgacgacctctccgactgagcacggccgccgcggtccgtgcttgttagagagcttggctctgtatctacgcggggcgggccaggttttccatgctcgatttgtataggaaccctgagagagatgcgcgcctgtactactactttttaaatagccggttatagcttccgctatagaccgctatagcttctagaaaggacggccgttatgtcatttagcccgctaaatttcagctatagtccgctaaacgccgtaatggcagctctaccgctaaacgtcttagccggcgatttaaaaccttgactactacactgccagcctgtgaaatatgatcaaacgcttggtgga

SEQ ID NO: 35166 - protein, 90 aa, Panicum virgatum; identical to SEQ ID NO: 18705
  misc_feature: Ceres CLONE 1959319
  misc_feature (63)..(81): Pfam Name: DVL Pfam Description: DVL family

SEQ ID NO: 35167 - DNA, 660 bp, Panicum virgatum
  misc_feature: Ceres CLONE 1959321
  misc_feature: Encodes the peptide sequence at SEQ ID NO. 35168
gctaccagggtgatgtttgctgccccaattctggcatttgttacaacacacatcttgtaccttaacttctatgagcttgactatggatggaacatgaaagtttgtgtagtgatggctgtggttcaacttctgacatgggcaatttgggctggtgtaacccaacatccatcacgactcaagctatggacagttatttttggaggagcactagctatgcttcttgaactctacgacttccctccatacatgggctatgcggatgctcactcactgtggcatgcaatcaccattccactcacatatctctggtggagcttcattaaggatgacgccgaattccgaacgtcaactctcatgaagaaggcaaagtaagcagaaggactacagattgttaacataggatctgggaggatcagaattcatggcccacttgagaaacattgcgacacttgtgctatcagacatcacaaactttcagaatatttggacccttgatgctgctgtcaccaatctgaaaagggattcatgttcatgctctcacaattttggtccacaagctcatcatcttccttcgggcacatatcaggcccttgtgatctgtctgttgattgctgaacgaaaattctgtggttgaattcgcatcttatctttttttatctg

SEQ ID NO: 35168 - protein, 123 aa, Panicum virgatum
  misc_feature: Ceres CLONE 1959321
  misc_feature (3)..(119): Pfam Name: Per1 Pfam Description: Per1-like
ATRVMFAAPILAFVTTHILYLNFYELDYGWNMKVCVVMAVVQLLTWAIWAGVTQHPSRLKLWTVIFGGALAMLLELYDFPPYMGYADAHSLWHAITIPLTYLWWSFIKDDAEFRTSTLMKKAK

SEQ ID NO: 35169 - DNA, 1340 bp, Panicum virgatum
  misc_feature: Ceres CLONE 1959329
  misc_feature: Encodes the peptide sequence at SEQ ID NO. 35170
actgcacacaccgccgacttgagagcaagaactaaacctagcagagctaataaggctagctagcaagccgatcgagcaaaagagatcgatcggccatggctgccgccgctgctaagaagcttggcgtcctcgtcgccttgctcgcgctcctcgtcgggccgtcggcgggcctgctgggcatcggcagcggcaccgactgcaccgtcttcgtgggttggccgctccccgtgatcctgcgctccctcatctgcgggctcctgggccaaccctacactcctccgatctggagggacgagcccacaggcgcagggctcagcgtcggctactacaacaaccctcgcaacaccgacgcctactgccccggcgcggagacggccgtgaggaatgccgtggagaaggccatctaccagcaggggcgcggcatcggcgccggcctcatccgtctcttcttccacgacgccttcgtccgggggtgcgaggcttccgttctcctcaggaccacggcccttgcgggcaccaacacggagatggaggggcccyyyaacaaggacagcctgcgcgggttcgatgtgatcgacgcggccaaggaggccaccaacgccgcctgcggcaacagggtctcgtgcgccgacatcctcgccttcgccgcgcgcgacgcgtccgacatcctcagcggcggcaacatccgctaccccgtgccggcggggcgctacgacggccgcgagtccttcgccaaggagaccggccagctgcccggcccggactcctccctccaggagctccagatgatgttcgccgcccagggcctaagcaccgccgacatggtgacgctctccggcgcgcacagcatcggccaagcccgctgcctcttcttcaccggccgccttgcggccatggactccgactacgccaggcggctgaacacggcctgcaacggcaccggcagccccaacaacagggtggaccaggaccccgtgtccgccaccgtgctggacaaccagtactacaagaacatcgacaagttcgtgctgttcgggtcggacgccgtgctcgtctcgtccccggagaccaaacagcaggtggacgttaacaaagccaatctgacgagcaggtgggagagcgacttcgcggcggccatggtgaagatgggcaacatcggggtcaagacggctctcgtccccagcgaaaccgagatcagggaggtatgctggagagtcaacgcttagcccctggccccggtcgtgtgtagctgctgcatgcatgcatgtgaatgaagatatgcatgcatacagaattgtttcttcgatcaatagtaccatgatctgttgatgttttttgtt

SEQ ID NO: 35170 - protein, 376 aa, Panicum virgatum
  misc_feature: Ceres CLONE 1959329
  misc_feature (95)..(335): Pfam Name: peroxidase Pfam Description: Peroxidase
  misc_feature: SWISSPROT Homolog: EC 1.11.1.7 Peroxidase
  misc_feature (149)..(149): Xaa is any aa, unknown, or other
MAAAAAKKLGVLVALLALLVGPSAGLLGIGSGTDCTVFVGWPLPVILRSLICGLLGQPYTPPIWRDEPTGAGLSVGYYNNPRNTDAYCPGAETAVRNAVEKAIYQQGRGIGAGLIRLFFHDAFVRGCEASVLLRTTALAGTNTEMEGPXNKDSLRGFDVIDAAKEATNAACGNRVSCADILAFAARDASDILSGGNIRYPVPAGRYDGRESFAKETGQLPGPDSSLQELQMMFAAQGLSTADMVTLSGAHSIGQARCLFFTGRLAAMDSDYARRLNTACNGTGSPNNRVDQDPVSATVLDNQYYKNIDKFVLFGSDAVLVSSPETKQQVDVNKANLTSRWESDFAAAMVKMGNIGVKTALVPSETEIREVCWRVNA

SEQ ID NO: 35171 - DNA, 658 bp, Panicum virgatum
  misc_feature: Ceres CLONE 1959330
  misc_feature: Encodes the peptide sequence at SEQ ID NO. 35172
ctccccgcagcgggccaccaccaccacctctctctcccgcccccaagccgcccggcgccgccgccgtctccctccctcctccgctgccgtctccggccctcgtccctcgccatgatcatctccaagaagaaccgccgcgagatctgcaagtacctcttccacgagggggtcttgtatgccaagaaggactacaacctggccaagcaccccaagcttgacgtccccaacttggaggtcattaagctaatgcagagcttcaagtcaaaggagtatggaaggttacagaggaggtccgcgtggtgctccaggtgattttggtggtgataagggtggtgctcctgcggagttccagccatcttttaggggtagcagacctggctttggccgtggtggcggtggcggcaccggcacatttggtgctggggcatcttccatggagtgatacttcagttagccagcgcattgatttgatgaatggctttacagatgcagcgcgcaaggggaggcttctctgttggtctttgaattatgaggacaatgagattttgtttaccaagttgtagcagtggttcagtgtttttcgtttttgttagaagatgaaattcttgaggctgtttgtatgccaagaatgttatgagcaagttatcatcattctgtc

SEQ ID NO: 35172 - protein, 66 aa, Panicum virgatum
  misc_feature: Ceres CLONE 1959330
  misc_feature (3)..(62): Pfam Name: S10_plectin Pfam Description: Plectin/S10 domain
  misc_feature: Functional homolog of the protein sequence given in SEQ ID NO 50186
  misc_feature: Useful for making plants with modulated nitrogen use efficiency
MIISKKNRREICKYLFHEGVLYAKKDYNLAKHPKLDVPNLEVIKLMQSFKSKEYGRLQRRSAWCSR

SEQ ID NO: 35173 - DNA, 386 bp, Panicum virgatum
  misc_feature: Ceres CLONE 1959339
  misc_feature: Encodes the peptide sequence at SEQ ID NO. 35174
gacctgttcgatcagctatatagctaccataccaagcaccatcagggacctcaacgcccgcctctccgccgacgagcgcgtcgaggtctgccagctcgccatcgccgacggcgtcaccatctgccgccgcctcgtctgagcgatatgatcccgcatgtggccggcggctgtgttgatctgttactactcgccctcgctctcgctgctgctgctgctgccgtcccggtactttcaataagtttttttttcttccctttctgtttctttctctttttgcaagttggtcgcgtcagatcgtgtggtatacagtatactgtacctactactactgtactgtacttgtgtaaccggaattgttggagcaaatacagcgcattactttcgcc

SEQ ID NO: 35174 - protein, 45 aa, Panicum virgatum
  misc_feature: Ceres CLONE 1959339
  misc_feature: SWISSPROT Homolog: EC 2.1.1.104 Caffeoyl-CoA O-methyltransferase
  misc_feature: Functional homolog of the protein sequence given in SEQ ID NO 51474
  misc_feature: Useful for making plants with altered carbohydrate content
  misc_feature: Functional homolog of the protein sequence given in SEQ ID NO 51475
  misc_feature: Useful for making plants with altered cell wall content and/or composition
  misc_feature: Functional homolog of the protein sequence given in SEQ ID NO 51476
  misc_feature: Useful for making plants with altered lignin content
TCSISYIATIPSTIRDLNARLSADERVEVCQLAIADGVTICRRLV

SEQ ID NO: 35175 - DNA, 716 bp, Panicum virgatum
  misc_feature: Ceres CLONE 1959340
  misc_feature: Encodes the peptide sequence at SEQ ID NO. 35176
gacgtgcaggactactactgctagcttcctagtagcataagctagagagcaagctccacccggccaagaggcggcggcaggcagccatggccatggaaaccgtgcccccgaccgcgaggtgcctgttcccgggcaaggagcaccggaacgcgatcacggtgccggagttcaagctctggctgaagcagttcgacaccgacggcgacgggcgcatcagccagaaggagctccgggaggccatccgccgccgcggcgcgtggttctccggcctgcgggcgcggttcgccatccggcgcgccgaccggaaccgcaacggcttcgtggacgactccgagatcgagggcctcatccagttcgccgagagggagctgggcttcaggatcaccacggacgcggccgccgacggcccgcctctcggccgccgcgtcgtcatgggctcgccgccggcggacaggtcaatcacgtacaaggaagaaggatatttcagcacacatgggattttttgctctatgtagcttagatctctcctctcctctgaataatttgtgtggaagcaggagctaggaagcaccaactctgcaggtacgtagcagcttgtttgggtagtttgtaccgcgtggtgaagtgtgatgatgctatatcatgtactgtatattgacttgtaataatccatccgtcccatgtgtgttattatggattcgatcgatcagcttctc

SEQ ID NO: 35176 - protein, 142 aa, Panicum virgatum
  misc_feature: Ceres CLONE 1959340
  misc_feature (27)..(55): Pfam Name: efhand Pfam Description: EF hand
MAMETVPPTARCLFPGKEHRNAITVPEFKLWLKQFDTDGDGRISQKELREAIRRRGAWFSGLRARFAIRRADRNRNGFVDDSEIEGLIQFAERELGFRITTDAAADGPPLGRRVVMGSPPADRSITYKEEGYFSTHGIFCSM

SEQ ID NO: 35177 - DNA, 685 bp, Panicum virgatum
  misc_feature: Ceres CLONE 1959346
  misc_feature: Encodes the peptide sequence at SEQ ID NO. 35178
tcggccgccatctcccccgcttaggtttaggtcccctccgccgcccatctccggcctcccgagctcgcggaaatggtcgcccacaggttccatcagtaccaggtggtgggtcgcgctctgccgacccccggcgatgagcaccccaagatctaccgtatgaagctctgggccaccaacgaggttcgcgccaagtccaagttctggtacttcctgaggaagctcaagaaggtgaagaagagcaatggccagatgctcgccatcaacgagatctttgagcgcaacccaaccacaatcaaaaactatggcatctggctgcgctaccagagcaggacaggttaccataacatgtacaaggagtaccgtgacaccaccctgaatggtgccgtggagcagatgtacaatgagatggcctcccgtcatcgtgtgagggccccctgcatccagatcatcaagacagcgacagtccacttcaagctgtgcaagagggacaacaccaagcagttccacaactccaagatcaagttccctctcgtgtaccgcaaggtgaggccacccaccaggaagctcaagaccactttcaaggcgtccaggcccaacttgttcatgtgataggtctcagcaggatggaacggtcttagcgagccagagtggaaagattttgcctgtggaagttttgggtgcctgt

SEQ ID NO: 35178 - protein, 178 aa, Panicum virgatum; identical to SEQ ID NO: 18658
  misc_feature: Ceres CLONE 1959346
  misc_feature (5)..(178): Pfam Name: Ribosomal_L18ae Pfam Description: Ribosomal L18ae protein family

SEQ ID NO: 35179 - DNA, 444 bp, Panicum virgatum
  misc_feature: Ceres CLONE 1959353
  misc_feature: Encodes the peptide sequence at SEQ ID NO. 35180
agtcaactccagtcagagccaaaatcctctacaatggccaagtctaagaactcgtcccagcacaaccagtcgcgcaaggcgcaccggaacggcatcaagaagcctaagacccagaggtacccctcgctgaagggcaccgaccccaagttccgcaggaaccacaggcatgcgctccacggcaccgcgaaggctctgaaggagttcaaggagggcaagagggagactgcctaaatcgattttccttttttgctagcggcgcgcaacggttgggggaggggacacatcttcggacatgactcttacgaaggagggattctaaggcggtgacgatttttttttacaccaccgctcactgggccggcttttcgaggtgttatctagggcgtcatttcgatcaaacccaaacggaatgcattggcctccgcgcagaggcggacctgccgg

SEQ ID NO: 35180 - protein, 65 aa, Panicum virgatum
  misc_feature: Ceres CLONE 1959353
  misc_feature (3)..(42): Pfam Name: Ribosomal_L29e Pfam Description: Ribosomal L29e protein family
MAKSKNSSQHNQSRKAHRNGIKKPKTQRYPSLKGTDPKFRRNHRHALHGTAKALKEFKEGKRETA

SEQ ID NO: 35181 - DNA, 603 bp, Panicum virgatum
  misc_feature: Ceres CLONE 1959367
  misc_feature: Encodes the peptide sequence at SEQ ID NO. 35182
gtgctctctcagaggtgggttggcttctcctccccctccggttcgcggttcggttcggtccggtttcgtgaggttcttgggggtgagaggaagagatggcggcgtcggatgttgagtaccgctgcttcgtcggcggccttgcctgggccaccgacgacaactcgctcctcaacgccttcagccccttcggcgaggtcctcgagtcctagatcatcctcgatcgtgagacccagaggtcccgcggcttcggcttcgtcaccttctcgagcgagcaggcgatgctcgatgccatcaaggggatgaacggcaaggagctggacggccgcagcgtcgctgtctacgaggcccagtcccgcggcggcccgcgctctggtggtggctgttacgggtgcctttagggttgcggagggtacggtggctggggctagagctgtgggtgctcctggcgcggtcccggcggtggcgggtactgaggatgaagaagaagaagcagctacagtggacggggaggctggtgcggcgttcgccgtttcgggagttccaatgggcgctctcagagctgatcggtgtagcccgtgtggactggaaatcctgtgcctgtta

SEQ ID NO: 35182 - protein, 37 aa, Panicum virgatum
  misc_feature: Ceres CLONE 1959367
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MAASDVEYRCFVGGLAWATDDNSLLNAFSPFGEVLES

SEQ ID NO: 35183 - DNA, 722 bp, Panicum virgatum
  misc_feature: Ceres CLONE 1959377
  misc_feature: Encodes the peptide sequence at SEQ ID NO. 35184
gacaaggcctctaaatcaaaaacggttgatggaaaagaaagccacaacaataaggttgctaagccatccagtaaaaataaaggtaaaggcaagggtggtgcaaagggtaagcctgccccaactaaggcacagctgcatgctgttgttaccagaattttgaaggaagttgacttcaacacggcaactttggctgatattctcagacaattaggggcccattttgaagtggacctcatggacagaaaagcagaagtgaagtgcatcattgaggatgtaataaataatatgtctgatgatgatggtggtgaggaagaatcagatggtgaagcagaagccaatggtaaggaagagaaggtcaagggtgatcctgatagaggtgaagataattgatgccatggattggatttacatgcatggtcaggtttgtattatgccagcggtttggattgatcttgggaggactattctgttggttctgtacaattggggcaccaccacaaattggtgacctgggtagtacaagattgttaaccatttcacacagccgtatacacctagttgtgcttgactaggtagcgacctgtagcctagttgctggtcatgtataatagctgtgggtttaatagctttgttgcttaggtagctagcctgactgtaatatgcacaataattcttggcttgtttcgtccatttaaacatgtaaaactctatcgttctgagtc

SEQ ID NO: 35184 - protein, 129 aa, Panicum virgatum
  misc_feature: Ceres CLONE 1959377
  misc_feature (41)..(94): Pfam Name: DEK_C Pfam Description: DEK C terminal domain
DKASKSKTVDGKESHNNKVAKPSSKNKGKGKGGAKGKPAPTKAQLHAVVTRILKEVDFNTATLADILRQLGAHFEVDLMDRKAEVKCIIEDVINNMSDDDGGEEESDGEAEANGKEEKVKGDPDRGEDN

SEQ ID NO: 35185 - DNA, 719 bp, Panicum virgatum
  misc_feature: Ceres CLONE 1959384
  misc_feature: Encodes the peptide sequence at SEQ ID NO. 35186
aaccatcccaaacacaagctcagcctactaagaagctagttgtagcaagcagctcatagcacactttaagctatagctagctaatagaaatggcgccatcaaagcttgccctgttcctcgccctgactgtccttgcctccgcggcggcagtgcacggctgtacaccttactgtcctaccccaccagtggttcccaccccgccggtcgtgccaacgccgtccggtggcggcggttcctgcccaatcaacgcactgaagctagaggtgtgcgccaatgtgttgaacctcctcaagctcaacatccctggcttggggaacgaccagtgctgcccgctgttgcaggggctcgtcgaccttgacgccgcagtctgtctctgcactgccatcaaggccaacgtcctcggcatcaacctcaatgttcccatcgacctgagcctcctcctcaaccactgtggcaagatctgccctgcagatttcacctgcccaaattagccagcgaatgaaacgttccacacgcccatgcatcatttgaatcttcatccatccactgccttgccagcgatcttgggcacctatgccgtcggtctatgtgttggtttgcatcagcatgcacccatatatgtgttgatctcttctcttcgcgttcgagtgatgcctcaggagaggtgattggcatgcaaattgttgttctcgttcattcgaaaaatatgttatatttgc

SEQ ID NO: 35186 - protein, 133 aa, Panicum virgatum
  misc_feature: Ceres CLONE 1959384
  misc_feature (50)..(131): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
  misc_feature: Functional homolog of the protein sequence given in SEQ ID NO 50191
  misc_feature: Useful for making plants with modulated salt sensitivity
MAPSKLALFLALTVLASAAAVHGCTPYCPTPPVVPTPPVVPTPSGGGGSCPINALKLEVCANVLNLLKLNIPGLGNDQCCPLLQGLVDLDAAVCLCTAIKANVLGINLNVPIDLSLLLNHCGKICPADFTCPN

SEQ ID NO: 35187 - DNA, 566 bp, Panicum virgatum
  misc_feature: Ceres CLONE 1959413
  misc_feature: Encodes the peptide sequence at SEQ ID NO. 35188
aaccctcctatcaggaaaataatttgctctcccccccccaacatatctagacctgggtgtctccgtcatcaccgtctccgctcgcgttgggacttgggaaaggagcaagacgacgacactaccgccctctccggagatgacctgggtcggcatggagatgttgggcgacttgaactggtcgaatgcatcgagaatatcatcggacattacaggtgggttgggggatctggcatggatgtgacgagcacagcctagacgctgtccggacctgtggatgatcctagcaagcttcctatatggaacttcgactgcttcagcacaggccacgctacaggtgacgacaatgaagtcctcctttgtccccaagccatcttcaaggacccgttcaggaaggggaagaacatactggttatgtgcgactgctatgcgccgaacggggagccgattccgaccaacaagcggcacggggcggctaaaatcttcagccagcctgatgtcaaggctgaaaaaccatggtttgggattgagcaggaatacacccttcttgaaaaggacaccaactggcc

SEQ ID NO: 35188 - protein, 51 aa, Panicum virgatum
  misc_feature: Ceres CLONE 1959413
  misc_feature: SWISSPROT Homolog: EC 6.3.1.2 Glutamate--ammonia ligase
  misc_feature: Functional homolog of the protein sequence given in SEQ ID NO 50222
  misc_feature: Useful for making plants with modulated water use efficiency
MCDCYAPNGEPIPTNKRHGAAKIFSQPDVKAEKPWFGIEQEYTLLEKDTNW

SEQ ID NO: 35189 - DNA, 1520 bp, Panicum virgatum
  misc_feature: Ceres CLONE 1959425
  misc_feature: Encodes the peptide sequence at SEQ ID NO. 35190
acgtcgcggtcggattattacgcgcgaaataggaaccaggttcggaggagccacgctagtctactgcagtctgtggcccagatcgaatactcaattctcgatcgattgtgtggctcgctggtgactagttagtttacgtactgaattgggttgattactctctgcctaatgattgcttacacacgcacgggaaaactaatttgatggggggaatctagttgattcctgtcttgctgaacttttgattctgtttctgtacagtcaccaaaatttgagaaaaggtctatatctgtctttagtttaaaataaagttgtctgtcgactgattcttaaatgtctctgatgcagcttgtggaacttcccgtccctgcggcaaagaagaatgagcttctgttgaagctggaggcagcaagcatcaatccggtggactggaagctacagaaagggatgctacgccctatcctgcctcgcaaactgccttttatcccagtgactgatgtggcaggagttgtggttgatgttggtccaggagtcaatggattccaggctggagatcaagttgttgccatgctgaactcattttatggaggtggacttgcggagtatgctgtggcatctgagaatctgaccgttaagaggcctcctgaggtgtcccctgctgaaggcgcagggctgcccatcgcagctggcactgcgctccaggctttaaggaccattggcgccaagttcgacggaactggcgagcccttaaatgtgctgatcaccgcagcatctggtggtgttgggctctacgccgtgcagctcgcaaagctggcaggtctccacatcactgccacctgtggcgcgcgcaatgtggaactggtgaagagcttgggcgcggatgaggtgctcgactacaggacgccggagggcgccagcctgcagagcccatcaggcaagaagtacgacggcatcgttcactgcacagtcgggataagctggtcgacgttcgagcctgtgctcgccaacaccggtagggtgattgacatcaccccgaacttcaccgccatcctcaagtcggcgctgcacaaggtgacgtttgccaggaagcggctggtgcccctgctcctgtctcccaacaaagctgacctggagttcctggtccggctgctgaagaacggcaagatgaagacgctgatcgactcgaggttctctctgagcgaagccagcaaggcttgggagaagagcatcgagggccacgccacaggcaagatcatcgtcgagatggaaggctgatccgccattaacaaaagcagggagacgcaaggtagctggctatagacatacagcgttgacggacaagtagtagcagggtgtctgggtatggcttcgtcgtacagaagaatattggtgaggaactgaggatagatgtttataggattgtgctttttccttgttttcgattgtgaggttcttgagtaggttgggggtttgtggatttgcaccgttgatcagtaaagtggcatcgtagtatttcgtag

SEQ ID NO: 35190 - protein, 313 aa, Panicum virgatum
  misc_feature: Ceres CLONE 1959425
  misc_feature (16)..(102): Pfam Name: ADH_N Pfam Description: Alcohol dehydrogenase GroES-like domain
  misc_feature (137)..(274): Pfam Name: ADH_zinc_N Pfam Description: Zinc-binding dehydrogenase
  misc_feature: SWISSPROT Homolog: EC 1.6.5.5 NADPH:quinone reductase
MSLMQLVELPVPAAKKNELLLKLEAASINPVDWKLQKGMLRPILPRKLPFIPVTDVAGVVVDVGPGVNGFQAGDQVVAMLNSFYGGGLAEYAVASENLTVKRPPEVSPAEGAGLPIAAGTALQALRTIGAKFDGTGEPLNVLITAASGGVGLYAVQLAKLAGLHITATCGARNVELVKSLGADEVLDYRTPEGASLQSPSGKKYDGIVHCTVGISWSTFEPVLANTGRVIDITPNFTAILKSALHKVTFARKRLVPLLLSPNKADLEFLVRLLKNGKMKTLIDSRFSLSEASKAWEKSIEGHATGKIIVEMEG

SEQ ID NO: 35191 - DNA, 578 bp, Panicum virgatum
  misc_feature: Ceres CLONE 1959429
  misc_feature: Encodes the peptide sequence at SEQ ID NO. 35192
accagcaagtccacggaaatcggtcaagatgcagatcttcgtgaagaccctcacgggtaagaccatcaccctcgaggtcgagtcctcggacaccatcgacaatgtcaagtcgaagatccaggacaaggagggcattccccccgaccaacagcgcctgatctttgccggcaagcagcttgaggatggtcggactttgtccgactacaacatccagaaggagtcgactctccaccttgtcctccgcctccgtggtggtatcattgagccctcgctcaaggcccttgcctccaagttcaactgcgagaagatgatctgccgcaagtgttacgctcgtctcccgcctcgtgcgaccaactgccgcaagcgcaagtgcggtcacactaaccagctccgccccaagaagaagctcaaataaacggttactctcttcggtcacggtcgtctggcgtctttggttttctcggcattgcatggttctgcaagggttggcagggggtacacggcacattctggctgtacattccggatgaccatagctcaagactcttgaccatctaaattcatctgcatgactgttc

SEQ ID NO: 35192 - protein, 128 aa, Panicum virgatum
  misc_feature: Ceres CLONE 1959429
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature: SWISSPROT Homolog: EC 3.1.2.15 Ubiquitin thiolesterase
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKSKIQDKEGIPPDQQRLIFAGKQLEDGRTLSDYNIQKESTLHLVLRLRGGIIEPSLKALASKFNCEKMICRKCYARLPPRATNCRKRKCGHTNQLRPKKKLK

SEQ ID NO: 35193 - DNA, 680 bp, Panicum virgatum
  misc_feature: Ceres CLONE 1959433
  misc_feature: Encodes the peptide sequence at SEQ ID NO. 35194
gtcgaagtttcggatcccatgaggatgaagataagagttctggtaaccctcagtctgggaaagcgttgtatgacttcacagcaggtggcgatgatgagttgagtttaaccactggagaagatgtggagattgaatatgaggtcgatggctggtattatgtgaagaaaaaaaggcctggaagagatggaaagatggcaggtctggttcctgttctgtatgtgagctcatgataacagccgtctgtatgtttgtcgacacttgttgagttgttgtccaagctgtttggagatcatgagcttatggatggcacacaaaaatggccctatatgatcatcacacaaacttgttgagagcctaacatcttataggcacatgcccttgtggaaggtatccatatgatgctgcaatgttcttgctgggcgagatttacatgttgattagtttgtacaccacgagtccattcaattgattgttttctttgagttggacacttgcttcagaggttaactgtccatctgtgccgttctgctctgtcggtattctggaaggcggtttcgcatccctagtttatcagttgtgcgatatatatgtagtcaaattgtagaggcatcattttccccctcccgaccattattttggtcttgtgtattgtgtgattccacagggaatagttgcggttt

SEQ ID NO: 35194 - protein, 75 aa, Panicum virgatum
  misc_feature: Ceres CLONE 1959433
  misc_feature (17)..(75): Pfam Name: SH3_1 Pfam Description: SH3 domain
RSFGSHEDEDKSSGNPQSGKALYDFTAGGDDELSLTTGEDVEIEYEVDGWYYVKKKRPGRDGKMAGLVPVLYVSS

SEQ ID NO: 35195 - DNA, 394 bp, Panicum virgatum
  misc_feature: Ceres CLONE 1959442
  misc_feature: Encodes the peptide sequence at SEQ ID NO. 35196
aaggagctcttctggaagatgtgcaagattcttcacttgttctactttcagaccgatggattcagctctccaaaggaaatggtcggtgcagtgaacgcagtcatcaacgagccactcaaaatccaaatgagtgatgcatccttgttcatttcatcagaaaaatgaggatctcctgtagtctgtcatgttcatatcaatcacaatcagaggcagcagcaggccaaacagctagtatcatacagtttaatttggctgatgtagtgatgaacaatgtaggtgttgtacatgacccttttccaaaaaaaaaaattgtgttgtacatggatcatggtcataggaagaactgtaactctctgctagtgaaatttcgttgccctcttacgcaaaatttgtc

SEQ ID NO: 35196 - protein, 54 aa, Panicum virgatum
  misc_feature: Ceres CLONE 1959442
  misc_feature: SWISSPROT Homolog: EC 4.2.3.19 Ent-kaurene synthase
  misc_feature: Functional homolog of the protein sequence given in SEQ ID NO 51477
  misc_feature: Useful for making plants with modulated biomass
  misc_feature: Useful for making plants with modulated flowering time
KELFWKMCKILHLFYFQTDGFSSPKEMVGAVNAVINEPLKIQMSDASLFISSEK

SEQ ID NO: 35197 - DNA, 709 bp, Panicum virgatum
  misc_feature: Ceres CLONE 1959477
  misc_feature: Encodes the peptide sequence at SEQ ID NO. 35198
actgccaatcgaatcaaccacaagcacacacaccgaggcaatcaacaaggccatggccgccgtgaactccagcgtcgtcgggctcaagcccgccgcggcggtgccgcaggccgcctcgccggcgaagagggtgcaggtcgcgcccaaggcggctgagggccgccgcgccgccatgctcggcctggccgccgtcttcgccgtcacggccaccgccggctcggccaaggccgggattatcgacgagtacctcgagaagagcaaggccaacaaggagctgaacgacaagaagaggctggccaccagtggcgccaacttcgctcgcgcctacaccgtggagttcggcagctgccagttcccctacaacttcaccggctgccaggacctggccaagcagaagaaagttccgttcatcagcgacgacctcgagatcgagtgcgaggggaaggagaagtacaagtgcggctccaacgtcttctggaagtggtgaagatcgagcttgattgattcttggcaaggagctggagggagtgctgtgtcgtcggtgtaacgtttgtacctagatgcccataaaccggaggaaaaaaatttggatgtgtaatctaccgtcattgtgtctgtatcatctcgtcgtttgatcatgatcgaacctcttgcattggggagggtgaagttgtagtcttttcttcttggctgttgcctcctcatttcg

SEQ ID NO: 35198 - protein, 144 aa, Panicum virgatum
  misc_feature: Ceres CLONE 1959477
  misc_feature (8)..(144): Pfam Name: PsaN Pfam Description: Photosystem I reaction centre subunit N (PSAN or PSI-N)
MAAVNSSVVGLKPAAAVPQAASPAKRVQVAPKAAEGRRAAMLGLAAVFAVTATAGSAKAGIIDEYLEKSKANKELNDKKRLATSGANFARAYTVEFGSCQFPYNFTGCQDLAKQKKVPFISDDLEIECEGKEKYKCGSNVFWKW

SEQ ID NO: 35199 - DNA, 1319 bp, Panicum virgatum
  misc_feature: Ceres CLONE 1959502
  misc_feature: Encodes the peptide sequence at SEQ ID NO. 35200
tcggctcggctcccataccaccagtccaccaccccgtcatccatctcctcctccgcctcctcgcttttccgtccactcctccccctccccgtccacgcctccctccctctctctcaagcgcgcgccccattgcttctcggatctgggcgggcgggcggcggcctcgcctcgcgctcccggctgttgcgatctgacccgggtgggggcgcgcggctgctggcgagccgaatggtgtgatcggcccggccggggaccgggagcgaggcgatgcggcgggctccggagctcccgctgctgctggcggcggcgctcctcgcattggcggcggcgcccgggctcgcgcgcgcggccaccgacgcggccgacgtctctgccataaatggattgtacgttgcactgggatcgccaactcttcctggatggactggaaatggtggagacccctatggtgagctctggcagggtatcgtgtgtactggctctactataactggaataaccatgaatgctgcaaacttgggagggcagctgggcagtttagggaacttcacttcgatcatcatcataaatcttagtaacaataagattggtggaagcataccagaggacctacctattacattgcagcagctttttctctctgctaatcagctcactggaagcatcccaagttcattgtcaaagctcaaaaatctaacagccatgtcagtcaatggcaacaatctaaacggagacctgccagatgcttttgattcactcaatggacttgtgaatttggatatttcttctaacaacttgactggtgtgttaccaccttcaatgaaaagcttggcatctttgactacattgcacatgcaagataatcaactgtctgggacacttaatgtcttgcaggatctccctctgaaagacttgaatatagagaacaatcagttttctggcccagtgcctgcaagtttactgaacataccaaacttcaaaaaggatgggaatccattcaataccagcatagccccatctgcatcaccaccttcaccatcaattggaccagcaccaactccaacaccagcaggaccaaaaccagcttcgacaccagcatctgcacctactagttcaaattcaacaccagcatcagcacctccatcacctccttcatttacacaagacaggagggtggaggtgcaaccatttgtgcacctggttgttgatgataaaaatccctgtaatttttgcggacgtgatattatagctggatcctgaattcttgtaacttacactccggaattcattgaatcagtcactctaaagctagttattcc

SEQ ID NO: 35200 - protein, 330 aa, Panicum virgatum
  misc_feature: Ceres CLONE 1959502
  misc_feature: SWISSPROT Homolog: EC 2.7.11.1 Non-specific serine/threonine protein kinase
  misc_feature: Functional homolog of the protein sequence given in SEQ ID NO 50266
  misc_feature: Useful for making plants with altered cell wall content and/or composition
MRRAPELPLLLAAALLALAAAPGLARAATDAADVSAINGLYVALGSPTLPGWTGNGGDPYGELWQGIVCTGSTITGITMNAANLGGQLGSLGNFTSIIIINLSNNKIGGSIPEDLPITLQQLFLSANQLTGSIPSSLSKLKNLTAMSVNGNNLNGDLPDAFDSLNGLVNLDISSNNLTGVLPPSMKSLASLTTLHMQDNQLSGTLNVLQDLPLKDLNIENNQFSGPVPASLLNIPNFKKDGNPFNTSIAPSASPPSPSIGPAPTPTPAGPKPASTPASAPTSSNSTPASAPPSPPSFTQDRRVEVQPFVHLVVDDKNPCNFCGRDIIAGS

SEQ ID NO: 35201 - DNA, 606 bp, Panicum virgatum
  misc_feature: Ceres CLONE 1959520
  misc_feature: Encodes the peptide sequence at SEQ ID NO. 35202
ctcaaatcatctctaaacagctacctaatgcaaattttcgttaaaactttgactggcaagaccatcaccctcgatgtcgagccatctgactctattgaaaatgtcaaggctaagatccaagacaaggaaggtatcccccctgatcagcaaagacttatcttcgctggtaagcaactcgaagatggcagaaccctttccgactacaacattcaaaaggaatccactcttcacttggtcctcggacttagaggtggtatgcaaatcttcgtcaagactttgactggcaagaccatcactcttgacgttgaaccctccgactccattgaaaacgtcaaggctaagatccaagacaaggaaggtatccctcctgatcagcaaagacttatcttcgctggtaagcaactcgaagatggcagaaccctttccgactacaacatccaaaaggaatccactctccatttggtcctcagacttagaggtggtatgcaaatcttcgtcaagaccttgactggtaagaccatcaccctcgatgtcgagccatctgactccattgaaaatgtcaaggccaagatccaagacaaggaaggtatccctcctgatcagcaa

SEQ ID NO: 35202 - protein, 192 aa, Panicum virgatum
  misc_feature: Ceres CLONE 1959520
  misc_feature (82)..(150): Pfam Name: ubiquitin Pfam Description: Ubiquitin family
  misc_feature (6)..(74): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLDVEPSDSIENVKAKIQDKEGIPPDQQRLIFAGKQLEDGRTLSDYNIQKESTLHLVLGLRGGMQIFVKTLTGKTITLDVEPSDSIENVKAKIQDKEGIPPDQQRLIFAGKQLEDGRTLSDYNIQKESTLHLVLRLRGGMQIFVKTLTGKTITLDVEPSDSIENVKAKIQDKEGIPPDQ

SEQ ID NO: 35203 - DNA, 1206 bp, Panicum virgatum
  misc_feature: Ceres CLONE 1959523
  misc_feature: Encodes the peptide sequence at SEQ ID NO. 35204
agagagagggagcaaaggcgaagcagccaacaaccggaggcggccgagagagacgaagctcttgagagaattgggagagggagagagagggagggaggaggacgatggaacaggtggaggcgtgctcgtcttcttcctccacgaccctgatgaggcagtgcaggatttgccatgacgaggaggactagggcggcgcgaccaccatggagtcgccgtgcgggtgctccggctccctcaagtacgcgcacaggggatgcgtgcagcgctggtgcgacgagaaggggagcaccctctgcgagatttgccttcagaatttcgagcctggctacaccgctcctcccaagaaaaaccaacctgctgatgtcgcggtcaccatcagagagagcctggaggtgcccaggatggactacgagccggcagcggaggaggaggacgtcgacgcggcggtggccggcgccggcgacccggagtacgccgagtgcgcccgcgccgccgacaggagcgcgtcctggtgccgctcggtggccgtgacgttcacggtcgtgctgctgctgaggcacctggtcaccgtggcgacggtcggagcggcgaaccagttcgccttcagcctcctcacggtgtacttgctgcgggcgagtgggatcctgctgccgttctacgtcgtcatgaggctcatctccgtgatccagcagggtcagcggcagtaccgcctgcaggtcctccaggagcagaggagacacgcgttgagaatggcccggctgcagggtcaggaacagcagcagcatgtcatcctggttcgctgaggaagaagacggcattcatcaagtgttcatatgtcttgtacaaggttgtaaaatgtaccacttgttcagggggcacggggaaaagcgagcattgtttacaagcttccgtttatgtgcgtacatcacttgcaatgaaagctgcatcaacctgagtacttgacgtcgccgcatgcctaaaacctggaaataaaaaatcctgctcaagaggtcgacaaaagaagcattggattactgttgagtccatcaccctctcgttcatgaattactatgatgtactgatgtggtactaccaccgcaatgtaaataagagcacgacagtgatcctgcatggatccacccaccaacatcattcccttttcaattttcgcttcatttgatggggggcccacggcaatcccctctg

SEQ ID NO: 35204 - protein, 199 aa, Panicum virgatum
  misc_feature: Ceres CLONE 1959523
  misc_feature (1)..(34): Pfam Name: zf-C3HC4 Pfam Description: Zinc finger, C3HC4 type (RING finger)
MESPCGCSGSLKYAHRGCVQRWCDEKGSTLCEICLQNFEPGYTAPPKKNQPADVAVTIRESLEVPRMDYEPAAEEEDVDAAVAGAGDPEYAECARAADRSASWCRSVAVTFTVVLLLRHLVTVATVGAANQFAFSLLTVYLLRASGILLPFYVVMRLISVIQQGQRQYRLQVLQEQRRHALRMARLQGQEQQQHVILVR

SEQ ID NO: 35205 - DNA, 672 bp, Panicum virgatum
  misc_feature: Ceres CLONE 1959534
  misc_feature: Encodes the peptide sequence at SEQ ID NO. 35206
accgagagtattgaggctgttagaatgtccaagcgtgctggatggggagtgatggcaagccacaggagtggtgagacagaggacaccttcattgctgacctctcggttgggctagctacgggtcaaatcaagacaggagctccctgccgttctgagcgcctggccaaatacaaccagctgctcaggatcgaggaagagcttggtgctgtggctgtctatgccggagcaaagttcagggcaccagtggaaccctactaaacacccttcttagaacctgaagatgagcatgtgttctggtggtgtcactagtttgctgcagcattttagtacgagtctgtatcattacaataagatcttgtgtaccataaaagcttcctgtgtcatttgcacatgccatatcaccaatggctggacaattcatataagtggtgattttgtcgtgcaatttctggtagttttggtgggtgacgatctgcacccgtaaaggttttgtccaaacggatttctgaacagtttgggttgtgccataaagatgtattttgctttttgccggatgtgagcttctatactcttaaccatttcagaatgtaatgtgatgccccctcacgtggccacagcttccgcttgtacggcccaaattacaattcattttgatttttatagatacatata

SEQ ID NO: 35206 - protein, 85 aa, Panicum virgatum
  misc_feature: Ceres CLONE 1959534
  misc_feature: SWISSPROT Homolog: EC 4.2.1.11 Phosphopyruvate hydratase
TESIEAVRMSKRAGWGVMASHRSGETEDTFIADLSVGLATGQIKTGAPCRSERLAKYNQLLRIEEELGAVAVYAGAKFRAPVEPY

SEQ ID NO: 35207 - DNA, 649 bp, Panicum virgatum
  misc_feature: Ceres CLONE 1959545
  misc_feature: Encodes the peptide sequence at SEQ ID NO. 35208
cgcgacccctctacacagctccatccctccctcccgaaatgaacacggtcatctactacgctgccctccgcggtattgattacttggctgaggccgtcaccgtcgaggctgaggctgcccccgccaagaccgagaccaagccctccgctgcccccgccaaggaggccgctcccgccaagaaggccgaggaggaggtggatgaggacgaccttttcggaggcgtcgatgaggaggagctcgctgccgagaagaagaggcgcgaggccgacaagaagcaccacaagaaggctgaggagatccagaggtccaacatcatcttcgacgtcaagcccctcggtgacgacactgacctgaacgagatggagaaggtagtgagggccatcaccatcgacggtctcacctggggtccttccaagttcgtcgccattgcgtacggcgtgaagaagctccagatcagctgcgtcgttgttgacgacaaggtgtacactgaggacattgaggagcagatcatggcgcacgaggaacttgtgcagtccgtcgacattgcctccttcaccaaggtgtaaaagagcctccaagccccactcccctgaccacccccaccttgataataaagaagatgacactaagtcaaaaattctttcttatg

SEQ ID NO: 35208 - protein, 175 aa, Panicum virgatum
  misc_feature: Ceres CLONE 1959545
  misc_feature (89)..(175): Pfam Name: EF1_GNE Pfam Description: EF-1 guanine nucleotide exchange domain
MNTVIYYAALRGIDYLAEAVTVEAEAAPAKTETKPSAAPAKEAAPAKKAEEEVDEDDLFGGVDEEELAAEKKRREADKKHHKKAEEIQRSNIIFDVKPLGDDTDLNEMEKVVRAITIDGLTWGPSKFVAIAYGVKKLQISCVVVDDKVYTEDIEEQIMAHEELVQSVDIASFTKV

SEQ ID NO: 35209 - DNA, 528 bp, Panicum virgatum
  misc_feature: Ceres CLONE 1959560
  misc_feature: Encodes the peptide sequence at SEQ ID NO. 35210
cactcgataaactttgttttaataaattccaagagagtactttcttgaggagacactgccaagatggagtcgtcacgcaagttcttacctgcctttgtcctcctgcttctcatcgtctcagccaaagatatggcggccgtccaggcgagggagtgcgagaaggatagtgccaaattcgttgggctttgcatgaatgtacacaactgcgcccatgtgtgccgtggtgaagggttcgcctctgccaggtgcagcacattccgccgtcgctgcgtctgcattaagccgtgctagatcaagtggaggatgcgcgtgagaccgccggccgatatgatcgaccaccagatgcctgcatcgtcaagttattctgtcatacatggtatacctgcatcatgcatgtatctatgtgtggcacaccttcgataagcagttcaacttattgaaaggcttgtgcttaatttgcttcacacaacaataaacctagcagatatttgcttatcaaaaaacaaaaacacaaaaaaaaaaaaaaac

SEQ ID NO: 35210 - protein, 75 aa, Panicum virgatum
  misc_feature: Ceres CLONE 1959560
  misc_feature (29)..(75): Pfam Name: Gamma-thionin Pfam Description: Gamma-thionin family
MESSRKFLPAFVLLLLIVSAKDMAAVQARECEKDSAKFVGLCMNVHNCAHVCRGEGFASARCSTFRRRCVCIKPC

SEQ ID NO: 35211 - DNA, 669 bp, Panicum virgatum
  misc_feature: Ceres CLONE 1959582
  misc_feature: Encodes the peptide sequence at SEQ ID NO. 35212
agcgcaggccgccgagttcccccaagaaacgtctcctctgatcctctctccctccctcttcatcagttcgtcagcggcctccctccgctcaccattcttgccatggctctagattctgttcctacctatctcagcgacttgggatcagcccacagggctgccagaacccagcagcaaaggatcagcatcaggaaagatgagcgcacctggacctcggacacttacgctccgtatgatgacgggcaccagtggaggaagtacggcgagaagaagctctccaactccaacttcccaaggttctattacagatgcacctacaagaacgacatgaagtgccctgccacaaagcaagtccagcagaaggacaccagcgatcctccattgttttctgtcacttacttcaaccagcacacctgcagcaccagctcaaatcccatgggaagcacgagagatattgctgcgccatcgtcgtcgaggaaggcggtatcaatctgcttcagcccgcacacagccaatgagcagcccacattcttgacaacctcggcgacgcattctttcagagccaatcaacaaccagagaggagcccctatgcaagccagtttcagtggacaacctcatcgtcacctacaggtaacagtccggttacgattgaggttgacagtatttca

SEQ ID NO: 35212 - protein, 188 aa, Panicum virgatum
  misc_feature: Ceres CLONE 1959582
  misc_feature (44)..(107): Pfam Name: WRKY Pfam Description: WRKY DNA -binding domain
MALDSVPTYLSDLGSAHRAARTQQQRISIRKDERTWTSDTYAPYDDGHQWRKYGEKKLSNSNFPRFYYRCTYKNDMKCPATKQVQQKDTSDPPLFSVTYFNQHTCSTSSNPMGSTRDIAAPSSSRKAVSICFSPHTANEQPTFLTTSATHSFRANQQPERSPYASQFQWTTSSSPTGNSPVTIEVDSI

SEQ ID NO: 35213 - DNA, 620 bp, Panicum virgatum
  misc_feature: Ceres CLONE 1959595
  misc_feature: Encodes the peptide sequence at SEQ ID NO. 35214
ttcactgtgattgttgcacagaagaaccaccacacaaggtttttcgagcccaaaggccccagagacgacaatgtgactaatgtccctgctggtactgttgtggacacgggaatctgccatcccaggaactacgatttctacatgtgtgcacatgctggcatgattgggacaactaggccaacacattaccatgtgttgcatgatgagattggcttctctccagatgacctgcaggagctcgtgcactccctctcatatgtgtatcagaagagcacctcagccatatcagtcgttgccccggtgtactacgcgcacctggcggcggcgcaggtcaggcagttcgtcaggttcgacgacatgtcggaggccgcgtcgtcggccagcggcaccccttcgcccctgccggagctgcctcggctgcatgagaatgtcaggtcttccatgttcttctgctgagtttgagctgcggatcggatagctggttccatgttcttctaatgacaattcagcttggcatttccgttccatgtttggacgccagactatgcttttgattttgcttttgcacctggttgatgatggctatttgttctctaggcgcttacttggatctgaactct

SEQ ID NO: 35214 - protein, 151 aa, Panicum virgatum
  misc_feature: Ceres CLONE 1959595
  misc_feature (1)..(116): Pfam Name: Piwi Pfam Description: Piwi domain
  misc_feature: The sequence is a functional homolog of SEQ ID NO 2 in the 11/375,241 US patent application
  misc_feature: The sequence is a functional homolog of SEQ ID NO 2562 in the 10/374,780 US patent application
FTVIVAQKNHHTRFFEPKGPRDDNVTNVPAGTVVDTGICHPRNYDFYMCAHAGMIGTTRPTHYHVLHDEIGFSPDDLQELVHSLSYVYQKSTSAISVVAPVYYAHLAAAQVRQFVRFDDMSEAASSASGTPSPLPELPRLHENVRSSMFFC

SEQ ID NO: 35215 - DNA, 624 bp, Panicum virgatum
  misc_feature: Ceres CLONE 1959614
  misc_feature: Encodes the peptide sequence at SEQ ID NO. 35216
gacctgggcagtctacttggagccacctatgcttgtattttcttccttggagctgcaaatttgctcacagctcttccggttttttctatcgaaagaacagtcttctatcgtgaaaaggctgctgggatgttctctccattgtcctatgcatttgctatgacagccgtggagtttctctactgcatagctcagggtattctttatactatccctatctacactatgattggctatgactggaaggcagacaagtttttctacttcctgttctttatcaccgcaagcttcctctacttctcgatgtttggtgccatgctgatttcctgcactccttcccaaatacttgcaagtattcttgtctcaatcattctcacatgttggaacattttctctggattcctcataacccgaccggcattgcctgtctggtggcgatggttctactggtgtaacccggtggcctgaaccatctacggcgttattgcgtcgcagtttggcgacataaaccgcacggttacagttcctggcaaccccgataaaatagtgaaggaaattttgaaagaaacttatggcatgaagcatgacttcctcggctacgtcgtgctggcgcactttggctacatc

SEQ ID NO: 35216 - protein, 154 aa, Panicum virgatum
  misc_feature: Ceres CLONE 1959614
  misc_feature (2)..(154): Pfam Name: ABC2_membrane Pfam Description: ABC-2 type transporter
DLGSLLGATYACIFFLGAANLLTALPVFSIERTVFYREKAAGMFSPLSYAFAMTAVEFLYCIAQGILYTIPIYTMIGYDWKADKFFYFLFFITASFLYFSMFGAMLISCTPSQILASILVSIILTCWNIFSGFLITRPALPVWWRWFYWCNPVA

SEQ ID NO: 35217 - DNA, 459 bp, Panicum virgatum
  misc_feature: Ceres CLONE 1959629
  misc_feature: Encodes the peptide sequence at SEQ ID NO. 35218
tgcttccctccctacagccgccgccgcctctcccagcctccgtcgccgccgccgcttcctcagccatgggtaaggtgcacggatcgttggcccgtgccgggaaggtccgcggccagacgcccaagggggcgaagcaggacaaaaaaaaaaagccccgcggccgcgcgtacaaaaggatgcagtacaaccgccaattcgtcaccgccgtcgtcggcttcggcaagaagcgcgggcccaactcatcaaaaaagtaggcgccgcgccgcgcagccgccggctcgccccgctccggttcctcctttccgttctcagtatgcttatgctcttgttggtagtagtttcgttgtgcaagcaaaggaaaaaccttttgtagtttcagtttcgttgttcatgtgatgtgatgggaacttgaaatggtatgtttaccccgtttaaaagtttgagatgtgatgatatgag

SEQ ID NO: 35218 - protein, 62 aa, Panicum virgatum
  misc_feature: Ceres CLONE 1959629
  misc_feature (3)..(61): Pfam Name: Ribosomal_S30 Pfam Description: Ribosomal protein S30
MGKVHGSLARAGKVRGQTPKGAKQDKKKKPRGRAYKRMQYNRQFVTAVVGFGKKRGPNSSKK

SEQ ID NO: 35219 - DNA, 638 bp, Panicum virgatum
  misc_feature: Ceres CLONE 1959635
  misc_feature: Encodes the peptide sequence at SEQ ID NO. 35220
cactgccaggcgccacccagccaagcaaggtagatagcggctagctttggacggtaccctccctagctggtggtggcagttagcgatcgatgaccgccggcgacgtgcggtccgtctccatccggggcacccgcacggggtggcagcccatgtcccggaactggggccagaactggcagagcaacgccttcctcgacggccaggcgctctccttccaggtcaccgccagcgacggccgcgccgtcaccagcaacaacgccgcgccgcgcggctggcagttcggccagaccttcgagggcgcccagttctgatgcccttccgtcttctcccctccgactcgatccatcgtctccacagcaagcaagcaccggggacgacgacggggaggggttatattaattaatcaagctgttattgatcattgggtgatcctcgatttgtttggggttttcttttttttgccgtttcgcacgtgatgatgggatggggaaggtgaggccctcttcgactatattgaacaagagaagagggcctcgcgctatgctgaggctgctaatctagcacccgcctagacgacgtttccttctctggactctgctggatcggagtgaatgaatgaatgacacattactctccct

SEQ ID NO: 35220 - protein, 73 aa, Panicum virgatum
  misc_feature: Ceres CLONE 1959635
  misc_feature (3)..(59): Pfam Name: Pollen_allerg_1 Pfam Description: Pollen allergen
  misc_feature: Functional homolog of the protein sequence given in SEQ ID NO 50486
  misc_feature: Useful for making plants with altered carbohydrate content
  misc_feature: Functional homolog of the protein sequence given in SEQ ID NO 51478
  misc_feature: Useful for making plants with altered cell wall content and/or composition
  misc_feature: Functional homolog of the protein sequence given in SEQ ID NO 50489
  misc_feature: Useful for making plants with altered lignin content
MTAGDVRSVSIRGTRTGWQPMSRNWGQNWQSNAFLDGQALSFQVTASDGRAVTSNNAAPRGWQFGQTFEGAQF

SEQ ID NO: 35221 - DNA, 474 bp, Panicum virgatum
  misc_feature: Ceres CLONE 1959639
  misc_feature: Encodes the peptide sequence at SEQ ID NO. 35222
aggcaagaagaaagcactccacctcaagaacatagctagcgatcagcggctagcccgcaagccagccattgccgccattccaaggatggcgatggccgtccacctcaggaagcctgtttgggctatcctcctcgttgccttcctctgcttgacatgctctgtttctgctcatcatttcgacgacgactacggccatggcccgaaagggtacgggcacggtccgcgcttcggccgcgggccgttcggccgtgactgccgcttcggccgctgccgcggcggcggcggcggatttggaggcggtggaggctttggaggcggaggtggagctgggggcggccttggtggtggcggcgggatgggcggtggaggaggtggcggagggggcggtggccttggaggtggaggtggtgcaggaggctgctttggtggcggggccggtgggggaggtggtgcaggaggctggcttggtggtgg

SEQ ID NO: 35222 - protein, 129 aa, Panicum virgatum
  misc_feature: Ceres CLONE 1959639
  misc_feature: Functional homolog of the protein sequence given in SEQ ID NO 50702
  misc_feature: Useful for making plants with altered lignin content
MAMAVHLRKPVWAILLVAFLCLTCSVSAHHFDDDYGHGPKGYGHGPRFGRGPFGRDCRFGRCRGGGGGFGGGGGFGGGGGAGGGLGGGGGMGGGGGGGGGGGLGGGGGAGGCFGGGAGGGGGAGGWLGG

SEQ ID NO: 35223 - DNA, 566 bp, Panicum virgatum
  misc_feature: Ceres CLONE 1959677
  misc_feature: Encodes the peptide sequence at SEQ ID NO. 35224
aaaatcaccaccgagctctctcgatttcaatctcaccaccacctccgagctaggagccatgtcgggccgcggcaagggaggcaaggggctgggcaagggcggcgcgaagcggcaccgcaaggtcctccgcgacaacatccagggcatcaccaagccggcgatccggaggctggcgcgcaggggcggggtgaagcgcatctccggcctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagatccgccttgggtgccaggctggtcgatggtgctagggttagcaatggtgtttggcgttcgttccatctgatgtgatgtctggagcctggaggtgtctccgactccgtgtctgttttgtgcaaagtagtaatgtgtctctgattggaaatggagtccgaggcttatgaatgaaatcgatctgtgtttacttttct

SEQ ID NO: 35224 - protein, 103 aa, Panicum virgatum; identical to SEQ ID NO: 12044
  misc_feature: Ceres CLONE 1959677
  misc_feature (25)..(94): Pfam Name: Histone Pfam Description: Core histone H2A/H2B/H3/H4

SEQ ID NO: 35225 - DNA, 1025 bp, Panicum virgatum
  misc_feature: Ceres CLONE 1959678
  misc_feature: Encodes the peptide sequence at SEQ ID NO. 35226
acccgaaactccagtttcactcaagcagccagaggtttatgtttagtttcccttaccagcacaaagacgaaaaagtatcaaacaactacatttctgaacaaattattcccaaatgcctttaattaacaagatcaacaaattttctattcgcagactagctaccctctctaataacggcttccttacaaagcaaacgccagaaagcccttctttccctgccaccttgcgtctcaacactggtcacacttttaatgctacttcttttggtgccgtcaaaccaatcacttctggtgaagtcgtgtttactacttctctagttggatatcccgagtcaatgactgatccatcctatcacggccaaatcttggttttcacacaacctctggtcggcaattatggcgtccctcctcctactttggacaagtacggacttcacaagtactttgaaagcagcaagatccaagtttctggcattattgtcaatgactatgctgccmmgtactctcactggaatgctatcgagtctcttggacaatggtgtacccgctatggagtcccagccctaactggtgtagacactcgtgcagttgtcactttgttgcgtgaaagagggtctactgtcggacatatctctattggtgaggaagcaatggcgcaagagcctccagaatacactgatgactctgctgagtggatcaataccgtttctcgcaaggacattcgtgttttcaactttaatggcaaaacaaaaatcgctttagtagactgtggagccaaggacaatattattaggtgtttggtagaacgcggtgcccaagttactgctttcccacatgactatgatttttcctctaaattatctgaatttgatggtgtattcctttcaaatgggccaagagatccaaaaaatgctaccaaaactactgaagtcgtcaaaaaggatcttgccaaatcaagcgccatgaaaattccagtaccaatttttggcatttgcatgagtcatcaagaacttgaataagcagatg

SEQ ID NO: 35226 - protein, 301 aa, Panicum virgatum
  misc_feature: Ceres CLONE 1959678
  misc_feature (34)..(188): Pfam Name: CPSase_sm_chain Pfam Description: Carbamoyl-phosphate synthase small chain, CPSase domain
  misc_feature: SWISSPROT Homolog: EC 6.3.5.5 Carbamoyl-phosphate synthase (glutamine-hydrolyzing)
  misc_feature (129)..(129): Xaa is any aa, unknown, or other
MPLINKINKFSIRRLATLSNNGFLTKQTPESPSFPATLRLNTGHTFNATSFGAVKPITSGEVVFTTSLVGYPESMTDPSYHGQILVFTQPLVGNYGVPPPTLDKYGLHKYFESSKIQVSGIIVNDYAAXYSHWNAIESLGQWCTRYGVPALTGVDTRAVVTLLRERGSTVGHISIGEEAMAQEPPEYTDDSAEWINTVSRKDIRVFNFNGKTKIALVDCGAKDNIIRCLVERGAQVTAFPHDYDFSSKLSEFDGVFLSNGPRDPKNATKTTEVVKKDLAKSSAMKIPVPIFGICMSHQELE

SEQ ID NO: 35227 - DNA, 521 bp, Panicum virgatum
  misc_feature: Ceres CLONE 1959698
  misc_feature: Encodes the peptide sequence at SEQ ID NO. 35228
ctctagggtttcctcgccaccgccgcttccgccttcgccgccgcagccgcagccatggtacgtatcctgtgggcttaagttctcgaattcatgcgctcgtactggtggtctggtgccccccgctcatctcacgctttgcctcgtcgcgtttgttcccgtcccccgcgcagccgtcccacaagaccttccggatcaagaagaagctggccaagaagcagcgccagaaccgccccatcccctactggatccgcatgcgcaccgacaacaccatcaggtacaacgcgaagcgcaggcactggcgccgcaccaagctcggattctgagcgggggaagagatgccgggcaccgatgcttggggaaactcgtgattacgagccggcctcgggacgcttccatgattccgcatgctaggaagctgcttgtttagattttgcttgtgttaaattgatcttatcagttgtttctgtagcgaactgagaataccatgttttgctgatggttggagaacatcatttataatt

SEQ ID NO: 35228 - protein, 106 aa, Panicum virgatum
  misc_feature: Ceres CLONE 1959698
  misc_feature (64)..(106): Pfam Name: Ribosomal_L39 Pfam Description: Ribosomal L39 protein
LGFPRHRRFRLRRRSRSHGTYPVGLSSRIHALVLVVWCPPLISRFASSRLFPSPAQPSHKTFRIKKKLAKKQRQNRPIPYWIRMRTDNTIRYNAKRRHWRRTKLGF

SEQ ID NO: 35229 - DNA, 666 bp, Panicum virgatum
  misc_feature: Ceres CLONE 1959700
  misc_feature: Encodes the peptide sequence at SEQ ID NO. 35230
gcaaaaagtgtacggggacggtattcgactccagcagatcctctctgacttcctatttgtttcggtgaagttctctcctgttggaggttctgttggtatcacttccaaactgactaagaacagcattggggaaaacctccatctcataaacctggagcttaggatcaagcaccagggaacaggtgttccagcaaaaatactagcacaaatgtatgaggaggacaataaggaacagtcagaagagggcttgagccttctagtttctagaaatcttctgaggctaatgaatggtgacattcgtcacctgagggaagctgggatgtcaaccttcattctcaccgcagaacttgcctctgctcctgccgccagtggacattgaagccaacactgcaagtagtggtttcaaatgctccttttcagttcattcagaaagccaaatggttcgtggagaatgggagtgctgcaggctgtacggccgccgaatgcataaataagattgacttgtatggttgtttgtcaagtggggaaaggttgtacgggcatacttctgccctgtttctacctgttatccaactgtgtagtttttttctcttccagaaacagaaaatcctaccgtgtagtaagcttgaagtttaagttaacatgaataaaccgtcaaatttagct

SEQ ID NO: 35230 - protein, 125 aa, Panicum virgatum
  misc_feature: Ceres CLONE 1959700
  misc_feature (5)..(117): Pfam Name: HATPase_c Pfam Description: Histidine kinase-, DNA gyrase B-, and HSP90-like ATPase
  misc_feature: SWISSPROT Homolog: EC 2.7.13.3 Histidine kinase
  misc_feature: Functional homolog of the protein sequence given in SEQ ID NO 51315
  misc_feature: Useful for making plants with modulated biomass
  misc_feature: Useful for making plants with modulated light quality response
  misc_feature: Useful for making plants with modulated light quality sensitivity
QKVYGDGIRLQQILSDFLFVSVKFSPVGGSVGITSKLTKNSIGENLHLINLELRIKHQGTGVPAKILAQMYEEDNKEQSEEGLSLLVSRNLLRLMNGDIRHLREAGMSTFILTAELASAPAASGH

SEQ ID NO: 35231 - DNA, 405 bp, Panicum virgatum
  misc_feature: Ceres CLONE 1959747
  misc_feature: Encodes the peptide sequence at SEQ ID NO. 35232
aaatcagctcaacgaccaaagagcgtctagccgcccgccgcccgcgctcgcaaaggagaccgacagacagacaccgcgcggcgcgcagcatgcgtccagtagctcgccacgtcggcctcgcggcggccgcgctcctcgccgccgccctcctgctcggcggcgcggccagggcgcaggaggagacggagcacgaggaggaattcagctacgcccgcggcggcgagcacgggccggagcactggggcgagatcaagccggagtgggcggcgtgcggcgccgggcggatgcagtcgcccatccacctctcccaccagcgcgtctcgctggtgcgctccctcggctacctcgaccacgcctaccgccccgcccaggcctccatcgtcaaccgcggcctctacttcttgg

SEQ ID NO: 35232 - protein, 105 aa, Panicum virgatum
  misc_feature: Ceres CLONE 1959747
  misc_feature: SWISSPROT Homolog: EC 4.2.1.1 Carbonate dehydratase
MRPVARHVGLAAAALLAAALLLGGAARAQEETEHEEEFSYARGGEHGPEHWGEIKPEWAACGAGRMQSPIHLSHQRVSLVRSLGYLDHAYRPAQASIVNRGLYFL

SEQ ID NO: 35233 - DNA, 687 bp, Panicum virgatum
  misc_feature: Ceres CLONE 1959749
  misc_feature: Encodes the peptide sequence at SEQ ID NO. 35234
acgggcttatgtgttcgttcactccactgagctagttaatgcgctgagggatggtgttagcaggcaggaggtgcaggctggccgtgacagccctgctgctgctccatgcgctgcttggtgatgccagcagcggcagcagcggcgccgtcgagcccgagacccagctgtctgcttcagggtgccgcggtgctcgcctgccgcccggcggcgttccggcggcgggcactacttggcctccgcgtgcggatgccgtcgtggcaaaggagggaggctgcggcaacgacttcgcctgcttcacgacgatccaacaagctcttaaggcagcaccggatctcgtgccatgcgagaagcagcgctacgttgtcctcgtcaagtccggcgtctatgaggaaccgttcatcaaaataacaaggaaaaacgtcatgttgcgaggcagttatctacttgcattgcttacatacgttggtaggggcatgatttactcaatcgatccgcgtgttaaaagtttgtgatgtcgtacatgcctgcgttgcccgctcggaacggatttatttcatacgtactagtatatgtatcatagttgcttctctttaatttgatctatctggtcatctcgtcattgtcaaattaattccatctttttacctccatcatcatgtacatatggatccaatgatccctttcttc

SEQ ID NO: 35234 - protein, 153 aa, Panicum virgatum
  misc_feature: Ceres CLONE 1959749
  misc_feature: SWISSPROT Homolog: EC 3.1.1.11 Pectinesterase
MVLAGRRCRLAVTALLLLHALLGDASSGSSGAVEPETQLSASGCRGARLPPGGVPAAGTTWPPRADAVVAKEGGCGNDFACFTTIQQALKAAPDLVPCEKQRYVVLVKSGVYEEPFIKITRKNVMLRGSYLLALLTYVGRGMIYSIDPRVKSL

SEQ ID NO: 35235 - DNA, 563 bp, Panicum virgatum
  misc_feature: Ceres CLONE 1959755
  misc_feature: Encodes the peptide sequence at SEQ ID NO. 35236
aaaccctacctcgcagcgccgcctagcccaagcagccgagcgaggaagcgaagactcaccccccccccccacccccccccgagccagagcaccttgggggcggggggggtttgtggtggcctgggggggaggcttggcgtcgaggacgccctcgagctgcagctttaccgcttccgcttccccctgtcctccaagaacgttgagaacttggtgaaagtttgtggggatttggtgaagggagccaaggatgaggggttgagggttaagggagctgtctggatccgttctaaggttctccacatcaccacccgcttgtggcgttggggtgaaggaacgaacacatgggatcgctttgagttccgcatcggcgagagggtggttgacctgatcagctccccggatgtggtgaagcagatctcctccttcacccttgagcctggggtcgaggtcgaggtgaccatcgcggatgtgtaatgccttgcagtttagctgttatacactatccgtatattgcgttggtttagtttttgtgctcgctttgtgtgcttgtatgagacatctga

SEQ ID NO: 35236 - protein, 157 aa, Panicum virgatum
  misc_feature: Ceres CLONE 1959755
  misc_feature (57)..(152): Pfam Name: Ribosomal_S10 Pfam Description: Ribosomal protein S10p/S20e
  misc_feature: Functional homolog of the protein sequence given in SEQ ID NO 50532
  misc_feature: Useful for making plants with modulated biomass
  misc_feature: Useful for making plants with modulated flowering time
  misc_feature: Functional homolog of the protein sequence given in SEQ ID NO 50533
  misc_feature: Useful for making plants with modulated phosphate use efficiency
KPYLAAPPSPSSRARKRRLTPPPHPPPSQSTLGAGGVCGGLGGRLGVEDALELQLYRFRFPLSSKNVENLVKVCGDLVKGAKDEGLRVKGAVWIRSKVLHITTRLWRWGEGTNTWDRFEFRIGERVVDLISSPDVVKQISSFTLEPGVEVEVTIADV

SEQ ID NO: 35237 - DNA, 655 bp, Panicum virgatum
  misc_feature: Ceres CLONE 1959764
  misc_feature: Encodes the peptide sequence at SEQ ID NO. 35238
agatgcgcaaacaccggatcgccggactcgtggctgccctgctcgccctcgccctcgccctctccctctccctctcgtccctccgcaccgcgcaagaggagccgcccatggcggacagcgggcctctggcgggcggcgtcacggacgtgccgcagaacgaaaacgacatccacctacaggagctcgcccgcttcgccgtcgacgagcacaacaagaaggccaatgctctcctggggttcgagaagcttgtgaaggcgaagacgcaagtggttgctggaaccatgtactatctcactgttgaggtgaaggatggggaagccaagaagctctatgaagctaaggtctgggagaagccatgggagaacttcaaggagctgcaggaattcaagcctgttgaagagagtgctagcgcttaaggatatctcgtcttccacgtgcaattgctacctgaagcactaaacagacttgcagaataaggagctggttcggatgtataatagatgtgctgttgcgagctccgttgtgtagtatcataagatcaccttgccctttgtgtaatatcatgaataacggtgtcctttgtgtaaaatcatgaattcagtgccctttatgtgtaacattataaataaataacaggggctgagtattcatcagt

SEQ ID NO: 35238 - protein, 137 aa, Panicum virgatum
  misc_feature: Ceres CLONE 1959764
  misc_feature (44)..(132): Pfam Name: Cystatin Pfam Description: Cystatin domain
MRKHRIAGLVAALLALALALSLSLSSLRTAQEEPPMADSGPLAGGVTDVPQNENDIHLQELARFAVDEHNKKANALLGFEKLVKAKTQVVAGTMYYLTVEVKDGEAKKLYEAKVWEKPWENFKELQEFKPVEESASA

SEQ ID NO: 35239 - DNA, 824 bp, Panicum virgatum
  misc_feature: Ceres CLONE 1959789
  misc_feature: Encodes the peptide sequence at SEQ ID NO. 35240
aaatatatcttatatatataattaaagcagcgaagcgaaatgcccccaaaaaagttcggaaagaagactaaggtcaccaaggcctccaaggtcaagagaaaccccctcttcgaaaagaaacccagaaacttcagaattggtggtgatatccaacccgtcagagatttgaccagattcgtcagatggcccaaatacattatcctccaaagacaaaagagagtcctcctccaaagactcaaggttcccccagcattgaaccaattccaatccaccatcgacagaaatcaagccaccactctcttgaagctcctcagaaactacgctcctgaaacccccgaaaagagaagagaaagaagattggaagctgctaagcttaaggctgaaaacaaggcccccgctgacaccaaggcccccattgcccttaagtacggtttgaataacgtcactggcctcatcgaagacaagaaagctagactcgtcatcatcgccaacgatgttgaccccatcgaaactattgtctggcttccccaactctgcagaaagcaagacattcctttctgcttcatcagaggtaaggcaagactcggtaaattggttggccttaagaacgcctcctgcgttgccctcaccggtatcagaaaggaagatcaagctactttcgataacttggttaagactttcaaggctcaattcaacgaaaacgtctccctcagaagagaatggggtggtggtcttttgggacacaaatccagacaagctcaagaagccaagcaaagagctattgaagctgaacaactcaagaaggctgctctttaaatagtcgg

SEQ ID NO: 35240 - protein, 258 aa, Panicum virgatum
  misc_feature: Ceres CLONE 1959789
  misc_feature (113)..(205): Pfam Name: Ribosomal_L7Ae Pfam Description: Ribosomal protein L7Ae/L30e/S12e/Gadd45 family
MPPKKFGKKTKVTKASKVKRNPLFEKKPRNFRIGGDIQPVRDLTRFVRWPKYIILQRQKRVLLQRLKVPPALNQFQSTIDRNQATTLLKLLRNYAPETPEKRRERRLEAAKLKAENKAPADTKAPIALKYGLNNVTGLIEDKKARLVIIANDVDPIETIVWLPQLCRKQDIPFCFIRGKARLGKLVGLKNASCVALTGIRKEDQATFDNLVKTFKAQFNENVSLRREWGGGLLGHKSRQAQEAKQRAIEAEQLKKAAL

SEQ ID NO: 35241 - DNA, 562 bp, Panicum virgatum
  misc_feature: Ceres CLONE 1959797
  misc_feature: Encodes the peptide sequence at SEQ ID NO. 35242
acagcaccccagctcaattctactcataaaacaaaatggccgttgaccaactctccgctgaccaaatcgccgaattcaaggaagccttctcgctcttcgataaggacggcgatggagcaatcacaaccaaggagcttggcactgtgatgcgatcacttggccagaatcctacagaagccgagctcgcccagatgatcgaggaagtggactgcgacaagaatggtacgatcgacttccccgaattcctgaccatgatggcccgcaagatgaaggaggtcgacggtgaggaagagatcaaggaggcattcaaggtcttcgacaaagacggcaacggcacgatctcggctgccgagctccgccacgtgatgaccaacctcggcgagaagctcaccgaccaggaagtcgatgagatgatccgagaagctgacgtcgatggagatggccagatcaactatgaagagttcgtcaagatgatgacttcaaagtaagtcagcggcgcttgtttttcattttgtataataatcactattgacaggcccaatcaaaagagcaaacaaaaacg

SEQ ID NO: 35242 - protein, 150 aa, Panicum virgatum
  misc_feature: Ceres CLONE 1959797
  misc_feature (122)..(150): Pfam Name: efhand Pfam Description: EF hand
  misc_feature (86)..(114): Pfam Name: efhand Pfam Description: EF hand
  misc_feature (13)..(41): Pfam Name: efhand Pfam Description: EF hand
  misc_feature (49)..(77): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 50110
  misc_feature: Useful for making plants with modulated salt sensitivity
MAVDQLSADQIAEFKEAFSLFDKDGDGAITTKELGTVMRSLGQNPTEAELAQMIEEVDCDKNGTIDFPEFLTMMARKMKEVDGEEEIKEAFKVFDKDGNGTISAAELRHVMTNLGEKLTDQEVDEMIREADVDGDGQINYEEFVKMMTSK

SEQ ID NO: 35243 - DNA, 402 bp, Panicum virgatum
  misc_feature: Ceres CLONE 1959823
  misc_feature: Encodes the peptide sequence at SEQ ID NO. 35244
acaagtatccgcgccgcaacggctctgcctctctttcttcctcctccctccctgaacccagcgccgcctagggtttcgccgccatgccgcagggtgaccacatagagctgcaccagaagcgccatgggcggcgcccggactatgaggagcggaagcggaagcgcgaggcccgcgaggtcaagaagcgctcgcagcaggccagaaagctgcttggtgccaagggcaagaggttcgccaagaagcggtatgccgagaaggcacagatgaagaagaccctgaaaatgcacgatgagtcaactacgaggaataaggttgaggatgttcaggaaggagctgtcccgccttatctacttgatcgtgatcagacacaacgggcaaaagttcttagcaacactataaagc

SEQ ID NO: 35244 - protein, 106 aa, Panicum virgatum
  misc_feature: Ceres CLONE 1959823
  misc_feature (1)..(106): Pfam Name: Ribosomal_S8e Pfam Description: Ribosomal protein S8e
MPQGDHIELHQKRHGRRPDYEERKRKREAREVKKRSQQARKLLGAKGKRFAKKRYAEKAQMKKTLKMHDESTTRNKVEDVQEGAVPPYLLDRDQTQRAKVLSNTIK

SEQ ID NO: 35245 - DNA, 309 bp, Panicum virgatum
  misc_feature: Ceres CLONE 1959830
  misc_feature: Encodes the peptide sequence at SEQ ID NO. 35246
accttctctgagtaccctcctcttggtcgcttcgctgtccgtgacatgaggcaaacggttgctgttggagtcatcaagagcgtggagaagaaggacccaaccggagccaaggtgaccaaggctgctgccaaaaagaaatgatgtggctggtggtttatccttatctgcttttgcgatacctagatgcctttttaccacataagttgtctggtgtcattgctgttacagtgaacttttaaggtctgctggaggtgtgcaatttgtatgtttggtgacttatttcagcttctgcaaaacttaaatgctccg

SEQ ID NO: 35246 - protein, 46 aa, Panicum virgatum
  misc_feature: Ceres CLONE 1959830
  misc_feature: The sequence is a functional homolog of SEQ ID NO 576 in the 10/666,642 US patent application
TFSEYPPLGRFAVRDMRQTVAVGVIKSVEKKDPTGAKVTKAAAKKK

SEQ ID NO: 35247 - DNA, 311 bp, Panicum virgatum
  misc_feature: Ceres CLONE 1959877
  misc_feature: Encodes the peptide sequence at SEQ ID NO. 35248
aacaagatgtccgctgctgccgaggataagaagaaacgtgtatttaagaaattcacataccgaggagtcgatttagatcgacttttagaccttcaacatgaagagcttatgactctctttccctgccgagcacgacgaaagttcgctcgtggattgaacagaaaacaactcgctcttatcaaaaaattaagacgtgctaagcaaaacgctgcaaccactggagctgaaaaaccagatgctgtcaaaacccatcttagaaacttgatcattgtcccagaaatgattggatccatcgttggtgtttacaacgg

SEQ ID NO: 35248 - protein, 101 aa, Panicum virgatum
  misc_feature: Ceres CLONE 1959877
  misc_feature (48)..(101): Pfam Name: Ribosomal_S19 Pfam Description: Ribosomal protein S19
MSAAAEDKKKRVFKKFTYRGVDLDRLLDLQHEELMTLFPCRARRKFARGLNRKQLALIKKLRRAKQNAATTGAEKPDAVKTHLRNLIIVPEMIGSIVGVYN

SEQ ID NO: 35249 - DNA, 258 bp, Panicum virgatum
  misc_feature: Ceres CLONE 1959917
  misc_feature: Encodes the peptide sequence at SEQ ID NO. 35250
gagcatgatcgctatgccgcaggaagtcaatttatcacacacacaattgggagggttttgtcacaactgaacctaaagacaactccaattaacacaaagggttacgagagcttgttgcaacttgtaagtagtgaatgtcatgcttgtctccattcttaattgctgagagcttatttgtgacgttgtcatgtataaaccttgcagactcataacactgtaagtgatagttttgatctatactatgggctttttatgtac

SEQ ID NO: 35250 - protein, 52 aa, Panicum virgatum
  misc_feature: Ceres CLONE 1959917
  misc_feature: SWISSPROT Homolog: EC 1.3.1.78 Arogenate dehydrogenase (NADP(+))
EHDRYAAGSQFITHTIGRVLSQLNLKTTPINTKGYESLLQLVSSECHACLHS

SEQ ID NO: 35251 - DNA, 207 bp, Panicum virgatum
  misc_feature: Ceres CLONE 1959923
  misc_feature: Encodes the peptide sequence at SEQ ID NO. 35252
gatcctacagttgtctccaagccttatgaccagtgggtgatgccattgacgaaggacgtcgaagtcgagtatctcctctgccgtctcgactgaccgcaaatcgctgcaaatattatgcgtgatttccagttgtgtcatcagaatgttgtgccttttgtcactgctatattcaaactcaattatcagagaatgctacacattcgcgcc

SEQ ID NO: 35252 - protein, 30 aa, Panicum virgatum
  misc_feature: Ceres CLONE 1959923
  misc_feature: SWISSPROT Homolog: EC 5.4.99.5 Chorismate mutase
DPTVVSKPYDQWVMPLTKDVEVEYLLCRLD

SEQ ID NO: 35253 - DNA, 298 bp, Panicum virgatum
  misc_feature: Ceres CLONE 1959924
  misc_feature: Encodes the peptide sequence at SEQ ID NO. 35254
ctcttacgccttggccttgacgcgctcttcaacgagggcacgcaaacaccatgggtcacgacaacgtctggaactcccaccccaagggctacgggcagggctcccgccactgccgtgtgtgcagcaacgggcacgccatcattcgcaagtatggcctgaacatctgccgtcagtgcttccgcgagtacgccaacgacattggcttcatcaagtacaagtaagcaccatgtttggttaaggcttggaggatttgaggcaactgttttgtggtctttccgtcatgtaatcaatattccac

SEQ ID NO: 35254 - protein, 56 aa, Panicum virgatum
  misc_feature: Ceres CLONE 1959924
  misc_feature (3)..(56): Pfam Name: Ribosomal_S14 Pfam Description: Ribosomal protein S14p/S29e
  misc_feature: Functional homolog of the protein sequence given in SEQ ID NO 50136
  misc_feature: Useful for making plants with modulated nitrogen use efficiency
MGHDNVWNSHPKGYGQGSRHCRVCSNGHAIIRKYGLNICRQCFREYANDIGFIKYK

SEQ ID NO: 35255 - DNA, 370 bp, Panicum virgatum
  misc_feature: Ceres CLONE 1959925
  misc_feature: Encodes the peptide sequence at SEQ ID NO. 35256
cgccaaacgccttctagaagccactggaattgtcattgtccctggttctggttttggacaggtccctggaacatggcacttcagatgcacgatcttgccgcaggaggacaaaataccagcaatcatatctagtttcaaggagtttcacgagaagttcatggatgagttccgtgattaaatatacagacttgtaccaaaacgtgctgacactgggcgtccacctcagactcggcataccatcagatttctgtcagaggcattctgtaattgtctttctgatgaaataataaggtcacccctggcatcccttcatcctttggatgctacaaccaaatttttcccagcttttgttacaggcaaatgttagacg

SEQ ID NO: 35256 - protein, 58 aa, Panicum virgatum
  misc_feature: Ceres CLONE 1959925
  misc_feature: SWISSPROT Homolog: EC 2.6.1.2 Alanine transaminase
  misc_feature: Functional homolog of the protein sequence given in SEQ ID NO 51391
  misc_feature: Useful for making plants with modulated nitrogen use efficiency
AKRLLEATGIVIVPGSGFGQVPGTWHFRCTILPQEDKIPAIISSFKEFHEKFMDEFRD

SEQ ID NO: 35257 - DNA, 369 bp, Panicum virgatum
  misc_feature: Ceres CLONE 1959978
  misc_feature: Encodes the peptide sequence at SEQ ID NO. 35258
ggatcccgacgcccgaccccctgcgcgggctgtctgttgcgaccggagggatacgctgtctgcctgtgttcccacactcggttctgcatgttcggctgttgggttccgcaggcgactgcatccgcggcccccggctgcaggtgcggctcctgctgcggacggtgcctgatgtacccggacatggctgagcattgctccacccccaccacctcccgtactgtcttcattggcgttgcacgcaacaacatggggcacgccgagggcgggttcgaggccagcgccagaaccgagaacggcggctgcgagtgcggcgacaactgcacctgccacccctgcgcctgctagcgaggagctcatggacatggccgg

SEQ ID NO: 35258 - protein, 85 aa, Panicum virgatum
  misc_feature: Ceres CLONE 1959978
  misc_feature (11)..(85): Pfam Name: Metallothio_2 Pfam Description: Metallothionein
MFGCWVPQATASAAPGCRCGSCCGRCLMYPDMAEHCSTPTTSRTVFIGVARNNMGHAEGGFEASARTENGGCECGDNCTCHPCAC

SEQ ID NO: 35259 - DNA, 667 bp, Panicum virgatum
  misc_feature: Ceres CLONE 1959979
  misc_feature: Encodes the peptide sequence at SEQ ID NO. 35260
actaaaaagaagacaagggttgtgacagacacgctatatccaatatggaaccagacatttgattttgtggtagaagatgcactgcatgatttgctcatggtggaactatgggaccatgatacatttggaaaggattacgtagggaggtgcatcttgaccctcacaagagttctactggaaggccagttccaagatacctttgtcttgcaaggttccaaatctggaaagctgaacttgcactttaagtggatgccacagccaatctaccgtgatcgtgaacgggaccagtgaaatatgaatataccttaaatggaaaggaagataaacacatcatcccctacgatgggcctgtacagcaaatccacaaacttggagccacacggttaaaatcaaagaacagatcgaccttctatagtttcccctagacgatggagatgcatgaacccgatgagaagtacttgacacgggtgacttgtgttagatccaatgttcatttatgtagactgatccttagcatagtcagttgttaaatgtggtgtcaatgaactaagccttgtatgctgcttttgtgcgtattcaaaaaaaaatgtgcgcaaaagttagatagttcttacgtttgattttgttcctggttatgcattaggcagaaattgtttgtgcattatgc

SEQ ID NO: 35260 - protein, 96 aa, Panicum virgatum
  misc_feature: Ceres CLONE 1959979
  misc_feature: SWISSPROT Homolog: EC 2.7.11.13 Protein kinase C
TKKKTRVVTDTLYPIWNQTFDFVVEDALHDLLMVELWDHDTFGKDYVGRCILTLTRVLLEGQFQDTFVLQGSKSGKLNLHFKWMPQPIYRDRERDQ

SEQ ID NO: 35261 - DNA, 354 bp, Panicum virgatum
  misc_feature: Ceres CLONE 1959984
  misc_feature: Encodes the peptide sequence at SEQ ID NO. 35262
agatgcggtgtcagggaaaggatattgaggtcttggatcctgcacttagaggaagaggacatgatgagcaaatgctgaatgtgcttgaagtcgcttgcaagtgtatcaaccacaatccttgcctgaggccaaccatccaagaggttgtgtcctgcctggacagtgtaaatgtagacctccaggtgcagatgtagttaaaggacaacagactctaggtggtcatcttgtacttcacctaattagttgtaacttctgtgcaagaatggttttctaacaaattgtactcgtacagtagtgtgtgctgtgtgtaaatctctgaaaagaaaaggcccacggttatgaggccctttatac

SEQ ID NO: 35262 - protein, 63 aa, Panicum virgatum
  misc_feature: Ceres CLONE 1959984
  misc_feature: SWISSPROT Homolog: EC 2.7.11.1 Non-specific serine/threonine protein kinase
MRCQGKDIEVLDPALRGRGHDEQMLNVLEVACKCINHNPCLRPTIQEVVSCLDSVNVDLQVQM

SEQ ID NO: 35263 - DNA, 554 bp, Panicum virgatum
  misc_feature: Ceres CLONE 1960015
  misc_feature: Encodes the peptide sequence at SEQ ID NO. 35264
aacctgaacgccatgaacaagctcaacaccaagaagccgtggtccctgtccttctcctttggccgtgcccttcaggcgagcaccctcaaggcctgggctggcaaggaggagaatgtggagaaggcaaggactgccttcctcaccaggtgcaaggccaactcagaggccacccttggcacgtacaagggtgatgctgccgccggcgaaggcgtctcagagagcctccacgtcaaggactacaagtactgatctgctcccgctttggatctgttggctgcactcatttaggtgagtttggtttgcccgtcagagtgtggttggacatcgaaactcctttgtaataaaatcctgaacttaagcttcccttctgtggatgatggttggctacttgttattcgtatattagtctttttggtggtaatcttgtgtatgcctgatcctgccgacggtaaatcgagcagctgctttttgttgtgtcgttgctgtaatgctggttatataatggaaaagaccatttatgtgctgagctgaccagcacgcagttggattgcact

SEQ ID NO: 35264 - protein, 82 aa, Panicum virgatum
  misc_feature: Ceres CLONE 1960015
  misc_feature: SWISSPROT Homolog: EC 4.1.2.13 Fructose-bisphosphate aldolase
  misc_feature: Functional homolog of the protein sequence given in SEQ ID NO 50216
  misc_feature: Useful for making plants with modulated phosphate use efficiency
NLNAMNKLNTKKPWSLSFSFGRALQASTLKAWAGKEENVEKARTAFLTRCKANSEATLGTYKGDAAAGEGVSESLHVKDYKY

SEQ ID NO: 35265 - DNA, 465 bp, Panicum virgatum
  misc_feature: Ceres CLONE 1960054
  misc_feature: Encodes the peptide sequence at SEQ ID NO. 35266
aaccttgctgaaatccttttcgcctcttctccgctccgctcctcccccatcatctgggctcacccccgcgcgtggattcaagatgctctccagtactacatcaacgagaagggggacaaggtttacaccaccaagaaggagtcgcctctcggtgtgccgacgcagtctgctcatccggctcgcttctcaccagatgacaagtactctcgccagcggtacctgttgaagaagagatttggactgctgccaacccagaagccagcaccaaagtactgaagtttcaactgtccaaccatatggatgttcaatagaaaatcatctgtttcgcagcttgttggctgtaatgtagaatagctatccgagaaaagaaatcaaacactaccatgtgctaccatggtatttctcagcacattcagacgctatgtaatgctatgctattcacatcgtgcttcctgatgttatgtt

SEQ ID NO: 35266 - protein, 91 aa, Panicum virgatum
  misc_feature: Ceres CLONE 1960054
  misc_feature (30)..(80): Pfam Name: Nop10p Pfam Description: Nucleolar RNA-binding protein, Nop10p family
NLAEILFASSPLRSSPIIWAHPRAWIQDALQYYINEKGDKVYTTKKESPLGVPTQSAHPARFSPDDKYSRQRYLLKKRFGLLPTQKPAPKY

SEQ ID NO: 35267 - DNA, 363 bp, Panicum virgatum
  misc_feature: Ceres CLONE 1960059
  misc_feature: Encodes the peptide sequence at SEQ ID NO. 35268
ctctttgtagattatattcatccaatatgggtaaagttcacggttctttggctcgtgccggtaaggttaagtctcaatgtcctaaggtcgctaagcaagaaaagaagaagcccaagactggtcgtgctaagaagagacaagtttacaaccgtcgtttcgtcaatgttaccactcaagttggtggtaagcgtagaatgaaccctgctcctactgctggtccttaaattggaacaacaatgtctcttttcaatctgatataatcaagtttattctcgagaaaattatgaatgtgcgtagatatcaatcatcaacagcgattatatagttttttccccctatacgaataaacttttacatctatac

SEQ ID NO: 35268 - protein, 65 aa, Panicum virgatum
  misc_feature: Ceres CLONE 1960059
  misc_feature (3)..(61): Pfam Name: Ribosomal_S30 Pfam Description: Ribosomal protein S30
MGKVHGSLARAGKVKSQCPKVAKQEKKKPKTGRAKKRQVYNRRFVNVTTQVGGKRRMNPAPTAGP

SEQ ID NO: 35269 - DNA, 661 bp, Panicum virgatum
  misc_feature: Ceres CLONE 1960068
  misc_feature: Encodes the peptide sequence at SEQ ID NO. 35270
agacgacgacgattcaaccgtccgccaagcggcccaaacccaccaagcccaccgccaatccagacccgcgcaccctcaccaccggcggcgaccatggcgacgaccaaggaccccgctgtcaccggcggcgagcccgccatcggcatcccgtacgatcccgcggcggcggcccaggggcaatactactacgcgccgccgccgaacccctacgcggcggggatgccgccgcccaacgcgatctacgccggcgcgcccaagggggtgccgctgcagcagaccatgttccgcgacacgcccgcgcccttccactgccaggcctgcggcgaagccgccgtctctaccgtccggtcgaagccgagcctggcatctgttgtggcctgcatgatgcccttcatgatgggggtctgcttcctatgcccttcgatggactgcctctggcacaagtaccattactgccccaactgcggcgaaaaggtgggcgagttcaggaagtccgacccgtgcctcgtggtggatgcgccccggtggtccgagccaagcttcgccgtgcctgcgtagtgcatacaccacttgctataaatgccattaccttcaaaatgatagaatgcattgctgttgttcttgtgtagtctgtatataaaaggatgcaaaactttcttgt

SEQ ID NO: 35270 - protein, 154 aa, Panicum virgatum
  misc_feature: Ceres CLONE 1960068
  misc_feature: Functional homolog of the protein sequence given in SEQ ID NO 51479
  misc_feature: Useful for biocontainment applications
MATTKDPAVTGGEPAIGIPYDPAAAAQGQYYYAPPPNPYAAGMPPPNAIYAGAPKGVPLQQTMFRDTPAPFHCQACGEAAVSTVRSKPSLASVVACMMPFMMGVCFLCPSMDCLWHKYHYCPNCGEKVGEFRKSDPCLVVDAPRWSEPSFAVPA

SEQ ID NO: 35271 - DNA, 397 bp, Panicum virgatum
  misc_feature: Ceres CLONE 1960071
  misc_feature: Encodes the peptide sequence at SEQ ID NO. 35272
agtggcgctggttggctactgctgctgctagcaagggtgctaggctagcgctcctgctccgctgctcggctgctgctgcgccaactcggccgtcctcatccgcctccgccctccctcctcgtctcctcctctctttctctcgccgccattggttggtttgcgcaaagggaagatactcctaccagcttcggctgctttccccgacgacgcgcgccgcatatctacacctcggcgccgggcgccggcggagctggcagggacgacgatggcggggaagagggagcggatagcgatacggaggatcgacaacctggcggcgaggcaggtgaccttctccaagcgccgccgggggctgtttaagaaggccgaggagctctccatcctcggctctgtactc

SEQ ID NO: 35272 - protein, 43 aa, Panicum virgatum
  misc_feature: Ceres CLONE 1960071
  misc_feature (11)..(43): Pfam Name: SRF-TF Pfam Description: SRF-type transcription factor (DNA-binding and dimerisation domain)
  misc_feature: Functional homolog of the protein sequence given in SEQ ID NO 51480
  misc_feature: Useful for making plants with altered alkaloid content
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: Functional homolog of the protein sequence given in SEQ ID NO 51419
  misc_feature: Useful for making plants with modulated flowering time
  misc_feature: The sequence is a functional homolog of SEQ ID NO 1454 in the 10/374,780 US patent application
  misc_feature: The sequence is a functional homolog of SEQ ID NO 122 in the 10/225,066 US patent application
  misc_feature: The sequence is a functional homolog of SEQ ID NO 234 in the 10/374,780 US patent application
  misc_feature: The sequence is a functional homolog of SEQ ID NO 1453 in the 10/374,780 US patent application
  misc_feature: The sequence is a functional homolog of SEQ ID NO 1701 in the 10/412,699 US patent application
  misc_feature: The sequence is a functional homolog of SEQ ID NO 2189 in the 10/666,642 US patent application
  misc_feature: The sequence is a functional homolog of SEQ ID NO 2191 in the 10/666,642 US patent application
  misc_feature: The sequence is a functional homolog of SEQ ID NO 2199 in the 10/666,642 US patent application
  misc_feature: The sequence is a functional homolog of SEQ ID NO 2197 in the 10/666,642 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: Functional homolog of the protein sequence given in SEQ ID NO 51481
  misc_feature: Useful for making plants with altered lignin content
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: The sequence is a functional homolog of SEQ ID NO 1470 in the 10/666,642 US patent application
  misc_feature: The sequence is a functional homolog of SEQ ID NO 284 in the 10/666,642 US patent application
  misc_feature: The sequence is a functional homolog of SEQ ID NO 2193 in the 10/666,642 US patent application
  misc_feature: The sequence is a functional homolog of SEQ ID NO 2195 in the 10/666,642 US patent application
  misc_feature: The sequence is a functional homolog of SEQ ID NO 1971 in the 10/412,699 US patent application
  misc_feature: Functional homolog of the protein sequence given in SEQ ID NO 51482
  misc_feature: Useful for making plants with modulated biomass
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 1973 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1955 in the 10/412,699 US patent application
  misc_feature: The sequence is a functional homolog of SEQ ID NO 1953 in the 10/412,699 US patent application
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: The sequence is a functional homolog of SEQ ID NO 1056 in the 10/225,066 US patent application
  misc_feature: The sequence is a functional homolog of SEQ ID NO 1882 in the 10/412,699 US patent application
  misc_feature: The sequence is a functional homolog of SEQ ID NO 350 in the 10/374,780 US patent application
  misc_feature: The sequence is a functional homolog of SEQ ID NO 944 in the 10/412,699 US patent application
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: Functional homolog of the protein sequence given in SEQ ID NO 50741
  misc_feature: Useful for biocontainment applications
  misc_feature: Useful for making plants with modulated nitrogen use efficiency
  misc_feature: The sequence is a functional homolog of SEQ ID NO 1949 in the 10/412,699 US patent application
  misc_feature: The sequence is a functional homolog of SEQ ID NO 1945 in the 10/412,699 US patent application
  misc_feature: The sequence is a functional homolog of SEQ ID NO 1947 in the 10/412,699 US patent application
  misc_feature: The sequence is a functional homolog of SEQ ID NO 1110 in the 10/225,066 US patent application
  misc_feature: The sequence is a functional homolog of SEQ ID NO 166 in the 10/374,780 US patent application
  misc_feature: The sequence is a functional homolog of SEQ ID NO 1812 in the 10/412,699 US patent application
  misc_feature: The sequence is a functional homolog of SEQ ID NO 568 in the 10/412,699 US patent application
  misc_feature: The sequence is a functional homolog of SEQ ID NO 4 in US patent 7303918
  misc_feature: The sequence is a functional homolog of SEQ ID NO 1969 in the 10/412,699 US patent application
  misc_feature: Functional homolog of the protein sequence given in SEQ ID NO 50970
  misc_feature: Useful for making plants with altered terpenoid content
  misc_feature: The sequence is a functional homolog of SEQ ID NO 1366 in the 10/666,642 US patent application
  misc_feature: The sequence is a functional homolog of SEQ ID NO 1730 in the 10/412,699 US patent application
  misc_feature: The sequence is a functional homolog of SEQ ID NO 207 in the 11/479,226 US patent application
  misc_feature: The sequence is a functional homolog of SEQ ID NO 64 in the 10/412,699 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 1886 in the 10/412,699 US patent application
  misc_feature: The sequence is a functional homolog of SEQ ID NO 2146 in the 10/374,780 US patent application
  misc_feature: The sequence is a functional homolog of SEQ ID NO 948 in the 10/412,699 US patent application
  misc_feature: The sequence is a functional homolog of SEQ ID NO 42 in the 10/666,642 US patent application
  misc_feature: The sequence is a functional homolog of SEQ ID NO 1951 in the 10/412,699 US patent application
  misc_feature: The sequence is a functional homolog of SEQ ID NO 14 in the 10/374,780 US patent application
  misc_feature: The sequence is a functional homolog of SEQ ID NO 328 in the 10/225,066 US patent application
  misc_feature: The sequence is a functional homolog of SEQ ID NO 34 in the 10/286,264 US patent application
  misc_feature: The sequence is a functional homolog of SEQ ID NO 468 in the 11/435,388 US patent application
  misc_feature: The sequence is a functional homolog of SEQ ID NO 68 in the 10/412,699 US patent application
  misc_feature: The sequence is a functional homolog of SEQ ID NO 1967 in the 10/412,699 US patent application
  misc_feature: The sequence is a functional homolog of SEQ ID NO 1961 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 919 in the 10/666,642 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 707 in the 10/666,642 US patent application
  misc_feature: The sequence is a functional homolog of SEQ ID NO 1884 in the 10/412,699 US patent application
  misc_feature: The sequence is a functional homolog of SEQ ID NO 352 in the 10/374,780 US patent application
  misc_feature: The sequence is a functional homolog of SEQ ID NO 384 in the 10/225,066 US patent application
  misc_feature: The sequence is a functional homolog of SEQ ID NO 946 in the 10/412,699 US patent application
  misc_feature: The sequence is a functional homolog of SEQ ID NO 46 in the 10/666,642 US patent application
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: Functional homolog of the protein sequence given in SEQ ID NO 50968
  misc_feature: Useful for making plants with modulated phosphate use efficiency
  misc_feature: The sequence is a functional homolog of SEQ ID NO 2 in US patent 7273968
  misc_feature: The sequence is a functional homolog of SEQ ID NO 729 in the 10/666,642 US patent application
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 4 in US patent 7057087
  misc_feature: The sequence is a functional homolog of SEQ ID NO 32 in the 10/666,642 US patent application
  misc_feature: The sequence is a functional homolog of SEQ ID NO 30 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 14 in the 10/666,642 US patent application
  misc_feature: The sequence is a functional homolog of SEQ ID NO 2232 in the 10/374,780 US patent application
  misc_feature: The sequence is a functional homolog of SEQ ID NO 232 in the 10/225,068 US patent application
  misc_feature: The sequence is a functional homolog of SEQ ID NO 310 in the 10/225,066 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 6 in US patent 7279615
  misc_feature: The sequence is a functional homolog of SEQ ID NO 730 in the 10/666,642 US patent application
  misc_feature: The sequence is a functional homolog of SEQ ID NO 731 in the 10/666,642 US patent application
  misc_feature: The sequence is a functional homolog of SEQ ID NO 28 in the 10/666,642 US patent application
  misc_feature: The sequence is a functional homolog of SEQ ID NO 2822 in the 10/374,780 US patent application
  misc_feature: The sequence is a functional homolog of SEQ ID NO 82 in the 11/375,241 US patent application
  misc_feature: Functional homolog of the protein sequence given in SEQ ID NO 51483
  misc_feature: Useful for making plants with altered tocopherol content
  misc_feature: The sequence is a functional homolog of SEQ ID NO 2 in US patent 7049489
  misc_feature: The sequence is a functional homolog of SEQ ID NO 360 in the 10/666,642 US patent application
  misc_feature: The sequence is a functional homolog of SEQ ID NO 118 in the 11/375,241 US patent application
  misc_feature: The sequence is a functional homolog of SEQ ID NO 2234 in the 10/374,780 US patent application
  misc_feature: The sequence is a functional homolog of SEQ ID NO 216 in the 10/225,066 US patent application
  misc_feature: The sequence is a functional homolog of SEQ ID NO 2454 in the 10/374,780 US patent application
  misc_feature: The sequence is a functional homolog of SEQ ID NO 215 in the 11/479,226 US patent application
  misc_feature: The sequence is a functional homolog of SEQ ID NO 470 in the 11/435,388 US patent application
MAGKRERIAIRRIDNLAARQVTFSKRRRGLFKKAEELSILGSV

SEQ ID NO: 35273 - DNA, 256 bp, Panicum virgatum
  misc_feature: Ceres CLONE 1960109
  misc_feature: Encodes the peptide sequence at SEQ ID NO. 35274
gagctactgggtcaaggacggcaaggtcgtcggcgtgttcctcgagggtgggtcggctgaggagaaccaggccatcgccagggtcgccaggacccagccgccggtggccgacgtcgaggcgctcaagaccgaggggctggagttcgctaccaaagcctgatcaagcaattcggcagatgtaacaaaaacaaaattaattagagactgccaatttgagcatgtatatttcttggcaattctgctttgagcttttcac

SEQ ID NO: 35274 - protein, 52 aa, Panicum virgatum
  misc_feature: Ceres CLONE 1960109
  misc_feature: SWISSPROT Homolog: EC 1.6.5.4 Monodehydroascorbate reductase (NADH)
SYWVKDGKVVGVFLEGGSAEENQAIARVARTQPPVADVEALKTEGLEFATKA

SEQ ID NO: 35275 - DNA, 683 bp, Panicum virgatum
  misc_feature: Ceres CLONE 1960110
  misc_feature: Encodes the peptide sequence at SEQ ID NO. 35276
ccatccatctcatcccttgctacctgcatccatcggccttagcgagctcacagttcaatcaggtccggttcagcttcaggccgagctcgtcgtcaccgaggagatggcgctctctcaccgcatggccgcgcccgtcctcgtcttcctgctgctcctcgtcgccacagagatggggccggcgacggtggcggaggcgaggcactgcctgtcgcagagccaccacttcaagggcctgtgcgtgagcagcagcaactgcgccaacgtctgccagaccgagaacttccccggcggcgagtgcaagacggagggcgccacccgcaagtgcttctgcaagaggatctgctagccgccgccgcccccgccccggcactgcgctggtcctcccgccgttgttcgtgtgttcttccttctgttcgtcggttcctcatgcgcgcacgctgcgccgtgaacgctgtagcgggctgtgttcctctcgatcgtcttgttctcttttcctggaataaatttgaactcggtggcggtgctggtgatgccgaggtgtgcgatgcctgtgcgtgtggatcatctcgctgttgttctgcatccgtatgcactccattattagtgtactcgtagtcgtaggcaaggtgatgtaaggtccttccttttcacattgatgtaataatgcaatgcagtttcgtgcc

SEQ ID NO: 35276 - protein, 80 aa, Panicum virgatum
  misc_feature: Ceres CLONE 1960110
  misc_feature (32)..(80): Pfam Name: Gamma-thionin Pfam Description: Gamma-thionin family
MALSHRMAAPVLVFLLLLVATEMGPATVAEARHCLSQSHHFKGLCVSSSNCANVCQTENFPGGECKTEGATRKCFCKRIC

SEQ ID NO: 35277 - DNA, 553 bp, Panicum virgatum
  misc_feature: Ceres CLONE 1960196
  misc_feature: Encodes the peptide sequence at SEQ ID NO. 35278
gcggcattcaattcccctggcttgcccccgccagcacgccccgcccgctgccctgatcccgcggagccggcgaggaagcccggtgccctcccgggaccgccggtgcgtgcgtccccccgctcagtcagtgttcacatgatgtatcatgctaagaatttttctgtgccctttgctccgcagagggctcagaataatgagcatgcaagtaatattggagctattggtggaaccaacataagcaaccctgctaatcctgtaggaagtgggaaacaacgtctaagatggacctcggatctccataatcgttttgtggatgccatcgcccagcttggtggaccagatagtgggtattctattcttgagtattagtcgttgtagttggtgttaatgcattgcataaactgccatctgcacaaatgttctgtactgatggtttaaaaatcaaggagtatattaattgaacgcattacacatgtcattatgtgtagcaaactggaaatttaattaaaccaaccgtgtcaatctttaggatcagattgctgcacgctttttg

SEQ ID NO: 35278 - protein, 77 aa, Panicum virgatum
  misc_feature: Ceres CLONE 1960196
  misc_feature: Functional homolog of the protein sequence given in SEQ ID NO 51484
  misc_feature: Useful for making plants with altered alkaloid content
  misc_feature: Useful for making plants with altered terpenoid content
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
MMYHAKNFSVPFAPQRAQNNEHASNIGAIGGTNISNPANPVGSGKQRLRWTSDLHNRFVDAIAQLGGPDSGYSILEY

SEQ ID NO: 35279 - DNA, 691 bp, Panicum virgatum
  misc_feature: Ceres CLONE 1960248
  misc_feature: Encodes the peptide sequence at SEQ ID NO. 35280
acactccaactccacatccatcaatccagcacatcgcgggtcattccatttccaacttaacagtccaacccactttcgataaattttatcatcaaccacaatggcccgcactaagcagaccgctcgcaagtccactggtggcaaggctcctcgcaagcagcttgcttccaaggctgcccgcaagtcggccccgtcgaccggcggtgtcaagaagcctcaccgttacaagcccggtaccgtcgctctccgtgagattcgtcgctaccagaagtcgactgagctcctcatccgcaagctccccttccagcgcctggttcgcgaaatcgctcaggacttcaagtccgacctccgcttccagagctccgccattggcgccctccaggagtccgttgagtcttacctcgtctccctcttcgaggacaccaacctgtgcgccatccacgccaagcgtgtcaccatccagtcgaaggacatccagctcgctcgtcgtctccgtggtgagcgcaactaagcatggttgcttgggtctttgctagtttgggggggttcgcaggttatgactttctcatttgggacgcgctctggatgaaggggctcattcacgggacaagggacggcgttttattgcgatgggtttttgctctggggttgtacattacacggcggcaaacggactgccgcgaatatccca

SEQ ID NO: 35280 - protein, 136 aa, Panicum virgatum
  misc_feature: Ceres CLONE 1960248
  misc_feature (58)..(132): Pfam Name: Histone Pfam Description: Core histone H2A/H2B/H3/H4
MARTKQTARKSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 35281 - DNA, 336 bp, Panicum virgatum
  misc_feature: Ceres CLONE 1960250
  misc_feature: Encodes the peptide sequence at SEQ ID NO. 35282
gacgttcgggtatgtcagccaggggctggccgggctgagaccgtgggtgctgatgcgccccaaccacgggaaggcgccggacacgccgtgcaagctggccgccaccgttgagccgtgcttccacaggccgcccaactacgactgccgggccaaggccagatgtgacaccggcaggatagtccagcacatccggcactgcgaggacttcccggagggtgtccagttgctggagtcatgagctactgctatttagttccatgcatcacatagtcatttttgctactctcgtatactgtgattaattaaaggttatgaataaacctctatatagatgac

SEQ ID NO: 35282 - protein, 78 aa, Panicum virgatum
  misc_feature: Ceres CLONE 1960250
  misc_feature: SWISSPROT Homolog: EC 2.4.1.69 Galactoside 2-alpha-L-fucosyltransferase
  misc_feature: Functional homolog of the protein sequence given in SEQ ID NO 51485
  misc_feature: Useful for making plants with altered cell wall content and/or composition
TFGYVSQGLAGLRPWVLMRPNHGKAPDTPCKLAATVEPCFHRPPNYDCRAKARCDTGRIVQHIRHCEDFPEGVQLLES

SEQ ID NO: 35283 - DNA, 665 bp, Panicum virgatum
  misc_feature: Ceres CLONE 1960258
  misc_feature: Encodes the peptide sequence at SEQ ID NO. 35284
aaggggaagagaaaaccccaacgccggcaagaacccgccgcctcttgcaatccctccgctcatctcgctcgaatccgccgccgcattccccgaatcgcgcgtccgcggttgcgggagcaagcaggagaaggacgagcaggatggccgggaagggcgggaaggggctgatcgccgcgaagacggcggccggcatggacaaggagaagaagcagcccgtcacccggtcctcgcgcgccggcctccagttccccgtcgggcgtatccatcgccagctgaaagaaagggtccaggccagcgaccgggtgggagcaaccgctgctgtgtactcggcagcaatcctggagtacctgacagcagaggtccttgagctggctgggaacgcgagcaaagatctcaaggtgaagcgcatcacgccccgccacctccagttggcgatccgcggtgatgaagagctggacacccttatcaagggcaccatcgctggtggtggtgtcatcccccacatccacaagtcgctcatcaacaagaccgtcaaggaatgaacaccatctatggctttcgctgactgtctgctctgtcagtttagggtcctggtcctgagaagtgagaacgaacatggtaacctatattcaaagaacctggtaacctgagattgcctttcagac

SEQ ID NO: 35284 - protein, 133 aa, Panicum virgatum
  misc_feature: Ceres CLONE 1960258
  misc_feature (28)..(102): Pfam Name: Histone Pfam Description: Core histone H2A/H2B/H3/H4
  misc_feature: SWISSPROT Homolog: EC 2.7.7.7 DNA-directed DNA polymerase
MAGKGGKGLIAAKTAAGMDKEKKQPVTRSSRAGLQFPVGRIHRQLKERVQASDRVGATAAVYSAAILEYLTAEVLELAGNASKDLKVKRITPRHLQLAIRGDEELDTLIKGTIAGGGVIPHIHKSLINKTVKE

SEQ ID NO: 35285 - DNA, 740 bp, Panicum virgatum
  misc_feature: Ceres CLONE 1960288
  misc_feature: Encodes the peptide sequence at SEQ ID NO. 35286
atgcacgtcgcaaagaagaaccagactagagaatctcaaggaaagccgcactacaacacatcatcacagccatggcgacctttgaacgcagcagcatgggtttcatctcctgcctcctcgctctcgccctgctctccgccacggcgtccgccgcggagaaggagacgcggctccgcgtgttttggcacgacgtggtaaccgggcccaactcgacgatagttcaggtggcgcaggccccctcgtccaacgcctccgccaccggcttcggcaccgtcatcgtcatcgacgacccgctcaccgacggcccaagcctcaactcgtccagactcgtcggccgcgcgcagggcatgtacgtcagcgccggcaaggactcgttctcgctgctcatggccatgaacttcgtgttcgtcgacggcgcctacaacggcagcagcgtcgctatcttcggtcccaacccggcggagaagcaggtcagggagatgcctgtgattggaggcaccggcatgttccggttcgcaagaggctactgccaggctcgcacgcagtggatcgacaacaagaccggcgacgccaccgtcgagtacaatattcacatccgccatgactgagatgatacgtacgtactgttgttacgcattgttttgtcattgaatcattcattattgttgagcatttcgtaggctttgagaagggtgtatttgattcttgtgagacgtgcgcagaaaagtaatgtgttttgt

SEQ ID NO: 35286 - protein, 178 aa, Panicum virgatum
  misc_feature: Ceres CLONE 1960288
  misc_feature (11)..(177): Pfam Name: Dirigent Pfam Description: Dirigent-like protein
MATFERSSMGFISCLLALALLSATASAAEKETRLRVFWHDVVTGPNSTIVQVAQAPSSNASATGFGTVIVIDDPLTDGPSLNSSRLVGRAQGMYVSAGKDSFSLLMAMNFVFVDGAYNGSSVAIFGPNPAEKQVREMPVIGGTGMFRFARGYCQARTQWIDNKTGDATVEYNIHIRHD

SEQ ID NO: 35287 - DNA, 578 bp, Panicum virgatum
  misc_feature: Ceres CLONE 1960327
  misc_feature: Encodes the peptide sequence at SEQ ID NO. 35288
atcgccgctaccgccgccccagcttccccgaccccgagcccgagggctccgccgaccgctggccgccgccacccacgctgccgccgtgccgcgcctcccgccggccgccgcccccagcgcggaagatggttctgcagcgagcggtggcggagtgccccaagaaggttgccgggctggtggacctggggaacctgccgactgcgctgcgggagttcgccggaggccggtcccagatgtcccacctctccttcttcctccgcgtctggtcccacatcaaggaacacaacctacaggacccgacaaataagaacattgtgaactgtgatgagaagctgaagactgtattattgggcaggtcccaagtgcagctctttgaactcccaatgattgtgaagcttcatttcccaaaagttccaaagtcgtgataacattaatttagaggtattgtatattaaaactttgtggaaaccagatggatttatgtttgtctgggatagacggaatcatgtaagtgttgcgttgctgaaatttcaattgataggctatgtactgcacatgctagattgagttttgtgatt

SEQ ID NO: 35288 - protein, 99 aa, Panicum virgatum
  misc_feature: Ceres CLONE 1960327
  misc_feature (17)..(94): Pfam Name: SWIB Pfam Description: SWIB/MDM2 domain
MVLQRAVAECPKKVAGLVDLGNLPTALREFAGGRSQMSHLSFFLRVWSHIKEHNLQDPTNKNIVNCDEKLKTVLLGRSQVQLFELPMIVKLHFPKVPKS

SEQ ID NO: 35289 - DNA, 564 bp, Panicum virgatum
  misc_feature: Ceres CLONE 1960354
  misc_feature: Encodes the peptide sequence at SEQ ID NO. 35290
aaagctcaggttttacttgaagtgggagatgcatggcatgcactgacagcagcaaccagagcaacagagctggatcctctatggcccgaggcttgggtcacacttggcagagcacagttaaattttggggaaccagattcagctatactatcatttgacaaggcactagtaattaagcccgaccatgatggtgcgaaagctgaccgcgaaactgcagtccgtcttgtcaagaaacgagggcagctgcactcatcaggtctaagcaccaacaaaaggaggttcacggtgggagagaactcagttaagggcgccgagggtaaagagaaggcggatgaaacagcggtacagtctggttagcctgctacatgttggctttctatcatcctggggctagtgctttagagtagaactggctaaaatgagggttaacatacaaggatttctggcctctgcctcatattttcgcatatcaggattctgagttgggttctgttgaaattttgtgccgctctgtggaactttgttagagccttaagaggtatgctgtaggggtttagacgttcg

SEQ ID NO: 35290 - protein, 118 aa, Panicum virgatum
  misc_feature: Ceres CLONE 1960354
  misc_feature (29)..(62): Pfam Name: TPR_1 Pfam Description: Tetratricopeptide repeat
KAQVLLEVGDAWHALTAATRATELDPLWPEAWVTLGRAQLNFGEPDSAILSFDKALVIKPDHDGAKADRETAVRLVKKRGQLHSSGLSTNKRRFTVGENSVKGAEGKEKADETAVQSG

SEQ ID NO: 35291 - DNA, 381 bp, Panicum virgatum
  misc_feature: Ceres CLONE 1960384
  misc_feature: Encodes the peptide sequence at SEQ ID NO. 35292
ggaatcgttatcccggcccccttttgacgctatggttgtaggtaaaggtactgcaagttttggaaagagacacaacaaatcacacacactctgtcgtcgatgtggtcgcagatcttggcacatccagaaagctcgctgtgctagctgtgcaggaggagcaactgccaaattgagaaaatttaattgggcaccaaaagcacttcacagaagaacaacaggaacaggacgtatgagataccttaagaccgttccaaaacgccaaccaagtcttattcgatgtaatcaaaagcgagacagccaaatcgccaaagttcttaaaaagaacattagagcctcagtaagagtttaaggaatttaccaacaataaatgggggtcgaatt

SEQ ID NO: 35292 - protein, 105 aa, Panicum virgatum
  misc_feature: Ceres CLONE 1960384
  misc_feature (4)..(58): Pfam Name: Ribosomal_L37e Pfam Description: Ribosomal protein L37e
MVVGKGTASFGKRHNKSHTLCRRCGRRSWHIQKARCASCAGGATAKLRKFNWAPKALHRRTTGTGRMRYLKTVPKRQPSLIRCNQKRDSQIAKVLKKNIRASVRV

SEQ ID NO: 35293 - DNA, 275 bp, Panicum virgatum
  misc_feature: Ceres CLONE 1960475
  misc_feature: Encodes the peptide sequence at SEQ ID NO. 35294
aaatacttcaacaatgaggttgaagacgagtttgaaggagacgacgaagatgatgaagatttggatggtgaggatggcgaggatgacgacgaggagaactgaaccctcagcctttgatgtcagctgctgggtggggactgtggctctgaagggtggaattatgtgacccttttgcgagactttttttgtttgtttgacttagctggaactcaccgtagggaactgtttaatgccttatgcagttcaaccaacttgaaaggagaccgctatgtcac

SEQ ID NO: 35294 - protein, 33 aa, Panicum virgatum
  misc_feature: Ceres CLONE 1960475
  misc_feature: Functional homolog of the protein sequence given in SEQ ID NO 51486
  misc_feature: Useful for making plants with altered terpenoid content
  misc_feature: Functional homolog of the protein sequence given in SEQ ID NO 50947
  misc_feature: Useful for making plants with modulated biomass
KYFNNEVEDEFEGDDEDDEDLDGEDGEDDDEEN

SEQ ID NO: 35295 - DNA, 613 bp, Panicum virgatum
  misc_feature: Ceres CLONE 1960487
  misc_feature: Encodes the peptide sequence at SEQ ID NO. 35296
aaaagcccaaaagaggagaggaagacgacgacgacgcggcaccatggcgacggcacaggcagcctcggcgtcgcccacccaccaccgcgcgtccccggggacgtcgccgccgcagccgccctaccccagcgccgccaggatcgcggactccgcctgcttcccccagtacaccgcctccctcaagtgtttggaggccaaccaggacaagagcaagtgccagcagcagttcgacgattacaaggagtgcaagaagaaagagagagaggctcggctcgaacggaataaaggccgatcactcttcgggtgaacaatggcgtaccccctgggcaatttgctggtgatgtgcaataagttgtttcctgatgccagtgaaatcacagctcctttggtttcgtgatgatcctttgtaacttgtgcaaggcaggaaataggagaccagtctgtaggttgagggagatgtaaggtctgagaacagctcattagctcaatggcttagtcgagcgaatcagatgagcaaggatgttttttgaggttcatcaggtgtcacgacacgaggatttgttgaataaaaaatgtatttccagaacgcttttactccaaagtatttatcttg

SEQ ID NO: 35296 - protein, 87 aa, Panicum virgatum
  misc_feature: Ceres CLONE 1960487
  misc_feature (31)..(71): Pfam Name: CHCH Pfam Description: CHCH domain
MATAQAASASPTHHRASPGTSPPQPPYPSAARIADSACFPQYTASLKCLEANQDKSKCQQQFDDYKECKKKEREARLERNKGRSLFG

SEQ ID NO: 35297 - DNA, 675 bp, Panicum virgatum
  misc_feature: Ceres CLONE 1960492
  misc_feature: Encodes the peptide sequence at SEQ ID NO. 35298
gcggtggagagccacgccggcgacgcggaggaggaggaggtcgtggtccagaaggtccacttcagccgggagttcatctccaggctcaagtcccgggcgtcggcgggcatgccgcggccgtacagcactctgcagtgcgtggtggcgcacctgtggcggtgcatgacgacggcgcgcgggctggacgagggccagtccaccagcgtgtgcatcgccgtggacgggcgcgcgcggatgagcccgcaggtccccgacggctacaccggcaacgtggtgctgtgggcgcggcccaccgccagggccggcgagctggtggcgaagcccctgcagcacgcggtggggctcatcaaccgggaggtggcccggatcaacgacggctacttcaagtcgttcatcgacttcgccagctccgcggcggtggacaaggagcggctggtggcggcggccgacgcggccgagatggtgctgagccccgacatcgaggtcgacagctggctgcggatcccgttctacgacctcgacttcggcggcggccggcccttcttcttcatgcccagctacctgccggtggagggcctgctcatcctgctgccgtccttcgtcggggacggcagcgtggacgcctacgtgccgctcttcagccgcgacatggacaccttcaagaactgctgctac

SEQ ID NO: 35298 - protein, 224 aa, Panicum virgatum
  misc_feature: Ceres CLONE 1960492
  misc_feature: SWISSPROT Homolog: EC 2.3.1.144 Anthranilate N-benzoyltransferase
AVESHAGDAEEEEVVVQKVHFSREFISRLKSRASAGMPRPYSTLQCVVAHLWRCMTTARGLDEGQSTSVCIAVDGRARMSPQVPDGYTGNVVLWARPTARAGELVAKPLQHAVGLINREVARINDGYFKSFIDFASSAAVDKERLVAAADAAEMVLSPDIEVDSWLRIPFYDLDFGGGRPFFFMPSYLPVEGLLILLPSFVGDGSVDAYVPLFSRDMDTFKNCC

SEQ ID NO: 35299 - DNA, 415 bp, Panicum virgatum
  misc_feature: Ceres CLONE 1960579
  misc_feature: Encodes the peptide sequence at SEQ ID NO. 35300
atcgtatgagcaaagagatcacgtccctggctcctagcagcatgaaggttaaagtgattgcgccacctgaaaggaaatacagtgtctggattggtggctctatactggcatctctcagcacttttcagcagatgtggatctccaaggcagagtatgacgaaaccggtcccggcattgtccacatgaagtgcttctaagtgtctgggagaagcttgacatggcacatccaagaaggttgccgcctggtcagcccgttgccctggagcaatgcagaagaggcagccgcagagtatcaagtggacagaaataaacagtagccgtgtacactagtacgtgttgctccgtgtcgtattgaatggtttgttcatatatctggtttgctgtttcgtatcatacctagtttgcgttttggttc

SEQ ID NO: 35300 - protein, 64 aa, Panicum virgatum
  misc_feature: Ceres CLONE 1960579
  misc_feature: Functional homolog of the protein sequence given in SEQ ID NO 51487
  misc_feature: Useful for making plants with modulated biomass
  misc_feature: Functional homolog of the protein sequence given in SEQ ID NO 50711
  misc_feature: Useful for making plants with modulated flowering time
RMSKEITSLAPSSMKVKVIAPPERKYSVWIGGSILASLSTFQQMWISKAEYDETGPGIVHMKCF

SEQ ID NO: 35301 - DNA, 590 bp, Panicum virgatum
  misc_feature: Ceres CLONE 1960634
  misc_feature: Encodes the peptide sequence at SEQ ID NO. 35302
ggccacaccttcggccgggtacaatgccagttcgtcacggaccggctctacaacttccgcggcacaaacatgccggacccgaccctggactcgtcgtaccgggcgttcctgtcgcagaggtgccccaggaacggcgcccctgcgtccctgaacgacctggacccgacgacgccggacaccttcgacaagaactactacaccaacatcgaggcgaaccgggggttcctcaactccgaccaggagctcaagtcgtcgccccaggcgcagggcaccacggcgcccatcgtcgaccagttcgccggcagccaggacgccttcttcgcgagcttcgcgcagtccatgatcaacatggggaacatcaggccggtcacggacccgtcacagggagaggtccgcaccaactgcagaagggtcaatggaagctaattaatactacatgataaccatggtcatggaggagagaattattattatttgtaactgaaacataagggctgtcggctccgatccctcgatcaagtgtgcagtttgtttatatatatgtatgtatttcttattttccaaaattatatatacatgtatagtttgtc

SEQ ID NO: 35302 - protein, 141 aa, Panicum virgatum
  misc_feature: Ceres CLONE 1960634
  misc_feature: SWISSPROT Homolog: EC 1.11.1.7 Peroxidase
  misc_feature: Functional homolog of the protein sequence given in SEQ ID NO 51034
  misc_feature: Useful for making plants with modulated nitrogen use efficiency
  misc_feature: Functional homolog of the protein sequence given in SEQ ID NO 51488
  misc_feature: Useful for making plants with altered cell wall content and/or composition
GHTFGRVQCQFVTDRLYNFRGTNMPDPTLDSSYRAFLSQRCPRNGAPASLNDLDPTTPDTFDKNYYTNIEANRGFLNSDQELKSSPQAQGTTAPIVDQFAGSQDAFFASFAQSMINMGNIRPVTDPSQGEVRTNCRRVNGS

SEQ ID NO: 35303 - DNA, 647 bp, Panicum virgatum
  misc_feature: Ceres CLONE 1960679
  misc_feature: Encodes the peptide sequence at SEQ ID NO. 35304
aacataagcacacagagatcagtaaccaagcaatcagcggttctcaccaccaaattcaagaactcaggaggcatctgtctcctctgctctcgcgttagcgaagccagcacccagcagagaagcatgatggcggcaagagcaggagcgttggcggtggcgtgcctcgtggctgccgtggcggcggcgctgctggcctcgccggcgtcggcgcaatcggggtcgtgcacgaccacgctgattagcctgtacccgtgcctgaactacatcagcggcaatgtgtcgacgccgccgtcctcgtgctgctcgcagctcgccagcgtcgtgcagtccaagccgcagtgcctctgcgccgcgctcagcggcgactcgtcgtccctcggcgtcaccatcgacaagaagcgcgcgctcgagctccccaaggcctgcaacgtcgataccccgccggcgagcaagtgcaactctgccggcggcggcaacgcaccgggcgccgcgacaccgaccacgccgtcggccggcgagccagcgaccgcaggggccagcggcggatcgaaggcgacgccgacggcgccctacctgacatctggcgccggcgcgtcgatccggggggcggtgagcctggcgctcgcattcgcagctgtcgccgtcta

SEQ ID NO: 35304 - protein, 173 aa, Panicum virgatum
  misc_feature: Ceres CLONE 1960679
  misc_feature (33)..(110): Pfam Name: Tryp_alpha_amyl Pfam Description: Protease inhibitor/seed storage/LTP family
MAARAGALAVACLVAAVAAALLASPASAQSGSCTTTLISLYPCLNYISGNVSTPPSSCCSQLASVVQSKPQCLCAALSGDSSSLGVTIDKKRALELPKACNVDTPPASKCNSAGGGNAPGAATPTTPSAGEPATAGASGGSKATPTAPYLTSGAGASIRGAVSLALAFAAVAV

SEQ ID NO: 35305 - DNA, 291 bp, Panicum virgatum
  misc_feature: Ceres CLONE 1960681
  misc_feature: Encodes the peptide sequence at SEQ ID NO. 35306
aaacaaacgctaaaaaagtaacagtttctgtactttattgcgagccaacacaccgcaaccatgggccactgggaccaatggaagtcgaagcagaagcaggtccagggcaagggtgcccgctgctgcgtcatgtgcgccaaccagtacgccggtatcatccgcaagtacgagctgaacgtgtgccgccagtgcttccgtgaggagcacgacgccctcggcttccgcaagctgaactaaagtgccgtcgtcgtggtcgttttggccgtcgcgcaaccaacactttctctttct

SEQ ID NO: 35306 - protein, 58 aa, Panicum virgatum
  misc_feature: Ceres CLONE 1960681
  misc_feature (3)..(58): Pfam Name: Ribosomal_S14 Pfam Description: Ribosomal protein S14p/S29e
MGHWDQWKSKQKQVQGKGARCCVMCANQYAGIIRKYELNVCRQCFREEHDALGFRKLN

SEQ ID NO: 35307 - DNA, 525 bp, Panicum virgatum
  misc_feature: Ceres CLONE 1960684
  misc_feature: Encodes the peptide sequence at SEQ ID NO. 35308
agtattcgaaacacaactcgcacaacacagcaagatgtcgcacgtcggacgcggaaagggaggcaagggtctcggcaagggtggcaagggcctcggcggcgccaagcgtcacaggaaggtgctccgcgacaacatccagggtatcaccaagcccgccatacgtaggctcgctcgccgcggtggtgtcaagcgtatctccggcatgatctacgaggagacccgtggcgtgctcaaggtcttcctcgagaacgtcatccgcgacgccgtcacctacaccgagcacgctcgcaggaagaccgtcacggccatggacgtcgtctacgccctcaagaggcagggccgcaccctctacggtttcggcggctaagcgccatcttcgacgagaacagaccccactcgacccaagttttgtatgtagagcccagatcgaagttgcagccaacggggcaggcgatatacaccctcaccccacggcctaccttcgtatttaccccatgaaaaagaataaacctacatgtacacccc

SEQ ID NO: 35308 - protein, 110 aa, Panicum virgatum
  misc_feature: Ceres CLONE 1960684
  misc_feature (32)..(101): Pfam Name: Histone Pfam Description: Core histone H2A/H2B/H3/H4
MSHVGRGKGGKGLGKGGKGLGGAKRHRKVLRDNIQGITKPAIRRLARRGGVKRISGMIYEETRGVLKVFLENVIRDAVTYTEHARRKTVTAMDVVYALKRQGRTLYGFGG

SEQ ID NO: 35309 - DNA, 346 bp, Panicum virgatum
  misc_feature: Ceres CLONE 1960744
  misc_feature: Encodes the peptide sequence at SEQ ID NO. 35310
gtgctctctcagaggtggcggcggcggcggcggttacggcggcgggtacggtggcggcggctacgacggtggcggtggcggatacggtggcggtcgccgcgagggcggctacggcggtggtggctacggcagccgcggtgactccggtggcaactggaggaactgatggggtagccctcccgtgctggcagccaagttatcctagatatctattagtgttcgtgttaccatttgatcccgagttaccccagagtttagtgtccgtgttaccgtttgattaggtgttggttcccatgttaccgttcccgagttgtttccgcaatgaaatgagaagaaaagagtgagc

SEQ ID NO: 35310 - protein, 54 aa, Panicum virgatum
  misc_feature: Ceres CLONE 1960744
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Functional homolog of the protein sequence given in SEQ ID NO 50178
  misc_feature: Useful for making plants with modulated nitrogen use efficiency
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Functional homolog of the protein sequence given in SEQ ID NO 50184
  misc_feature: Useful for making plants with altered lignin content
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Functional homolog of the protein sequence given in SEQ ID NO 50144
  misc_feature: Useful for making plants with altered terpenoid content
  misc_feature: Functional homolog of the protein sequence given in SEQ ID NO 50179
  misc_feature: Useful for making plants with modulated phosphate use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1844 in the 10/374,780 US patent application
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: The sequence is a functional homolog of SEQ ID NO 791 in the 10/374,780 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
  misc_feature: Functional homolog of the protein sequence given in SEQ ID NO 50268
  misc_feature: Useful for making plants with modulated heat sensitivity
  misc_feature: Useful for making plants with modulated low light sensitivity
  misc_feature: The sequence is a functional homolog of SEQ ID NO 60 in the 10/675,852 US patent application
  misc_feature: The sequence is a functional homolog of SEQ ID NO 1466 in the 10/374,780 US patent application
  misc_feature: The sequence is a functional homolog of SEQ ID NO 872 in the 10/666,642 US patent application
  misc_feature: The sequence is a functional homolog of SEQ ID NO 644 in the 10/666,642 US patent application
  misc_feature: The sequence is a functional homolog of SEQ ID NO 2086 in the 10/374,780 US patent application
  misc_feature: The sequence is a functional homolog of SEQ ID NO 1036 in the 10/374,780 US patent application
  misc_feature: The sequence is a functional homolog of SEQ ID NO 846 in the 10/666,642 US patent application
  misc_feature: The sequence is a functional homolog of SEQ ID NO 1126 in the 11/479,226 US patent application
  misc_feature: The sequence is a functional homolog of SEQ ID NO 2410 in the 10/374,780 US patent application
  misc_feature: The sequence is a functional homolog of SEQ ID NO 492 in the 10/412,699 US patent application
  misc_feature: The sequence is a functional homolog of SEQ ID NO 552 in the 10/225,066 US patent application
  misc_feature: The sequence is a functional homolog of SEQ ID NO 1929 in the 10/374,780 US patent application
  misc_feature: The sequence is a functional homolog of SEQ ID NO 1131 in the 10/666,642 US patent application
  misc_feature: The sequence is a functional homolog of SEQ ID NO 124 in the 10/714,887 US patent application
  misc_feature: The sequence is a functional homolog of SEQ ID NO 124 in the 11/435,388 US patent application
  misc_feature: The sequence is a functional homolog of SEQ ID NO 1202 in the 10/666,642 US patent application
  misc_feature: The sequence is a functional homolog of SEQ ID NO 1391 in the 10/374,780 US patent application
  misc_feature: Functional homolog of the protein sequence given in SEQ ID NO 50645
  misc_feature: Useful for making plants with altered carbohydrate content
CSLRGGGGGGGYGGGYGGGGYDGGGGGYGGGRREGGYGGGGYGSRGDSGGNWRN

SEQ ID NO: 35311 - DNA, 264 bp, Panicum virgatum
  misc_feature: Ceres CLONE 1960829
  misc_feature: Encodes the peptide sequence at SEQ ID NO. 35312
actacaagggcagggaggagacgctgacgatggtggaggcggggtgcacggggcaggggtccaaccggacggagcgggtgccgtggaccaaggcgttgagcgacggcgagctcgcaaagttcgtcgacctctcctacatctccggcgacggctggctcgacgcgcagccacggtagtcagctggccggcaataacgatgatatagatatgcaaatttactggcgtttgtgtcagtgaaaatggtaactggtgttgcttgacctc

SEQ ID NO: 35312 - protein, 57 aa, Panicum virgatum
  misc_feature: Ceres CLONE 1960829
  misc_feature: Functional homolog of the protein sequence given in SEQ ID NO 51489
  misc_feature: Useful for making plants with altered cell wall content and/or composition
YKGREETLTMVEAGCTGQGSNRTERVPWTKALSDGELAKFVDLSYISGDGWLDAQPR

SEQ ID NO: 35313 - DNA, 641 bp, Panicum virgatum
  misc_feature: Ceres CLONE 1960832
  misc_feature: Encodes the peptide sequence at SEQ ID NO. 35314
agaaaccctagacaccgctcgagccgttcgccgccgcgccgctcgtcttctcgggctctctccctcccggatccagcaggatgaagtttgttgctgcctatctgcttgctgtcctcgctggcaaccccagcccctctgctgaggatctatcgtccattctggaatcagttggctgtgaaattgacaatgaaaagatggagctgctgctgtcccaactgagcggcaaagacattaccgagctcattgctgctggcagggagaagtttgcttcagtcccatgcggtggtggtggtgtggctgtggcagcagctgcccctgctgctggtggagctgctcctgcagctgaggccaagaaagaagaggaggtggaggagaaggaagagagtgatgatgatatgggcttcagcctcttcgactaagctgtgcggtcaccagagttgtgtcttttcggcaggaaaaccagagtcgccatgtttggagtttaaccttgttttatgttgcaaagcacccgaaaagactgctacagtctggatatgtagtgattcagccataggtggctacactggttgttggtgtttactggtgaaccagagtttatgcatcatatattaagaatcagttacctagttcgttgatgttcc

SEQ ID NO: 35314 - protein, 112 aa, Panicum virgatum
  misc_feature: Ceres CLONE 1960832
  misc_feature (17)..(111): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass
MKFVAAYLLAVLAGNPSPSAEDLSSILESVGCEIDNEKMELLLSQLSGKDITELIAAGREKFASVPCGGGGVAVAAAAPAAGGAAPAAEAKKEEEVEEKEESDDDMGFSLFD

SEQ ID NO: 35315 - DNA, 641 bp, Panicum virgatum
  misc_feature: Ceres CLONE 1960844
  misc_feature: Encodes the peptide sequence at SEQ ID NO. 35316
gcgaggaaattgttggtctctttaacttgcgccttctgttctcctctccgccctctgttgcgtcgtccgtcgtctcccaccccgtcgtcaccagcgcccctcctcgcgctcgccgccgggatccggcccctcccgcgcccgcctcggcgattccgccccccgtcctagatttctgagaaaatggcaagaagtgctagagcaaggaggcatgtagctcgtcagctcaggcccaacccgtatcccattccttcaaaccgatggaagccgatgaaagaatccaaccaaaagaaaccattgccagccttgcagaagatggactgggaagatgccaattgctctgtgtgcatggaatacccgcataatgctgtgctcatcctctgttcatctcatgataagggctgccgtccttacatgtgtggaactagctaccgccactcgaattgcctggatcagttcaagaaagcctacaccaagggtgcattgcttgaggaagttcctgcaaatggtgttggcaccaacctggattcagcacctttgactgcaggtgaaaaaactgagtccattgacattgcatgcccactatgccgtggcaaggtgaaaggttggacagtggtagaaccagctcgaagctatctcaatgg

SEQ ID NO: 35316 - protein, 153 aa, Panicum virgatum
  misc_feature: Ceres CLONE 1960844
  misc_feature: The sequence is a functional homolog of SEQ ID NO 354 in the 10/666,642 US patent application
MARSARARRHVARQLRPNPYPIPSNRWKPMKESNQKKPLPALQKMDWEDANCSVCMEYPHNAVLILCSSHDKGCRPYMCGTSYRHSNCLDQFKKAYTKGALLEEVPANGVGTNLDSAPLTAGEKTESIDIACPLCRGKVKGWTVVEPARSYLN

SEQ ID NO: 35317 - DNA, 683 bp, Panicum virgatum
  misc_feature: Ceres CLONE 1960881
  misc_feature: Encodes the peptide sequence at SEQ ID NO. 35318
gaaaccggttcgaacgctcgcgaaaatcacaaatcaagaagcgcttcggcggcggaggcgggggcgagccggcggccaagcgccaggccgccggggacgaggggccctctgaatccgccgaagacggcaccgtcgtggccgagatatcgaagaacaagaaggtgtccgtgaggagctggaagggcaaggtctacgtcgacatgcgcgagttctacgtcaaggacggcaagaccctccctacccgcaaaggtatatcactacaactggatcagtggaagatactgagggacaatattaaagctatagatgaggccatcaaggaaaatgcatgacaggagccttgagctggatcagataggggcaaccttttgcgtactcttcagacccctgatgtacgctagtaggcccccaggatcataggggcaatcttttgcgtattctcttcagacccctgatgtacgctagtaggccctcaggctggtttttttgttgccacccatcccctatgctgcagtgttgcgcttgtaccgctttatcacctgttgttatttcaggtggccacatggcagctatgtagtctgtgctctgggcatccagatgacatgtagccctaatgaatgatttagggggtgtttagaaacagggactttttagtatttagaagtattaaataaatattaatt

SEQ ID NO: 35318 - protein, 109 aa, Panicum virgatum
  misc_feature: Ceres CLONE 1960881
  misc_feature (18)..(105): Pfam Name: PC4 Pfam Description: Transcriptional Coactivator p15 (PC4)
  misc_feature: Functional homolog of the protein sequence given in SEQ ID NO 51314
  misc_feature: Useful for making plants with altered lignin content
NRFERSRKSQIKKRFGGGGGGEPAAKRQAAGDEGPSESAEDGTVVAEISKNKKVSVRSWKGKVYVDMREFYVKDGKTLPTRKGISLQLDQWKILRDNIKAIDEAIKENA

SEQ ID NO: 35319 - DNA, 382 bp, Panicum virgatum
  misc_feature: Ceres CLONE 1960892
  misc_feature: Encodes the peptide sequence at SEQ ID NO. 35320
gtcgctgccacatttagtggcatcattcgggctttaaaaaaaaaggaatccaaattgaaggctgcaaggatgaacatttacgtccggagaggtggtccaaactaccaaaccggactcgcgaaaatgcgcactcttggtgcaaaacttggtgttccaattgaggtgtacggaccaaaggcgaccatgactgggatctgcaagcaagccattgaatgcatcatggctgcgtaggctaccgtatagttgcaccttctgcagttgcacccgttttgtactttgaatgcaagcgattgttcaagtgaaacaaaaaatgatcattgttgtgtaaactctacctttgtaccacaattgctcaataatcgagatcttggcttgggatgtg

SEQ ID NO: 35320 - protein, 76 aa, Panicum virgatum
  misc_feature: Ceres CLONE 1960892
  misc_feature: SWISSPROT Homolog: EC 2.3.3.8 ATP citrate synthase
  misc_feature: Functional homolog of the protein sequence given in SEQ ID NO 50168
  misc_feature: Useful for making plants with modulated root development
VAATFSGIIRALKKKESKLKAARMNIYVRRGGPNYQTGLAKMRTLGAKLGVPIEVYGPKATMTGICKQAIECIMAA

SEQ ID NO: 35321 - DNA, 323 bp, Panicum virgatum
  misc_feature: Ceres CLONE 1960895
  misc_feature: Encodes the peptide sequence at SEQ ID NO. 35322
tgagtgccgacgggaagcttcgatccctgagcagagttcaagcaggaggaggaggaggaggagatgaacgtcgacttcggcgcgcccaaggagctcgcggggggcctgcagcagcgcagggccctctaccagccccgcctcccgccgtgcctccaggtgatttccgtcgaaccctgatgctgatgcccatctcgccccgtctctgcttctcccctgtccacggattgaatagagcgagggttgattacgaccggccgcattcggcagctgccgtgatctgatcgccatccgatcggccgcggccggtcctgaatttatcctgg

SEQ ID NO: 35322 - protein, 37 aa, Panicum virgatum
  misc_feature: Ceres CLONE 1960895
  misc_feature: SWISSPROT Homolog: EC 2.7.1.90 Diphosphate--fructose-6-phosphate 1-phosphotransferase
MNVDFGAPKELAGGLQQRRALYQPRLPPCLQVISVEP

SEQ ID NO: 35323 - DNA, 402 bp, Panicum virgatum
  misc_feature: Ceres CLONE 1960924
  misc_feature: Encodes the peptide sequence at SEQ ID NO. 35324
gtgcgactatagccagttcgatgttacgtttactttctctttgtttgtttttggcagttaacgctggcccaactgttctcgatgcaacaacctttgatgatactgtcatcaatggcggaaagaacgccttcgtcaaattctatgccccatggtgcggacactgtaaagcaatggctccagcttggggaccattaggagatgaatatgcaggatcttcatccgttgtcattggtgatgtcgactgtactcaacaccaagaactctgctcaaaatatggagtctccggatacccaactcttaaatactggaaagatggagagaaacatgcctattctggaggacgcgactttgatcggacttaaaaaattcgttgttaataatctccaagtcttctgccatgtc

SEQ ID NO: 35324 - protein, 113 aa, Panicum virgatum
  misc_feature: Ceres CLONE 1960924
  misc_feature (16)..(112): Pfam Name: Thioredoxin Pfam Description: Thioredoxin
  misc_feature: SWISSPROT Homolog: EC 5.3.4.1 Protein disulfide-isomerase
MLRLLSLCLFLAVNAGPTVLDATTFDDTVINGGKNAFVKFYAPWCGHCKAMAPAWGPLGDEYAGSSSVVIGDVDCTQHQELCSKYGVSGYPTLKYWKDGEKHAYSGGRDFDRT

SEQ ID NO: 35325 - DNA, 680 bp, Panicum virgatum
  misc_feature: Ceres CLONE 1960930
  misc_feature: Encodes the peptide sequence at SEQ ID NO. 35326
caacccatcgacaaactcgactactaaccatctccagcatcaatcggtcaagatggttaaccttacgacccagaagcggctggcgtcgtccgtgctgggctgcggccagcgcaagatctggctcgaccccaacgaggtgtccgagatctccaacgccaactcccgtcagacgatccgcaagctcgtctccgatggcctcatcatcaagaagcccgtcaccatgcactcgcgctcgcgcgcgcgggagctgaacctcgcccgccggatcggccgtcaccgcggcttcggtaagcgcaagggtaccgccgatgcccgtatgcccgagcaggttttgtggatgcgccgccagcgggtcctccgccgtctgctcgtcaagtaccgtgccagcggcaagatcgacaagcacctctaccacgagctctaccacctcgccaagggtaacaccttcaagcacaagcgggcgctcgttgagcacattcaccgtgccaaggcggagaaggcgcgtgagaaccagatcaaggaggagatggacgccaagcgcgcgcgcaccaaggcggcccgcgagcgcaagctggagaggcaggcggcgaagcggaacgcgttgatgggcgaggccgaggaggaatccaagtagatttcaacagggaccaagtgaaatggacaacatggatttctcggcg

SEQ ID NO: 35326 - protein, 193 aa, Panicum virgatum
  misc_feature: Ceres CLONE 1960930
  misc_feature (2)..(149): Pfam Name: Ribosomal_L19e Pfam Description: Ribosomal protein L19e
MVNLTTQKRLASSVLGCGQRKIWLDPNEVSEISNANSRQTIRKLVSDGLIIKKPVTMHSRSRARELNLARRIGRHRGFGKRKGTADARMPEQVLWMRRQRVLRRLLVKYRASGKIDKHLYHELYHLAKGNTFKHKRALVEHIHRAKAEKARENQIKEEMDAKRARTKAARERKLERQAAKRNALMGEAEEESK

SEQ ID NO: 35327 - DNA, 734 bp, Panicum virgatum
  misc_feature: Ceres CLONE 1960948
  misc_feature: Encodes the peptide sequence at SEQ ID NO. 35328
ctctctctctctctctctctctctctacaagcggcgacgacaggggagtggcgccgccttgcccgttcttcgtcggacgcttcgccggccgacaagcatcgttaagcacagtatgtcggagaaaccatctgatgctgcaactggtgatgtgaggcctgaagatattgtttctgatgagaaagtggaaggttctgatcagaatgaaagagatggtatgccttcgccacaacaagaggaagcagcgatcaagaaaaagtacggaggaataatgcccagaaagacaccacttatttccaaggaccatgagcgagcatactttgattctgctgattgggctttggggaagcaaggaggaaatcatcaaaaacctaaaggaccgctcgaagcgcttcgaccaaaattacagcctactcaacaacaaactcgttcacgtcgatttcttggtgaatctgctgacaacgaagagagtgtccattcgcctactgaggatgtcaattcacctactgaggatgtcaattcacctactgaggatgcaggccagaaccaggataacgctgaaggcaagggcaaggaatgatgggcggttccaagttttgtctatgattttctgcttaaagcaataagcactcgggtgcatgtaatgatcatgccccgtgaggtcaagctgagtttcgaattgtcaaatgccgtaactacatgttatgttgttccatttgtgacgcctattgcccatt

SEQ ID NO: 35328 - protein, 154 aa, Panicum virgatum
  misc_feature: Ceres CLONE 1960948
  misc_feature (46)..(136): Pfam Name: Lg106 Pfam Description: Lg106-like protein
  misc_feature: Functional homolog of the protein sequence given in SEQ ID NO 50181
  misc_feature: Useful for biocontainment applications
MSEKPSDAATGDVRPEDIVSDEKVEGSDQNERDGMPSPQQEEAAIKKKYGGIMPRKTPLISKDHERAYFDSADWALGKQGGNHQKPKGPLEALRPKLQPTQQQTRSRRFLGESADNEESVHSPTEDVNSPTEDVNSPTEDAGQNQDNAEGKGKE

SEQ ID NO: 35329 - DNA, 614 bp, Panicum virgatum
  misc_feature: Ceres CLONE 1960956-R
  misc_feature: Encodes the peptide sequence at SEQ ID NO. 35330
gaagggacacaagctttatacagaattggtaaaggggaagcaccagcaattcctagtggtctttcaaaggatgcccgtgattttataagccagtgtgtaaaacccaatcctgaagacagaccttcagcatcgaaattgttggagcatccattcgttaacaggtcaataaggtcggtacggtctatgaggacatcttcacgctcaaattcatctacacgtggcatcaactgatgagcggggatcatttgtagcagaatgatattagtcaccgctaatcatgcggagctggctgaaagggagggtggcttgcctggagctagtattgtaaacgctcaacagcatcctcgtcaaccttgttattttccattagttgattctttgacatacgtttgagggaagaaagatgtcctcgtgtttcagccgccggctaatattcttctgcccggaggagttagaacagtgaatgcgcattgtagcgcatgagttgtagagtggaaacgggcgatgtaaatatgtcagcgtgtccacgtggggatttgtcttgatgccatgatatgttgctatgagaaaaagaaaaatatagaaggaaaaaaaatcgaagctttggaactgtc

SEQ ID NO: 35330 - protein, 76 aa, Panicum virgatum
  misc_feature: Ceres CLONE 1960956-R
  misc_feature: SWISSPROT Homolog: EC 2.7.11.25 Mitogen-activated protein kinase kinase kinase
EGTQALYRIGKGEAPAIPSGLSKDARDFISQCVKPNPEDRPSASKLLEHPFVNRSIRSVRSMRTSSRSNSSTRGIN

SEQ ID NO: 35331 - DNA, 371 bp, Panicum virgatum
  misc_feature: Ceres CLONE 1960956
agcgaaccagaaaaaatcgcccccgccctgccgtgtctccgctcccgcatccccaagcggagctctcgctttcggcgcgcgctcccgtccggcccccgcatcctccaggcctccagggcgccccatgagctgaggccgccgccgatgggcccgccccccgccgcgcaggaccccgcgccgtcgccgtcgggcggcagcggctcctccaggcgccgcctccgccggctcgaccgccgcaacgcgtccaagaacatcggctacgacgccaccaacttctgccagttcccgctgtccccgcagccggcctccgcgccggcgtcggggccggcctcgctcgccggctccgacgccggcgcggaggacggcggcgg

SEQ ID NO: 35332 - DNA, 1297 bp, Panicum virgatum
  misc_feature: Ceres CLONE 1960976
  misc_feature: Encodes the peptide sequence at SEQ ID NO. 35333
tgatccccactctcttcgtccccgccaggcgccggcggcagccaaagcaaccaaccctaatctgcacggcgaccgacgacgccgcatcctgccgctcccgttcctcgaggccccacgaaactccagccctcttcagttcagccatgacatcggaggacgaagctaacgccgcggcggtggcggcggaggagggtgcggaggcgacggaggggaaaaactggcggcggaaggggaagcacgacaagcccaagccgtgggacgaggaccccaacatcgaccactggaagatcgagaagttcgacccatcctggaacgagggcggcatgctcgaagtcaactccttctccaccctcttcccccagtaccgagagaagtacctgcaggagtcgtggccgatcgtgaagggcgcattgaaggagcacggtatctcgtgcgagcttaatttggtggagggatccatgactgtttcaaccaccaggaagaccagggatccctacattattgttaaggccagggaactgataaagctattgttgggcattcaggcgatcaaaattctcgatgatgagatgaactgtgatattataaagattggtggccttgtaagaaataaggaacgatttgttaaaaggagagaacgccttttaggccctaatttatctacacttaaggccattgagattttgactggctgctacatcttagtgcagggaaacacagttgcagccatgggttcctatactggaaggggactgaaacaagttagaaggattgtagaggattgcatgaagaatctcaagcatccagtgtaccacatcaaggaactcctaatcaaacgcgagctagccaaaaatcctgctctagccactgaaaactgggataggtttctaccgaagttcaagaagaagaatgtcaaacagaagaagcctcaaactaaggagaagaaaccatacacaccctttccgccacctcaacagcctagcaagatcgatgctcaacttgaaactggtgagtatttcatgagtgagaaaaagaaatcagcaaagaaatggcaagagaagctggagaagcaatcagggaaagctgaagaaaacaaaagaaagagagaggctgcatttgttcccccaaaggagaacactgcaggtccatctgaatctgtcaagactgccaatgacaatagtgagatagctgatatagccaagtcattaaaggaaaaggcaaaggaattcagaaagaacaaggcccaagagaatgtcagagctgaatcgtatcttgcaagtaatgaagaaccatgccc

SEQ ID NO: 35333 - protein, 384 aa, Panicum virgatum
  misc_feature: Ceres CLONE 1960976
  misc_feature: Functional homolog of the protein sequence given in SEQ ID NO 50556
  misc_feature: Useful for biocontainment applications
  misc_feature: Useful for making plants with modulated biomass
  misc_feature: Useful for making plants with modulated flowering time
MTSEDEANAAAVAAEEGAEATEGKNWRRKGKHDKPKPWDEDPNIDHWKIEKFDPSWNEGGMLEVNSFSTLFPQYREKYLQESWPIVKGALKEHGISCELNLVEGSMTVSTTRKTRDPYIIVKARELIKLLLGIQAIKILDDEMNCDIIKIGGLVRNKERFVKRRERLLGPNLSTLKAIEILTGCYILVQGNTVAAMGSYTGRGLKQVRRIVEDCMKNLKHPVYHIKELLIKRELAKNPALATENWDRFLPKFKKKNVKQKKPQTKEKKPYTPFPPPQQPSKIDAQLETGEYFMSEKKKSAKKWQEKLEKQSGKAEENKRKREAAFVPPKENTAGPSESVKTANDNSEIADIAKSLKEKAKEFRKNKAQENVRAESYLASNEEPC

SEQ ID NO: 35334 - DNA, 677 bp, Panicum virgatum
  misc_feature: Ceres CLONE 1960992
  misc_feature: Encodes the peptide sequence at SEQ ID NO. 35335
ggggggggcatcgtcgtcgtgctctgctcgcatcgcatcgcctcgcccagcgtcaatctctcaacagcagcccgggctcctctcctcccgccccccattccctcgttcctcggttcctcctcctcggccctcgcccagcccggccggcgcccgcgctccgcatgtcaatccatgggctgatcctggaagtcagagtcaccgggtgccggaagctgcgggacacggagttcttcacccgccaggacccctacgtcgtgctcgagtacgccaccaccaagctccgcacccgcacctgtaccgatgggggaagaaacccaactttcgatgagaagttccatatacccctcattgaagggctccgcgagttgaatgttatcgtttggaacagcaacacattatcccacgatgacttcatcggcagtggcagagtatatctgcacaaggtgctcgcaaatggatatgatgattcctcatggccacttcagacacgccacatgagatctgctggggaagtgaagctcattatgcatgttgatgtctcagcaatgaagaacaaaatgggtaaaagtatcggtgcagcaagtacacattctgttcctccaccttcagtgccagccccagcccgagtcccagtcccagtcccagctgcagccgcagcaccagcactagcatcagca

SEQ ID NO: 35335 - protein, 171 aa, Panicum virgatum
  misc_feature: Ceres CLONE 1960992
  misc_feature (8)..(89): Pfam Name: C2 Pfam Description: C2 domain
  misc_feature: SWISSPROT Homolog: EC 3.1.1.4 Phospholipase A(2)
  misc_feature: Functional homolog of the protein sequence given in SEQ ID NO 50391
  misc_feature: Useful for making plants with altered carbohydrate content
  misc_feature: Functional homolog of the protein sequence given in SEQ ID NO 50362
  misc_feature: Useful for making plants with altered cell wall content and/or composition
MSIHGLILEVRVTGCRKLRDTEFFTRQDPYVVLEYATTKLRTRTCTDGGRNPTFDEKFHIPLIEGLRELNVIVWNSNTLSHDDFIGSGRVYLHKVLANGYDDSSWPLQTRHMRSAGEVKLIMHVDVSAMKNKMGKSIGAASTHSVPPPSVPAPARVPVPVPAAAAAPALAS

SEQ ID NO: 35336 - DNA, 683 bp, Panicum virgatum
  misc_feature: Ceres CLONE 1960994
  misc_feature: Encodes the peptide sequence at SEQ ID NO. 35337
gtttccctcctccctctcgtcctctctcctgtttctttctctcttctccgttcccccacccgccgccgtgcgcgcagcggacgggaggctgccgtaacagggaggagctcgcatcgttgcagcgtcaggcgcaatggcgtccccccgcgcctgaccatgcattctaggttgttcaagaggctcgcgaagaggatcatgtgacgacgccttgcgtcgtctggatcgtcgcgcgctgcagaggaaatagcgtgcgggatggatggcttcatttcgtcgtggatggtgttcgtcgcgctggcactttatctcgccgtggatggctgctcggctatcaactttgaagggacagcgctgctcaagttccagtcaagggtggaggaggatccacacagcgctatggcaggttggaacccacgcgactgcgatccctgcagctgggacggcattcgctgcgtcgatggcagggttgtgatgctgaatctgaagggtctatcgttaagaggcacccttggtccagagctaggaactcttagccatctgagggctcttgtactctccaataactttttcagtggaccgatacctaaggaattgagtgctcttgcaatgttggagatactggatttaagcaacaacaacttgagcggagaagttccacaggagatagcagaaatgcaatctct

SEQ ID NO: 35337 - protein, 142 aa, Panicum virgatum
  misc_feature: Ceres CLONE 1960994
  misc_feature (26)..(67): Pfam Name: LRRNT_2 Pfam Description: Leucine rich repeat N-terminal domain
  misc_feature: SWISSPROT Homolog: EC 2.7.11.1 Non-specific serine/threonine protein kinase
MDGFISSWMVFVALALYLAVDGCSAINFEGTALLKFQSRVEEDPHSAMAGWNPRDCDPCSWDGIRCVDGRVVMLNLKGLSLRGTLGPELGTLSHLRALVLSNNFFSGPIPKELSALAMLEILDLSNNNLSGEVPQEIAEMQS

SEQ ID NO: 35338 - DNA, 1131 bp, Panicum virgatum
  misc_feature: Ceres CLONE 1960997
  misc_feature: Encodes the peptide sequence at SEQ ID NO. 35339
cttgcccccagacctattccgcctttccagcctccggccgccaacaacgtgatggcgaagaagagcaaagccccggccgacgccgctgctgccgcctccgcctccgcggcggcggatgagacgggcgtatcgaacccccagggctccgcccacggcagcgagggcggcggggcgaaggagggcgccttccttctggggcaaccgacctgggaggacgccgggggcgggcggtggcgttgcgcggagacggggcacgagctgccggagcgggagaaggagtcctacgcgcggtcccacgcctgccgtctcgcgcttatcgaccacgccgtcgcgcgcaagaagccgccgctcaacgccttcaagccccaccccgagcacaagtcgaagctggtatgcaacattacaggggatacagttaacaagtcggaggagcatatatggaagcacatcaacgggaagagatttcttaacaagctagaaaagctagaagaacagatggcttctggtgagatggctaatggagaaactgcaaagtcaaatgaaatggaaaagaagagcaagtcaagcaagaaggacaaaaaggacaagaaaggcaagaagaaaactaatgttgccagtccttctgtgccacgagaacctaaaccagagatggatgattcggatgatccagatttttgggtgcctcctgtcggaagtcgctgggatgatgatgacgggaaagacagatgggagtcgtcaccagggaagaatgactcagcaaagaatgaaggtggttctgatgatgatgacggtggtgataatgacgatggcaacgatgatgatatggctgacaaggatgatgctgaatcaagggaacttgcttcgagcaggacaaagcgaatgtcactagaagcagttgggccaagtagcttcgcttcaaggaagaaaaaacccaagaaggagcagtaacagttgattgatttatatctattgggtttcttgggttgggtaatcaatggctgtttttgtgtgttttaaagcatttttggttcaacgcttgtcggattgagataatatgtacgtaagctgcaggagatctttggaaaacatcccgaaaggtgcttatttactggtaacaactgacttgggtcc

SEQ ID NO: 35339 - protein, 298 aa, Panicum virgatum
  misc_feature: Ceres CLONE 1960997
  misc_feature (41)..(291): Pfam Name: SURF2 Pfam Description: Surfeit locus protein 2 (SURF2)
MAKKSKAPADAAAAASASAAADETGVSNPQGSAHGSEGGGAKEGAFLLGQPTWEDAGGGRWRCAETGHELPEREKESYARSHACRLALIDHAVARKKPPLNAFKPHPEHKSKLVCNITGDTVNKSEEHIWKHINGKRFLNKLEKLEEQMASGEMANGETAKSNEMEKKSKSSKKDKKDKKGKKKTNVASPSVPREPKPEMDDSDDPDFWVPPVGSRWDDDDGKDRWESSPGKNDSAKNEGGSDDDDGGDNDDGNDDDMADKDDAESRELASSRTKRMSLEAVGPSSFASRKKKPKKEQ

SEQ ID NO: 35340 - DNA, 667 bp, Panicum virgatum
  misc_feature: Ceres CLONE 1961010
  misc_feature: Encodes the peptide sequence at SEQ ID NO. 35341
ctctctccgcctcccccattcctcttcccctgcgatccggggccgcacccgcagggaggagaagcgatcacctgatcaccagggcgacgcctcgcgatctcgcgcaggagcggagatggggctcacgttcacgaaactgttcagccgcctctttgccaagaaggagatgaggatcctcatggttggtctcgacgcggctggtaagaccaccatcctctacaagctcaagctcggcgagatcgtcaccaccatccccaccataggtacgcctttcatccctatgtcttgattcactactgttatacttgcttgtaatgttaactgttggtattttgggagtgcacgcagtcttgaatccttactctagtttgagccttggactatgtgctacgtagccttaaggaatgttctatttttgcatgacaacagataccctttgaggaaagttcctttcgaaacaatggtttcgcctgacttaatggtagataaatattttaggatctagttcacacttgatatttacttgaatatttgtataagtgaatcttattttagaatttgtatgctaggtgatgcagaatgcctacatgtttcatctcatctgttggctttctgaagtttcagtctttctgtgtcctgtatgttgactttcacaggattttacgtt

SEQ ID NO: 35341 - protein, 57 aa, Panicum virgatum
  misc_feature: Ceres CLONE 1961010
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content
MGLTFTKLFSRLFAKKEMRILMVGLDAAGKTTILYKLKLGEIVTTIPTIGTPFIPMS

SEQ ID NO: 35342 - DNA, 693 bp, Panicum virgatum
  misc_feature: Ceres CLONE 1961016
  misc_feature: Encodes the peptide sequence at SEQ ID NO. 35343
aacaaagcccatccaacaaacaaaccttgaggcgcttggctgacagagaagagacacaaaccgagctttgcctgtggccggccaagcatggccaccgtggggcagcctggcgccctgagaaggatcaccgtgcactacgccaactcgcccacgcgcagcacgggagatgcggaccttgacgagctagaagaagacctgctccagtctgtgttcgctgatcttcttccttgtcaggagggtttgcaccaatccatcttggaagaagcatccagcaaccaaaaccacatgagaggtgccccatctgataattcacagtcacagcactaccatggggagagcagcactgctgcagcagcagcagcgactgcttccggaacttcaggaacggaagaacagatcgcctcggactttgagtacgccaagctactgcaggagatggaggacctgagcatcgaagatgacgatatcagttgcgtaccctctccatcagactctgactctgacgatgaccatgaccataacgacgaagaggctgacaggcaggatggtaatgatgatgatccagacaacatgacttatgagcaaaggcaagcactcgtggaagctgtggggactgaggacagaggtttacctgatgagctcatctcctatctgcacacatggaagtacaaggtctcatgggtttttctccag

SEQ ID NO: 35343 - protein, 201 aa, Panicum virgatum
  misc_feature: Ceres CLONE 1961016
  misc_feature: Functional homolog of the protein sequence given in SEQ ID NO 51382
  misc_feature: Useful for making plants with altered terpenoid content
MATVGQPGALRRITVHYANSPTRSTGDADLDELEEDLLQSVFADLLPCQEGLHQSILEEASSNQNHMRGAPSDNSQSQHYHGESSTAAAAAATASGTSGTEEQIASDFEYAKLLQEMEDLSIEDDDISCVPSPSDSDSDDDHDHNDEEADRQDGNDDDPDNMTYEQRQALVEAVGTEDRGLPDELISYLHTWKYKVSWVFL

SEQ ID NO: 35344 - DNA, 1203 bp, Panicum virgatum
  misc_feature: Ceres CLONE 1961031
  misc_feature: Encodes the peptide sequence at SEQ ID NO. 35345
catatcctggggaaagctacttgcagtattctgttttgcaatgatgacaagtagtatacttaatcagtcaattgcaacttatcataattgtgatactttcttcttggcttggaagttgatattaccgctttgcatggctttgctaacttaatttcttccattttcttggaggagtaccttgaagaacatccagaagttactgtcctcgaccctccaaatgctatcgagcatctgaacaatcgacaatcaatgcttgaggaagtagctgatttgaacctatcaaatttctatggagaagtttgtaccccacgccaactggtcattacgaaagatccatcctctataccaacagcagtagcaatggctggtctaactttgcccttggttgccaagccattggttgttgatggaacatcaaaaggtcacgaactatatcttgcatatgatgaggcctccttgtcaatgcttcatccacctctggttctacaggaattcataaaccatggcggtatcctctttaaggtctatatcattggtgaaacagtacaagttgtccgcaggttctctcttcctgatgtcaacacatatgacttgctaaacaacgttggcatctatcgattgccaagagtttcatgtgccgcagctagtgcacatggtgcagaccttgaccctcttattgtagagcttcctccaaggccacttctagagaaactggggagggagcttcgtagccggctggggttgagattgttcaatgttgatatgattagagaacttggaaacaaagatcggtactacataattgacatcaactacttcccaggttttgggaaaatgccaggatatgagcacatgttcactgacttcttactgagtcttgcacaaagcaagtacaaaaggtacttaagcgggacctgaagcgcaagggagtttgcgaagaggcgtcactgacaaaatggcatataacggtggcagctgtgcttccccaccgatgtacaaattccggagacataagcataagccggaggctcgaggaagttgcagtgtgtttcttcagaagtggtggtacatgctggatcctgagtaggaataaccaaggaaatgtttggatggcctatgcccatgtagtaaaatgttgtttactgaatgcataccttcttcgtgatggcctcctttcatcataatttggcgaccggttttttt

SEQ ID NO: 35345 - protein, 222 aa, Panicum virgatum
  misc_feature: Ceres CLONE 1961031
  misc_feature (1)..(209): Pfam Name: Ins134_P3_kin Pfam Description: Inositol 1, 3, 4-trisphosphate 5/6-kinase
MLEEVADLNLSNFYGEVCTPRQLVITKDPSSIPTAVAMAGLTLPLVAKPLVVDGTSKGHELYLAYDEASLSMLHPPLVLQEFINHGGILFKVYIIGETVQVVRRFSLPDVNTYDLLNNVGIYRLPRVSCAAASAHGADLDPLIVELPPRPLLEKLGRELRSRLGLRLFNVDMIRELGNKDRYYIIDINYFPGFGKMPGYEHMFTDFLLSLAQSKYKRYLSGT

SEQ ID NO: 35346 - DNA, 724 bp, Panicum virgatum
  misc_feature: Ceres CLONE 1961033
  misc_feature: Encodes the peptide sequence at SEQ ID NO. 35347
aaaaatctcgatttcccggagtgagttcgcgcccctccactccaccaccgttcccaaatgtcctccggacaccatctcgccgtcgccgccgtcgccgcagtgctattcctcctctcgccgccgccgccttgcgcggccgaccccgacgacgagcgctgcctgtctcacctccaccagtccctctccgacccctccggcgggctccgcaactggaccaaggcggcgttctcggcgccgtgcgacggcgtcttctcgcacctccagggcgtgacctgcaacaacgggcgcgtgtacaaactcgccctcccggggctctccctcggcggcgccatcccgcccgagctctccaactgcaccggcctccagtcgctggacctctccgccaacgcgctgtccggcgccatcccgccggagctctccgcgctgctcaacctcgccgtgctcaacctctcctccaacgcgctctccggcgccatcccacgggagctcgccggctgcgcctacctcaacgtcatagatctccacgccaaccagctctccggccccatccccgacgagcttggcctcctcgtccgcctctccaccttggacgtctccgacaaccgcctctccggccccatccccgtgctcctcgccaaccgcaccggtggcggcacggcggccgtcgggacggcgaggttcaatgccagctcgttcgcggggaacaaggggcctgtacgggtac

SEQ ID NO: 35347 - protein, 222 aa, Panicum virgatum
  misc_feature: Ceres CLONE 1961033
  misc_feature: SWISSPROT Homolog: EC 2.7.11.1 Non-specific serine/threonine protein kinase
MSSGHHLAVAAVAAVLFLLSPPPPCAADPDDERCLSHLHQSLSDPSGGLRNWTKAAFSAPCDGVFSHLQGVTCNNGRVYKLALPGLSLGGAIPPELSNCTGLQSLDLSANALSGAIPPELSALLNLAVLNLSSNALSGAIPRELAGCAYLNVIDLHANQLSGPIPDELGLLVRLSTLDVSDNRLSGPIPVLLANRTGGGTAAVGTARFNASSFAGNKGPVRV

SEQ ID NO: 35348 - DNA, 168 bp, Panicum virgatum
  misc_feature: Ceres CLONE 1961042
  misc_feature: Encodes the peptide sequence at SEQ ID NO. 35349
cgtcatctacctccaccagtggccctctttcctcgactccgccaaggacgacgccggctccaggctccccatggtccccaccgagcacatcctccccgaacacccccggtccccaccttttacttctgatgactcacctgcttctgctgaccccctatctctagctag

SEQ ID NO: 35349 - protein, 55 aa, Panicum virgatum
  misc_feature: Ceres CLONE 1961042
  misc_feature: Functional homolog of the protein sequence given in SEQ ID NO 51338
  misc_feature: Useful for making plants with altered alkaloid content
VIYLHQWPSFLDSAKDDAGSRLPMVPTEHILPEHPRSPPFTSDDSPASADPLSLA

SEQ ID NO: 35350 - DNA, 1229 bp, Panicum virgatum
  misc_feature: Ceres CLONE 1961045
  misc_feature: Encodes the peptide sequence at SEQ ID NO. 35351
acggcgaccccgacgactccgcccgcgtccccgatcccgcccaccaccaccccctccccgccgtcgatccacgcgtccaagcgccgtcgccgcgggcccgccgccacggggaactccccgtcccgccgcccctccgggggcggcacccgcgggggcgggcgacaagcgctcccggcggcggggttcgacccgctcgacccgtgcgccgagccgccggcctggagcctcacgccgggccaggtcggccgatgcaagagggcggtcaagctgctcgagaagaggctcagggaccccgacgcgctcgccaaggagttctggaagctcccggatataagaacagtgcttcaggaggcgcaaaagttttctgatgctaggagtcctgctaataggccaagaaaccgctacactgatgtcatgccatttgatgagaccagagtacgactaaagtcttcagccggcaatgattacataaatgcaagccttgtaatgactggcagcgaagcacaaacaaagtttatttctactcaaggtccactaaccagtacaattgaagatttttggcagatggtttatgagaaccactgtcctgtgattgttatgctcaccaaaattgatggtctaaagtgtgatgagtaccttccattgagtacgggacatgggaaatacgggaaatttaacattaagatcacgaagagccaaaaaaatggtcagttagtgttgcgttgtgtgcaggtgcaaaaagatgagtcagttgaagtacagactctactccacattgagcactctgaatggcctgaccatggggtgccaaataacagtactgctgtacaacaaatactaaaaagattacagtgcatcccaaaagaatatccaatagttgcacattgcagtgctggcatcggaagaacaggtgcttatatcaccatccataatacaatagagaagattttacatgatgaaaagggtgctttggatcttgcagaaaccataagaaaatttaggtcacagcgacctggaatggtccaaacagaggaacagtacagcttttgttatcatgcagttgcggacattctaagcgatatgttatcgacttcagtacactaaatttggtttccaagggacaatgtaatatcagcggtgtgcactgccctgacctattcggctgtctgttgccccttgagagtacctcaaatttgtttaggtggctggtgcaacaggattttcagccg

SEQ ID NO: 35351 - protein, 367 aa, Panicum virgatum
  misc_feature: Ceres CLONE 1961045
  misc_feature (129)..(356): Pfam Name: Y_phosphatase Pfam Description: Protein-tyrosine phosphatase
  misc_feature: SWISSPROT Homolog: EC 3.1.3.48 Protein-tyrosine-phosphatase
TATPTTPPASPIPPTTTPSPPSIHASKRRRRGPAATGNSPSRRPSGGGTRGGGRQALPAAGFDPLDPCAEPPAWSLTPGQVGRCKRAVKLLEKRLRDPDALAKEFWKLPDIRTVLQEAQKFSDARSPANRPRNRYTDVMPFDETRVRLKSSAGNDYINASLVMTGSEAQTKFISTQGPLTSTIEDFWQMVYENHCPVIVMLTKIDGLKCDEYLPLSTGHGKYGKFNIKITKSQKNGQLVLRCVQVQKDESVEVQTLLHIEHSEWPDHGVPNNSTAVQQILKRLQCIPKEYPIVAHCSAGIGRTGAYITIHNTIEKILHDEKGALDLAETIRKFRSQRPGMVQTEEQYSFCYHAVADILSDMLSTSVH

SEQ ID NO: 35352 - DNA, 1233 bp, Panicum virgatum
  misc_feature: Ceres CLONE 1961055
  misc_feature: Encodes the peptide sequence at SEQ ID NO. 35353
aaaaaaccctaaacccctctcctctgcttatggcgccgcctccgccgccgccgaaacagcttgtgctggctgcgtcctccgcggacgccggcgtggccgcctgggacctccgcaccggcgcggaggaaatccgccaccgcccctgcgcctcccgccctcgcgcgctcacctcggtcgccgaccgcttcctcgccgctgcacaggcccctcccgctggcggcaactccggcaccgtccacttctaccactgggacaaggtggccgtcaagagcttccccgctgagcctatacgcgcgcttcttgcggaccaggaggggagctacctcattggcggtggcagcaacggcaacttattcctttgggaggtggctagtggagagcttctccagacatggcatgcacactatcgtgctgttaggtgcctcgcgctttatgactatctgcttgtctcaggatcagaggatggaagcatcaaagtctgggatctgatcacggtgcttgatgagcagtcaaggttggaggcccagacaccatacctctacagtttcaatcagcatgcactgcctgtaactgatattgcttgtttccttggagcaattgctgtatcttcttcagaagatcgaacctgcaaaatctggagtttatctgagggtaggttgctaagaagcattccattccctactagcattgattctgtagcactagacccaagaagtcatgttttctatgctggtggtagagatggaaagatatatgttactgcaatgggtgttgatatcagttctcatggtagtgatgagtcagctattcttggtgctttggatgaccaaagcaaggcagtaacaagcttggcatcaagcacagatggacttttactagtttctggatctgaggatggtaatgttcgggtatgggatactagaagtcagcaagtaacccgaaaattcaaacactcccaaggtccagtaaccaatgttctgatagtaacaccaaaacgtgtaatcctgcccccactacatccattgcagaaagtttgctcagcaaatggtgaagttgaaccacgtgctgtaattctgcctcggcctgaaaatgatgttcctattcatgggaaatcgaacctcaatttttatggagcactacttggatgaacttcagaagtatggtggtacgtctttgatatttggttctggtctgcgtactcagaattgcacacctaaacaacaagggacagaa

SEQ ID NO: 35353 - protein, 372 aa, Panicum virgatum
  misc_feature: Ceres CLONE 1961055
  misc_feature (116)..(152): Pfam Name: WD40 Pfam Description: WD domain, G-beta repeat
  misc_feature (258)..(296): Pfam Name: WD40 Pfam Description: WD domain, G-beta repeat
  misc_feature: SWISSPROT Homolog: EC 2.7.11.7 [Myosin heavy-chain] kinase
MAPPPPPPKQLVLAASSADAGVAAWDLRTGAEEIRHRPCASRPRALTSVADRFLAAAQAPPAGGNSGTVHFYHWDKVAVKSFPAEPIRALLADQEGSYLIGGGSNGNLFLWEVASGELLQTWHAHYRAVRCLALYDYLLVSGSEDGSIKVWDLITVLDEQSRLEAQTPYLYSFNQHALPVTDIACFLGAIAVSSSEDRTCKIWSLSEGRLLRSIPFPTSIDSVALDPRSHVFYAGGRDGKIYVTAMGVDISSHGSDESAILGALDDQSKAVTSLASSTDGLLLVSGSEDGNVRVWDTRSQQVTRKFKHSQGPVTNVLIVTPKRVILPPLHPLQKVCSANGEVEPRAVILPRPENDVPIHGKSNLNFYGALLG

SEQ ID NO: 35354 - DNA, 702 bp, Panicum virgatum
  misc_feature: Ceres CLONE 1961065
  misc_feature: Encodes the peptide sequence at SEQ ID NO. 35355
atccacaagagaagacttcttctcttgtaacatagcgcagcaaaggttacttacatggcaacttccatgggttgcctcgtcttgctctgccttgtttctcccctcctccttgccagtgccgtccacggccacccatggggcggcttgttccctcagttctacgaccattcatgccccaaggcgaaggagattgtgcagtccattgtagcacaggctgtggccaaggagaccaggatggcggcatccttggtcagactgcatttccatgactgctttgtcaaaggctgtgatgcatccgtgctgttggacaacagcagcagcatagtcagtgagaaagggtctaaccccaaccggaactcactcagggggtttgaggtggtcgaccagatcaaggccgctctcgaggctgcctgcccaggcactgtctcctgcgccgacatcctcgcccttgcagcccgtgactcaactgtcctggttggtggcccatactgggatgtgccacttggccggagggattcgctcggtgcaagcatccagggttccaacaacgatatcccagcccccaacaacaccctcccaaccatcattaccaagttcaagcgccaaggcctcaacgttgtggatgtcgtcgccctctctggtggccacaccataggtatgtctcggtgcaccagcttccggcagaggctgtacaaccaatcg

SEQ ID NO: 35355 - protein, 211 aa, Panicum virgatum
  misc_feature: Ceres CLONE 1961065
  misc_feature (43)..(211): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51032
  misc_feature: Useful for making plants with altered carbohydrate content
  misc_feature: Functional homolog of the protein sequence given in SEQ ID NO 51033
  misc_feature: Useful for making plants with altered cell wall content and/or composition
  misc_feature: Functional homolog of the protein sequence given in SEQ ID NO 51034
  misc_feature: Useful for making plants with modulated nitrogen use efficiency
  misc_feature: Functional homolog of the protein sequence given in SEQ ID NO 50564
  misc_feature: Useful for making plants with modulated phosphate use efficiency
MGCLVLLCLVSPLLLASAVHGHPWGGLFPQFYDHSCPKAKEIVQSIVAQAVAKETRMAASLVRLHFHDCFVKGCDASVLLDNSSSIVSEKGSNPNRNSLRGFEVVDQIKAALEAACPGTVSCADILALAARDSTVLVGGPYWDVPLGRRDSLGASIQGSNNDIPAPNNTLPTIITKFKRQGLNVVDVVALSGGHTIGMSRCTSFRQRLYNQ

SEQ ID NO: 35356 - DNA, 670 bp, Panicum virgatum
  misc_feature: Ceres CLONE 1961066
  misc_feature: Encodes the peptide sequence at SEQ ID NO. 35357
aacggcaaccgtgtttccgtttgcttcgcctggtcaccttccgcggtgcggggctgcctgcgtacgcggtcgtctccatccatccctagccccaactccaactcgtctcccccccaatcatcaaaaacctaaaccgaatcctccccttcgatcccaactccccaccccgagccgccttccaaccagattcctcgcggccccctcgcttccgcccgcccaatccccgagctcgccggcgccgaatccggtattttgagtttcggtcgcgagcgcagctatgtccatgttcaacaggatcttcgggaagcccaaggagcaggctaactccaatgcgctggccactctggacaagttaaatgagactcttgatatgctggagaagaaagaaaaggtgctggagaaaaaagcggctgctgagcttgagagggcgaaggagttctcaagagcaaagaataaaagagcggctatccagtccttgaagaggaaaaaactttatgaacaacaaatcgagcagcttggaaatttccagttgagaatccatgatcagatgatcatgttagaagcagctaaagcgacaacagagactgttgatgcattgaggactggagctgcagctatgaaagcaatgcaaaaagcaacaaatattgatgatgtcgacaagactatggat

SEQ ID NO: 35357 - protein, 130 aa, Panicum virgatum
  misc_feature: Ceres CLONE 1961066
  misc_feature (21)..(130): Pfam Name: Snf7 Pfam Description: Snf7
MSMFNRIFGKPKEQANSNALATLDKLNETLDMLEKKEKVLEKKAAAELERAKEFSRAKNKRAAIQSLKRKKLYEQQIEQLGNFQLRIHDQMIMLEAAKATTETVDALRTGAAAMKAMQKATNIDDVDKTM

SEQ ID NO: 35358 - DNA, 736 bp, Panicum virgatum
  misc_feature: Ceres CLONE 1961073
  misc_feature: Encodes the peptide sequence at SEQ ID NO. 35359
tatctaagcaaaccaagcacaagcaaattcaagaagtgtcgcgtagagcaatggcggctcaagctcaaactgtagtccccactgacgcggagctggtgcaggcgcaggctgacctgtggcgccacagcctatactacctcacgtcaatggcactgaagtgtgccgtcgagcttaacatccccacggcgatccaccgcctcggtggtgctgcatcacccactgaactgatctctgcactctctctcccagcttctaagctgccgttccttcgtcgcctgctgcggctcttggccgcctcaggcgtgttcagtgtcgacaggagcgctgaggaggggaaatactgcatcaaccccgtgtcctacctcttggtggatggcatccctgacgaggtgcacatcaaccacacgtccttcgtgctcacggccacctcgacacgctacgtcgatgcggccatgggcctggctgactggttcaagaaggatgtggtgacaccaccattcgaggagctgcatggagcaactttgttccacgagagtatggagagcctcgacgccgatttccacaagatggcgaatgaagcactggaagcccacgacaacttcgggatcccgattgcgttgcgggagttccgtgatttgttcaacgggatccagtcggtgacttactgctgcggcggctctggtgatgatgcagctgccaaggccattgtcaaggccttcccacacataaagtgcac

SEQ ID NO: 35359 - protein, 228 aa, Panicum virgatum
  misc_feature: Ceres CLONE 1961073
  misc_feature (33)..(81): Pfam Name: Dimerisation Pfam Description: Dimerisation domain
  misc_feature: SWISSPROT Homolog: EC 2.1.1.146 (Iso)eugenol O-methyltransferase
MAAQAQTVVPTDAELVQAQADLWRHSLYYLTSMALKCAVELNIPTAIHRLGGAASPTELISALSLPASKLPFLRRLLRLLAASGVFSVDRSAEEGKYCINPVSYLLVDGIPDEVHINHTSFVLTATSTRYVDAAMGLADWFKKDVVTPPFEELHGATLFHESMESLDADFHKMANEALEAHDNFGIPIALREFRDLFNGIQSVTYCCGGSGDDAAAKAIVKAFPHIKC

SEQ ID NO: 35360 - DNA, 713 bp, Panicum virgatum
  misc_feature: Ceres CLONE 1961093
  misc_feature: Encodes the peptide sequence at SEQ ID NO. 35361
accgtctcccttgccatttttgccgcaggagctagccgccggcagccgatccgggagagggccgacgagctggggctccggctgcaattcgattcgagcgaagccggttctctcgccggcggtccaggatggtgcgggggaagacgcagatgaagcggatagagaacgcgaccagccgccaggtcaccttctccaagcgccgcagcggcctgctcaagaaggccttcgagctctccgtcctctgcgacgccgaggtcgccctcatcgtcatctccccgcgcggcaagctctacgaattcgccagcggcaccggcagtgtgcagaaaacaattgaacgctatagaacatacacaaaggataacgtcagcagcaagacagcacagcaagatattgaggtgacaacactcaataaacagtagtagacttagttatatttcttgttgctgtaggttttagtggcttactagggctgtctaattgaatgcttgaatgttgacgttttatcagaagcttttgtctatcccgtggatctgtgagcttaacagcattaatgtgtctcttttcaattgtttaaatatgcttttgtcggatgttcatttcccagcggatgatgcttctactgaaacctgaagtataaaactatactggatcaaagcttggcagggttcaattagctaaaattttaaaacatgcgatggtgatatgatttaccc

SEQ ID NO: 35361 - protein, 96 aa, Panicum virgatum
  misc_feature: Ceres CLONE 1961093
  misc_feature (9)..(59): Pfam Name: SRF-TF Pfam Description: SRF-type transcription factor (DNA-binding and dimerisation domain)
  misc_feature: Functional homolog of the protein sequence given in SEQ ID NO 50571
  misc_feature: Useful for making plants with modulated flowering time
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 919 in the 10/666,642 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: Functional homolog of the protein sequence given in SEQ ID NO 51058
  misc_feature: Useful for biocontainment applications
  misc_feature: Useful for making plants with altered alkaloid content
  misc_feature: Useful for making plants with altered lignin content
  misc_feature: Useful for making plants with modulated biomass
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 30 in the 10/666,642 US patent application
  misc_feature: The sequence is a functional homolog of SEQ ID NO 28 in the 10/666,642 US patent application
  misc_feature: The sequence is a functional homolog of SEQ ID NO 32 in the 10/666,642 US patent application
  misc_feature: The sequence is a functional homolog of SEQ ID NO 14 in the 10/666,642 US patent application
  misc_feature: Functional homolog of the protein sequence given in SEQ ID NO 50970
  misc_feature: Useful for making plants with altered terpenoid content
  misc_feature: The sequence is a functional homolog of SEQ ID NO 4 in US patent 7057087
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: The sequence is a functional homolog of SEQ ID NO 707 in the 10/666,642 US patent application
  misc_feature: The sequence is a functional homolog of SEQ ID NO 42 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 6 in US patent 7279615
  misc_feature: The sequence is a functional homolog of SEQ ID NO 729 in the 10/666,642 US patent application
  misc_feature: The sequence is a functional homolog of SEQ ID NO 730 in the 10/666,642 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: Functional homolog of the protein sequence given in SEQ ID NO 50968
  misc_feature: Useful for making plants with modulated phosphate use efficiency
  misc_feature: The sequence is a functional homolog of SEQ ID NO 2 in US patent 7273968
  misc_feature: The sequence is a functional homolog of SEQ ID NO 46 in the 10/666,642 US patent application
  misc_feature: The sequence is a functional homolog of SEQ ID NO 731 in the 10/666,642 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 1470 in the 10/666,642 US patent application
  misc_feature: The sequence is a functional homolog of SEQ ID NO 284 in the 10/666,642 US patent application
  misc_feature: The sequence is a functional homolog of SEQ ID NO 2232 in the 10/374,780 US patent application
  misc_feature: The sequence is a functional homolog of SEQ ID NO 232 in the 10/225,068 US patent application
  misc_feature: The sequence is a functional homolog of SEQ ID NO 310 in the 10/225,066 US patent application
  misc_feature: The sequence is a functional homolog of SEQ ID NO 2191 in the 10/666,642 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: The sequence is a functional homolog of SEQ ID NO 2195 in the 10/666,642 US patent application
  misc_feature: The sequence is a functional homolog of SEQ ID NO 2189 in the 10/666,642 US patent application
  misc_feature: The sequence is a functional homolog of SEQ ID NO 1961 in the 10/412,699 US patent application
  misc_feature: The sequence is a functional homolog of SEQ ID NO 1884 in the 10/412,699 US patent application
  misc_feature: The sequence is a functional homolog of SEQ ID NO 352 in the 10/374,780 US patent application
  misc_feature: The sequence is a functional homolog of SEQ ID NO 384 in the 10/225,066 US patent application
  misc_feature: The sequence is a functional homolog of SEQ ID NO 946 in the 10/412,699 US patent application
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: The sequence is a functional homolog of SEQ ID NO 2197 in the 10/666,642 US patent application
  misc_feature: The sequence is a functional homolog of SEQ ID NO 1366 in the 10/666,642 US patent application
  misc_feature: The sequence is a functional homolog of SEQ ID NO 1730 in the 10/412,699 US patent application
  misc_feature: The sequence is a functional homolog of SEQ ID NO 207 in the 11/479,226 US patent application
  misc_feature: The sequence is a functional homolog of SEQ ID NO 64 in the 10/412,699 US patent application
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: The sequence is a functional homolog of SEQ ID NO 2193 in the 10/666,642 US patent application
  misc_feature: The sequence is a functional homolog of SEQ ID NO 1701 in the 10/412,699 US patent application
  misc_feature: The sequence is a functional homolog of SEQ ID NO 1453 in the 10/374,780 US patent application
  misc_feature: The sequence is a functional homolog of SEQ ID NO 14 in the 10/374,780 US patent application
  misc_feature: The sequence is a functional homolog of SEQ ID NO 328 in the 10/225,066 US patent application
  misc_feature: The sequence is a functional homolog of SEQ ID NO 34 in the 10/286,264 US patent application
  misc_feature: The sequence is a functional homolog of SEQ ID NO 468 in the 11/435,388 US patent application
  misc_feature: The sequence is a functional homolog of SEQ ID NO 68 in the 10/412,699 US patent application
  misc_feature: The sequence is a functional homolog of SEQ ID NO 2199 in the 10/666,642 US patent application
  misc_feature: The sequence is a functional homolog of SEQ ID NO 1110 in the 10/225,066 US patent application
  misc_feature: The sequence is a functional homolog of SEQ ID NO 166 in the 10/374,780 US patent application
  misc_feature: The sequence is a functional homolog of SEQ ID NO 1812 in the 10/412,699 US patent application
  misc_feature: The sequence is a functional homolog of SEQ ID NO 568 in the 10/412,699 US patent application
  misc_feature: The sequence is a functional homolog of SEQ ID NO 1945 in the 10/412,699 US patent application
  misc_feature: The sequence is a functional homolog of SEQ ID NO 1947 in the 10/412,699 US patent application
  misc_feature: The sequence is a functional homolog of SEQ ID NO 2 in US patent 7049489
  misc_feature: The sequence is a functional homolog of SEQ ID NO 1949 in the 10/412,699 US patent application
  misc_feature: The sequence is a functional homolog of SEQ ID NO 1971 in the 10/412,699 US patent application
  misc_feature: The sequence is a functional homolog of SEQ ID NO 1454 in the 10/374,780 US patent application
  misc_feature: The sequence is a functional homolog of SEQ ID NO 1973 in the 10/412,699 US patent application
  misc_feature: Functional homolog of the protein sequence given in SEQ ID NO 51059
  misc_feature: Useful for making plants with modulated nitrogen use efficiency
  misc_feature: The sequence is a functional homolog of SEQ ID NO 122 in the 10/225,066 US patent application
  misc_feature: The sequence is a functional homolog of SEQ ID NO 234 in the 10/374,780 US patent application
  misc_feature: The sequence is a functional homolog of SEQ ID NO 1965 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1963 in the 10/412,699 US patent application
  misc_feature: The sequence is a functional homolog of SEQ ID NO 1886 in the 10/412,699 US patent application
  misc_feature: The sequence is a functional homolog of SEQ ID NO 2146 in the 10/374,780 US patent application
  misc_feature: The sequence is a functional homolog of SEQ ID NO 948 in the 10/412,699 US patent application
  misc_feature: The sequence is a functional homolog of SEQ ID NO 1969 in the 10/412,699 US patent application
  misc_feature: The sequence is a functional homolog of SEQ ID NO 1967 in the 10/412,699 US patent application
  misc_feature: The sequence is a functional homolog of SEQ ID NO 215 in the 11/479,226 US patent application
  misc_feature: The sequence is a functional homolog of SEQ ID NO 470 in the 11/435,388 US patent application
  misc_feature: The sequence is a functional homolog of SEQ ID NO 2822 in the 10/374,780 US patent application
  misc_feature: The sequence is a functional homolog of SEQ ID NO 82 in the 11/375,241 US patent application
MVRGKTQMKRIENATSRQVTFSKRRSGLLKKAFELSVLCDAEVALIVISPRGKLYEFASGTGSVQKTIERYRTYTKDNVSSKTAQQDIEVTTLNKQ

SEQ ID NO: 35362 - DNA, 670 bp, Panicum virgatum
  misc_feature: Ceres CLONE 1961097
  misc_feature: Encodes the peptide sequence at SEQ ID NO. 35363
gactcactgcaatccggagctgagcactggacacgtacaaggaagaaacagtagccggagagcgagctcgtagctagtcaagtagtcctgcgaggcttggcaagagaggttaacaaggcgccggcattgtcgttcccggtcatcgacatgggtctgctcggtggggaggagaggccggcggcgatggagctgctgcgtgacgcatgcgagaactggggcttcttcgagattttgaaccacggcatctcgaccgagctgatggacgaggtggagaagctgaccaaggaccactacaagagggtgcgcgagcagcggttcctcgagttcgccggcaaggcgctccaggacggcggtgacgacgcgcgcggcgtcaaggcggagaacctggactgggagagcaccttcttcgtccgccacctcccggagtccaacctcgccgagctccccgacctcgacgacgggtaccgccgcgtgatgaagcggttcgccggcgagctggaggcgctggcggagcggctgctggacctgctgtgcgagaacctcggcctggagaagggctacctcgcgcgggccttccgcgggcccagcggcgtccccaccttcggcaccaaggtcagcagctacccgccgtgcccgcgcccggacctcgtgagcggcctgcgcgcgcaca

SEQ ID NO: 35363 - protein, 174 aa, Panicum virgatum
  misc_feature: Ceres CLONE 1961097
  misc_feature: SWISSPROT Homolog: EC 1.14.17.4 Aminocyclopropanecarboxylate oxidase
  misc_feature: Functional homolog of the protein sequence given in SEQ ID NO 50854
  misc_feature: Useful for making plants with modulated heat sensitivity
MGLLGGEERPAAMELLRDACENWGFFEILNHGISTELMDEVEKLTKDHYKRVREQRFLEFAGKALQDGGDDARGVKAENLDWESTFFVRHLPESNLAELPDLDDGYRRVMKRFAGELEALAERLLDLLCENLGLEKGYLARAFRGPSGVPTFGTKVSSYPPCPRPDLVSGLRAH

SEQ ID NO: 35364 - DNA, 741 bp, Panicum virgatum
  misc_feature: Ceres CLONE 1961106
  misc_feature: Encodes the peptide sequence at SEQ ID NO. 35365
gagcttctccacgccctccagcaattcacgccgatggcctcgccggcgacggtcccgctgcggcagctcttcgtcgacggcgcgccgggggccgtccgggcaaagtacctccgcgccatcgccgccaagataattgagaggaaagctgagctggctaagctagaggtacttgattgtgggaagccttatgatgaagcagcatgggacatggatgatgttgctgggtgctttgagtactttgcggatcaagcagaagccttggacaaaaggcaaaattccccagtttctcttccaatggagaattttaaatgccatcttcggagagagcctatcggagttgttgggcttatcagcccttggaactatcctctcctaatggctacatggaaggtagctcctgctctggctgctggttgtacagctgtgctgaaaccatctgaattggcatctgtaacttgcttagagctcgctgatgtctgtaaagaagtcggtcttcctgctggtgtcttgaacattgtgactggattaggtcctgatgctggtgctcctttggcagcacacccagatgttaacaaggtctcttttactgggagtttcgaaactggtaagaaggttatggcggctgcagctcctatggtcaagcctgttacactggaacttggtggaaaaagtcctatagtagtatttgatgatgttgacattgaaacagctgttgaatggactctgtttgggggcttttgg

SEQ ID NO: 35365 - protein, 235 aa, Panicum virgatum
  misc_feature: Ceres CLONE 1961106
  misc_feature (2)..(235): Pfam Name: Aldedh Pfam Description: Aldehyde dehydrogenase family
  misc_feature: SWISSPROT Homolog: EC 1.2.1.8 Betaine-aldehyde dehydrogenase
MASPATVPLRQLFVDGAPGAVRAKYLRAIAAKIIERKAELAKLEVLDCGKPYDEAAWDMDDVAGCFEYFADQAEALDKRQNSPVSLPMENFKCHLRREPIGVVGLISPWNYPLLMATWKVAPALAAGCTAVLKPSELASVTCLELADVCKEVGLPAGVLNIVTGLGPDAGAPLAAHPDVNKVSFTGSFETGKKVMAAAAPMVKPVTLELGGKSPIVVFDDVDIETAVEWTLFGGF

SEQ ID NO: 35366 - DNA, 648 bp, Panicum virgatum
  misc_feature: Ceres CLONE 1961115
  misc_feature: Encodes the peptide sequence at SEQ ID NO. 35367
ctgtatcagagcctccgtctctcatctcctctccgcctccgcctccgcctccaccccaccccaccccacacctccgcccgacccccgccgccgcaggcaggaaggaaggatggaggcccctggctccccctacgcctcctcgccggaatccgccccgaagcgcgccccacgctcccctccgcagcagcagcagcagcatcagcagcagccgccctccgaggaaggagatgacaaggacaagccaacacatttgaggttcctggtgtctaatactgcagcaggatgtattattggcaagggtggatcaaccatcaatgactttcagtcccagtctggggctcgtattcagttatcacgtagccatgagttcttccctggtacaaatgaccgaatcatcatggtttctggaatgtttgatgaagtaatgaaggccatggagctaattcttgagaaacttttggctgagggtgaagagttcaatgaagctgaagctagacctaaagttagacttgtagttcctaacggctcttgtggtgggataattggtaaaggtggatcaacaataaagtcttttattgaagaatcgcacgctggaatcaaaatttcgccacaggataacaactatgctggtttgcatgacagggttgt

SEQ ID NO: 35367 - protein, 179 aa, Panicum virgatum
  misc_feature: Ceres CLONE 1961115
  misc_feature (47)..(112): Pfam Name: KH_1 Pfam Description: KH domain
  misc_feature (131)..(178): Pfam Name: KH_1 Pfam Description: KH domain
MEAPGSPYASSPESAPKRAPRSPPQQQQQHQQQPPSEEGDDKDKPTHLRFLVSNTAAGCIIGKGGSTINDFQSQSGARIQLSRSHEFFPGTNDRIIMVSGMFDEVMKAMELILEKLLAEGEEFNEAEARPKVRLVVPNGSCGGIIGKGGSTIKSFIEESHAGIKISPQDNNYAGLHDRV

SEQ ID NO: 35368 - DNA, 680 bp, Panicum virgatum
  misc_feature: Ceres CLONE 1961118
  misc_feature: Encodes the peptide sequence at SEQ ID NO. 35369
ccggcaaaactcccctccgccccaacccctcgcgtacggtctccctccctgtcctcctccacgtctcaccccctcacctcaccccctcacccccttcgcttccgctcctccgctcgcgctctcacttccttctccttcctatccagcttcccccaccggctcggcgcccaagaggtccaggacgatggccacggacgcagcggcggctggtcctccggcctccaagggatgcccagcgatgaaggccgagttcgccaagcacgccgagtacctcaatgccctgaacgataagagagaaaggcttgtgaaagcaagtcgggatatcacaatgaacagcaaaaaggtcatctttcaggtccacagggccagtaaagttaacaaggaagaggttctgtccaaggcagaaaatgatcttgctgcagtggttaaccagtacattggaaagttggtaaaagaattacaaggaactgacttctggaagctcagaagagcctacacctttggtgtacaagaatatgttgaagctgcaacgctgtgtagattttgcaagactggcacactattaagtcttgctgaaatcaatgattctttactagcactaagtgataaatctgttgagcccttacagataaatgtacttgactatcttttaggggttgctgatttgtcaggagagttaa

SEQ ID NO: 35369 - protein, 165 aa, Panicum virgatum
  misc_feature: Ceres CLONE 1961118
  misc_feature (34)..(165): Pfam Name: Translin Pfam Description: Translin family
MATDAAAAGPPASKGCPAMKAEFAKHAEYLNALNDKRERLVKASRDITMNSKKVIFQVHRASKVNKEEVLSKAENDLAAVVNQYIGKLVKELQGTDFWKLRRAYTFGVQEYVEAATLCRFCKTGTLLSLAEINDSLLALSDKSVEPLQINVLDYLLGVADLSGEL

SEQ ID NO: 35370 - DNA, 712 bp, Panicum virgatum
  misc_feature: Ceres CLONE 1961120
  misc_feature: Encodes the peptide sequence at SEQ ID NO. 35371
catgttgttaacaagcttcgaggaatccttaacgttgctgcaattaaggccccaagctttggtgagcggcggaaggctgtccttcaggacattgccattgtcacaggtgctgagttcctagcaaaagatcttggtttgttggttgaaaatgctacagaggaacaacttgggacagcaaggaaagtcacgatacatcagaccacaaccaccctgatagcagatgcagccagtaaagatgagatccaagcgagggttgcacagctaaagaaggagcttgctgaaactgattcggtttatgatactgagaaattggctgagagaattgcgaaacttgctggtggtgttgctgttatcaaggttggcgctgcaaccgaaactgagcttgaggaccgccagctacgaattgaggatgcaaagaatgctacttttgccgctatcgaggagggcattgttcctggaggtggtacggcctatgtgcacctatccaacattgtcccctcgattaaggagaaaattgaggatcctgatgagcgccttggtgctgacattattcaaaaggcattggtggcacctgcttcactgatcgcacacaatgctggagtggagggtgaagtggttgttgagaaggtcaaggagagtgagtgggaagtgggttacaatgcaatgacggacaagtacgagaacctgattgagtccggtgtgatcgaccctg

SEQ ID NO: 35371 - protein, 237 aa, Panicum virgatum
  misc_feature: Ceres CLONE 1961120
  misc_feature (1)..(237): Pfam Name: Cpn60_TCP1 Pfam Description: TCP-1/cpn60 chaperonin family
HVVNKLRGILNVAAIKAPSFGERRKAVLQDIAIVTGAEFLAKDLGLLVENATEEQLGTARKVTIHQTTTTLIADAASKDEIQARVAQLKKELAETDSVYDTEKLAERIAKLAGGVAVIKVGAATETELEDRQLRIEDAKNATFAAIEEGIVPGGGTAYVHLSNIVPSIKEKIEDPDERLGADIIQKALVAPASLIAHNAGVEGEVVVEKVKESEWEVGYNAMTDKYENLIESGVIDP

SEQ ID NO: 35372 - DNA, 741 bp, Panicum virgatum
  misc_feature: Ceres CLONE 1961124
  misc_feature: Encodes the peptide sequence at SEQ ID NO. 35373
atcagcatcaatgcagcaaagcacagaggcacccagcgagcagtaattactgctgcagctagtagtgtttattagctttgcttgggcgaggtgcctgatcgcgagctcgatcgagatgaagggtactgcaatggcggccgcggccttggttcccctcgctgtcgcggtcctcttctccctgtcgtcggcagcgtccgccggcgcggtccagtgggggaagctggacccgcacttctacgaccgctcgtgcccgcaggcgcagcagatcgtggcgtccatcgtggggaaggcgcactaccaggacccccgcatggccgcctccctcctccgcctccacttccacgactgcttcgtcaagggctgcgacgcgtcgctcctgctggacagcagcgggtccatcgtcagcgagaagcggtccaaccccaacagggactcggcccggggcttcgaggtcgtcgacgagatcaaggccgcgctggaggccgcctgccccggcaccgtgtcctgcgccgacatcctcgccctcgccgcccgcgactccaccgtcatgactggcggtcccgggtggatcgtgccgctggggaggagggacgctcggggcgccagcatccagggctccaacaacgacatcccggcaccaaacaacaccctccccaccatcatcaccaagttccagctccagggcctcgacatcgtcgacctcgtcgcactcctcggtagccacaccatcgggcgactcca

SEQ ID NO: 35373 - protein, 208 aa, Panicum virgatum
  misc_feature: Ceres CLONE 1961124
  misc_feature (52)..(208): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51033
  misc_feature: Useful for making plants with altered cell wall content and/or composition
  misc_feature: Functional homolog of the protein sequence given in SEQ ID NO 51032
  misc_feature: Useful for making plants with altered carbohydrate content
  misc_feature: Functional homolog of the protein sequence given in SEQ ID NO 51034
  misc_feature: Useful for making plants with modulated nitrogen use efficiency
  misc_feature: Functional homolog of the protein sequence given in SEQ ID NO 50564
  misc_feature: Useful for making plants with modulated phosphate use efficiency
MKGTAMAAAALVPLAVAVLFSLSSAASAGAVQWGKLDPHFYDRSCPQAQQIVASIVGKAHYQDPRMAASLLRLHFHDCFVKGCDASLLLDSSGSIVSEKRSNPNRDSARGFEVVDEIKAALEAACPGTVSCADILALAARDSTVMTGGPGWIVPLGRRDARGASIQGSNNDIPAPNNTLPTIITKFQLQGLDIVDLVALLGSHTIGRL

SEQ ID NO: 35374 - DNA, 648 bp, Panicum virgatum
  misc_feature: Ceres CLONE 1961175
  misc_feature: Encodes the peptide sequence at SEQ ID NO. 35375
aaaaccctagacatcccaagccccagcgccgccagcgagccagccactccaccactcccgacccgagccctcaggcggtcaggccccagcgcggcggcggcaagatggcggtgggaaagaacaagcggatcagcaaagggaagaagggtggtaagaagaagatcgtcgatcccttcgcgaagaaagattggtatgatatcaaggcgccctccgtcttctccgtgcgcaacattggaaagacgctcgtgtccaggacacagggtactaagattgcttctgagggtctgaagcaccgtgtctttgaggtctccctagctgatcttcagagtgatgaagaccaagcctacaggaagatcaggctccgtgctgaagatatccagggtcgtaatgtccttaccaacttctggggtatggattttactacagacaagctgcggtcgctggtcaggaagtggcagaccttgattgaggcccatgttgatgttaagaccactgatagctacatgctgcggctcttctgcatcgggtttacaaagaggagacccaaccaagtgaagcgtacttgctatgcacaggcctcccagatccgtcagatacgccggaagatggttgagatcatggccaaccaggcctctacctgtgacctga

SEQ ID NO: 35375 - protein, 181 aa, Panicum virgatum
  misc_feature: Ceres CLONE 1961175
  misc_feature (11)..(181): Pfam Name: Ribosomal_S3Ae Pfam Description: Ribosomal S3Ae family
MAVGKNKRISKGKKGGKKKIVDPFAKKDWYDIKAPSVFSVRNIGKTLVSRTQGTKIASEGLKHRVFEVSLADLQSDEDQAYRKIRLRAEDIQGRNVLTNFWGMDFTTDKLRSLVRKWQTLIEAHVDVKTTDSYMLRLFCIGFTKRRPNQVKRTCYAQASQIRQIRRKMVEIMANQASTCDL

SEQ ID NO: 35376 - DNA, 440 bp, Panicum virgatum
  misc_feature: Ceres CLONE 1961187
  misc_feature: Encodes the peptide sequence at SEQ ID NO. 35377
atccattggctatttggctcccttcgctcagtccagtttctcccccactcctcaccactctgcttgctccgctgctctgctccgccccaatcagtgagagctgccatccactgacccgccgcgagcgccaatggcggcggccgcggccctggcagcggcggtgctggcgctgtcatgcttcggcgcgcccgcgacggcggaggcggaggcggaggcggatcgcatctgcagcctgccggggcagccgccggtcaacttctccatgtactccgggtacgtcaccgcggacgcggccgcggggcgggcgctcttctactggctcatacaggcggccggcgcgcccgaggagcccgcgccgctcatgatctggctcaacggcgggaccgggtgctcctcggtcggctaaagcacatcaaaggaactcggcgccttccggatca

SEQ ID NO: 35377 - protein, 91 aa, Panicum virgatum
  misc_feature: Ceres CLONE 1961187
  misc_feature: SWISSPROT Homolog: EC 3.4.16.6 Carboxypeptidase D
MAAAAALAAAVLALSCFGAPATAEAEAEADRICSLPGQPPVNFSMYSGYVTADAAAGRALFYWLIQAAGAPEEPAPLMIWLNGGTGCSSVG

SEQ ID NO: 35378 - DNA, 682 bp, Panicum virgatum
  misc_feature: Ceres CLONE 1961213
  misc_feature: Encodes the peptide sequence at SEQ ID NO. 35379
acccgccccgccgcgcggccggaagtccccaaatcgcgttggctagaccaccccgcggccactcctccacccaccgccggcgccgcgccagcctgcagccaccgcctgccggaccccccgctctccgcacacgcacgccgcatggccgcttcgtacttcaaccactcctatccgccggcgccgcctccgccgccggggacctcctcgtacggcgcgtaccgcaacgcctacccgccggcgccggcgccccccaccgcttacggcgcttactacgaccgcgcggagcaggccctcccgtcgcgggacgagctccgcaccctcttcatcgctggcctccccgccgacgccaagccgcgcgaggtctacaacctcttccgcgacttccctggatacgtctcttcccatctccgccccggcaaatcctccaaggcatatgcatttgctgtatttgctgatcaaccatctgccttagctgccttgagtgctacaaatggaatggtatttgaccttgagaagaattgttctctacatgtggatctcgcaaaatccaattctagatcaaagcgcttgagatcagatgatgattcaccttattctcctgagaaaagaactaagagaccaatgggatttcctgattcaggtgctggaagcaatatttacatatctgggaatgggtaattct

SEQ ID NO: 35379 - protein, 178 aa, Panicum virgatum
  misc_feature: Ceres CLONE 1961213
  misc_feature (60)..(131): Pfam Name: RRM_1 Pfam Description: RNA recognition motif. (a.k.a. RRM, RBD, or RNP domain)
MAASYFNHSYPPAPPPPPGTSSYGAYRNAYPPAPAPPTAYGAYYDRAEQALPSRDELRTLFIAGLPADAKPREVYNLFRDFPGYVSSHLRPGKSSKAYAFAVFADQPSALAALSATNGMVFDLEKNCSLHVDLAKSNSRSKRLRSDDDSPYSPEKRTKRPMGFPDSGAGSNIYISGNG

SEQ ID NO: 35380 - DNA, 749 bp, Panicum virgatum
  misc_feature: Ceres CLONE 1961228
  misc_feature: Encodes the peptide sequence at SEQ ID NO. 35381
agcaactaagacaaagtagtgtactcttccctgtactagctttcttcttcttcctcccctcctcttcctttcaaacagactggagttcatcaaggtcatcctgaaactggagccaacaagtatacagagaaagaagggcaggaagaccggctcccagccgataaaaggtaggagcgagcagcgttagggcagtgtcatcgtatcacagggttgatatggtgacagtgagagaagagactcgcaaggggccttggacagagcaggaggacctgcaactggtatgcactgtccgtctgttcggtgaacgtcgttgggatttcattgccaaagtatcagggctcaaccggacaggcaagagctgccggctgcgctgggtcaactacctccaccctggcctcaagcgtgggcgcatgtctccccaagaagagcgcctcatccttgagcttcatgctcgatggggaaacaggtggtccaggatagcacgccgcttgccagggcgcactgacaatgagatcaagaactactggaggacacacatgagaaagaaagcacaggagaggaagagaaacatgtccccatcatcgtcctcatcttcactgacttaccagtcctgctacccagatactccctcaaccattggagttgaggggcaggagcttcatggtggcagtggctgcatcacaagcatccagaaaggcaacccctcggacatggatgcatatcccatggaacagatatggatggaaatt

SEQ ID NO: 35381 - protein, 177 aa, Panicum virgatum
  misc_feature: Ceres CLONE 1961228
  misc_feature (63)..(108): Pfam Name: Myb_DNA-binding Pfam Description: Myb-like DNA-binding domain
  misc_feature (10)..(57): Pfam Name: Myb_DNA-binding Pfam Description: Myb-like DNA-binding domain
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 126 in the 10/412,699 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 36 in US patent 7193132
  misc_feature: The sequence is a functional homolog of SEQ ID NO 1563 in the 10/374,780 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 271 in the 11/479,226 US patent application
  misc_feature: Functional homolog of the protein sequence given in SEQ ID NO 50831
  misc_feature: Useful for making plants with modulated nitrogen use efficiency
  misc_feature: Functional homolog of the protein sequence given in SEQ ID NO 50733
  misc_feature: Useful for making plants with altered cell wall content and/or composition
MVTVREETRKGPWTEQEDLQLVCTVRLFGERRWDFIAKVSGLNRTGKSCRLRWVNYLHPGLKRGRMSPQEERLILELHARWGNRWSRIARRLPGRTDNEIKNYWRTHMRKKAQERKRNMSPSSSSSSLTYQSCYPDTPSTIGVEGQELHGGSGCITSIQKGNPSDMDAYPMEQIWME

SEQ ID NO: 35382 - DNA, 671 bp, Panicum virgatum
  misc_feature: Ceres CLONE 1961240
  misc_feature: Encodes the peptide sequence at SEQ ID NO. 35383
agccaacccgaggtcggtcaatctcaatccacccacagctccccgctcctacccagatctcccggacccgttcagcgccaactgtagcgtcggcgatggccagcacggcggccgaggcggcggagcagccggcgcaggagcagcaggccaacggcaacggcgagcagaagacgcgccactccgaggtggggcacaagagcctgctcaagagcgacgacctctaccagtacatcctggacacgagcgtgtacccgcgggagcccgagagcatgaaggagctccgcgagatcaccgccaagcacccctggaacctgatgacaacgtcggcggacgaggggcagttcctcaacatgctcatcaagctcatcggcgccaagaagaccatggagatcggcgtctacaccggctactccctcctcgccaccgcgctcgccctccccgaggacggcacgatcttggccatggacatcaaccgcgagaactacgagctcggcctgccctgcatcgagaaggccggcgtcgcccacaagatcgacttccgcgagggccccgcgctccccgtcctcgacgacctcatcgccgacgagaagaaccacggcaccttcgacttcgtcttcgtggacgccgacaaggacaactacctcaactaccacgagcggctgctcaagctc

SEQ ID NO: 35383 - protein, 191 aa, Panicum virgatum
  misc_feature: Ceres CLONE 1961240
  misc_feature (47)..(191): Pfam Name: Methyltransf_3 Pfam Description: O-methyltransferase
  misc_feature: SWISSPROT Homolog: EC 2.1.1.104 Caffeoyl-CoA O-methyltransferase
  misc_feature: Functional homolog of the protein sequence given in SEQ ID NO 51308
  misc_feature: Useful for making plants with altered carbohydrate content
  misc_feature: Functional homolog of the protein sequence given in SEQ ID NO 51309
  misc_feature: Useful for making plants with altered cell wall content and/or composition
  misc_feature: Useful for making plants with altered lignin content
MASTAAEAAEQPAQEQQANGNGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADEKNHGTFDFVFVDADKDNYLNYHERLLK

SEQ ID NO: 35384 - DNA, 581 bp, Panicum virgatum
  misc_feature: Ceres CLONE 1961267
  misc_feature: Encodes the peptide sequence at SEQ ID NO. 35385
agagccccgtcgccccgcgcacagccggtgtcagtaacacgcagccgccgccgcaccgaggggagaggaccgagctcactcagctcgctagcgatcgagggcaggcaatggcgagagccggcggcctcctgatgctcgcggtcgccgtcctgacgctgggcatcgccggggccgcgagggcgcagctgcggcagaactactacggcagctcgtgccccagcgccgagtccaccgtgcgctccgtcatctcgcagcgcctccagcagagcttcgccgtcggcccaggcacgctccgcctcttcttccacgactgcttcgtccggggatgcgacgcgtcggtgatgctgatggcacccaacggggacgacgagagccacagcggcgcggacgccacgctgtcgccggacgccgtggacgccatcaacaaggccaaggcggccgtggaggcgctcccgggctgcgccggcaaggtctcgtgcgcggacatcctcgccatggccgcacgtgacgtcgtctccctgcttggggggccaaactacgccgtggagctcgggcggctggacggcaagtcgttcaacagg

SEQ ID NO: 35385 - protein, 157 aa, Panicum virgatum
  misc_feature: Ceres CLONE 1961267
  misc_feature (43)..(157): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51490
  misc_feature: Useful for making plants with altered carbohydrate content
  misc_feature: Functional homolog of the protein sequence given in SEQ ID NO 51491
  misc_feature: Useful for making plants with altered cell wall content and/or composition
MARAGGLLMLAVAVLTLGIAGAARAQLRQNYYGSSCPSAESTVRSVISQRLQQSFAVGPGTLRLFFHDCFVRGCDASVMLMAPNGDDESHSGADATLSPDAVDAINKAKAAVEALPGCAGKVSCADILAMAARDVVSLLGGPNYAVELGRLDGKSFN

SEQ ID NO: 35386 - DNA, 699 bp, Panicum virgatum
  misc_feature: Ceres CLONE 1961268
  misc_feature: Encodes the peptide sequence at SEQ ID NO. 35387
aaaaacgcccccagcccatgccgactgaaagggtcctcgtcctcgtcgccatctccggttttcccccagtaccctaaccctagccgcccgaggcggagtctcccctctccggaccgcgacccggcgccctctcctccgccatcgagccggccgccggccgatccagatgaacacgccgccgtccagatccagggcaatgatgggaagctggggggtttcggatgggtacgagggatcaaagaggccacgaatgatgatggaatcgaatccctacttcgcagtgaacgcagggagtccattggatgtctcaaagagggccaggatgatggaaccaggccctccctattttggggctatgggcagcaacgctggtggtgccagcggtggcttctaccagcccttcaacagcaacttagctggtgcgggggttagcactggcatccaaaactttccaggtgtccggctgcgaggactcccttttgattgcaatgaagttgacatctgcaagttctttgcggggctggaaattctggattgcctcctggttaacaagaatggccgctttactggtgaggcttttgtggtattcacgggatccatgccagcagaatttgcactgcatcgcaacaggcagaacatgggccggagatatgttgaggtgttcagatgccagaagcaggagtactactgtgcaatagc

SEQ ID NO: 35387 - protein, 177 aa, Panicum virgatum
  misc_feature: Ceres CLONE 1961268
  misc_feature (98)..(165): Pfam Name: RRM_1 Pfam Description: RNA recognition motif. (a.k.a. RRM, RBD, or RNP domain)
MNTPPSRSRAMMGSWGVSDGYEGSKRPRMMMESNPYFAVNAGSPLDVSKRARMMEPGPPYFGAMGSNAGGASGGFYQPFNSNLAGAGVSTGIQNFPGVRLRGLPFDCNEVDICKFFAGLEILDCLLVNKNGRFTGEAFVVFTGSMPAEFALHRNRQNMGRRYVEVFRCQKQEYYCAI

SEQ ID NO: 35388 - DNA, 1150 bp, Panicum virgatum
  misc_feature: Ceres CLONE 1961276
  misc_feature: Encodes the peptide sequence at SEQ ID NO. 35389
gatattctcctcctctcctcctcggcaggcgccagccaccgccttcctctccgtctccgtctccgtccgtcgcaagccttcagcgtcactgggtggggcggcgcaccaaaggccggtcaagattcgagaggccggcccagccaagcgtagggcctccgactcctcctcgtccgcgcgcgccgcccgccgacgcagggaggcgccgccgcccccgccgcccagggagatgggcgtcgactactacaaggtcctcggcgtcgaccgcggcgccggagacgacgacctcaagaaggcgtaccggaagctcgccatgcgttggcaccccgacaagaactccaccaacaagaaggaggcggaggcaaagttcaagcagatctctgaggcatacgaggtacttagcgatccccagaagcgcacaatctatgatcagctaggggaagaagggctcaaggggcagccacccccaggagcaggaggtcctggagcatctccattttttcctggcggggctcatcccacctctttccattttaatccgaggagcgcagatgatatatttaaagagttctttggattctccggcatgggtggcatgggcggcatgagaggggaaccaggattccagaggtcaatgtttggcaatgaatactttccttcacgctatggcggtgagggttccacctgtatgcagcagcctgtacacaaggcagctcccattgagaataggcttccagtcagtctcgcagatctgtacaagggtgtgacaaaaaagatgaaaatctcaagagagactgtggatgcttatgggagagtctcacatgtggaggaaattctgacaatagatgtaaagcctggttggaagaagggaacaaagataacatttcctgagaagggaaatgaagctccaaatatgaaacctgctgatattgttttcatcattgatgagaagccccacgacattttcactcgggatgggaatgatcttgtcatgaccgagaaaatatctctggttgaagcactgacgggctataccgcacgtgtcactacccttgatggacggagcctgtcactgcccattaactcaataatccatcccaactacgaagaggtaatccctggagagggcatgccgatacctaaggaccccact

SEQ ID NO: 35389 - protein, 307 aa, Panicum virgatum
  misc_feature: Ceres CLONE 1961276
  misc_feature (4)..(67): Pfam Name: DnaJ Pfam Description: DnaJ domain
  misc_feature (215)..(305): Pfam Name: DnaJ_C Pfam Description: DnaJ C terminal region
MGVDYYKVLGVDRGAGDDDLKKAYRKLAMRWHPDKNSTNKKEAEAKFKQISEAYEVLSDPQKRTIYDQLGEEGLKGQPPPGAGGPGASPFFPGGAHPTSFHFNPRSADDIFKEFFGFSGMGGMGGMRGEPGFQRSMFGNEYFPSRYGGEGSTCMQQPVHKAAPIENRLPVSLADLYKGVTKKMKISRETVDAYGRVSHVEEILTIDVKPGWKKGTKITFPEKGNEAPNMKPADIVFIIDEKPHDIFTRDGNDLVMTEKISLVEALTGYTARVTTLDGRSLSLPINSIIHPNYEEVIPGEGMPIPKDP

SEQ ID NO: 35390 - DNA, 630 bp, Panicum virgatum
  misc_feature: Ceres CLONE 1961287
  misc_feature: Encodes the peptide sequence at SEQ ID NO. 35391
ctctctcttcccagtccgctcggccaccagctttgaccgccgcctccgctcccctccgctcctgctcctccccatcccacttccccgcaggagaggcagcggcggcggcggcgacggcggctaagcgtaacccccacctcggcgagcggcaccggcggcggcaaaggcaagatgttcgggcgcgcgccgaagaagagcgacaacaccaagtactacgagatcctcggggtgcccaagtccgcatcccaggacgacctcaagaaggcctaccgcaaggccgccatcaagaaccaccccgacaagggcggcgaccccgagaagttcaaggagcttgcacaagcttatgaggttttgagtgatccagagaagcgtgagatttatgatcaatatggtgaagatgccctcaaagaaggaatgggtggaggaggagcccatgtagatccatttgacatcttctcatcattctttggaccctcttttggaggaggtggtggcagcagcagaggcagaaggcaaaggaggggagaagatgtcgtgcatccacttaaagtttctctagaagatctttacaatggtacctcaaagaagctctcgctttcacgtagtgtcatctgctccaagtgcaaaggc

SEQ ID NO: 35391 - protein, 152 aa, Panicum virgatum
  misc_feature: Ceres CLONE 1961287
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKELAQAYEVLSDPEKREIYDQYGEDALKEGMGGGGAHVDPFDIFSSFFGPSFGGGGGSSRGRRQRRGEDVVHPLKVSLEDLYNGTSKKLSLSRSVICSKCK

SEQ ID NO: 35392 - DNA, 1179 bp, Panicum virgatum
  misc_feature: Ceres CLONE 1961293
  misc_feature: Encodes the peptide sequence at SEQ ID NO. 35393
atcctgcgcgccccacgccaccacaagcttccttccctctcgccttggtcgggggcgcttgctagggtttgggaatccgaagggggccatggcttccctcgcaatgccggaggcgggagcgcgggcccgcggcgaggaggcagagccggtgacgccgccgccgcagcagcaggcggaggggtcccaggcggtggacgatcggcgtctgctgcggtcgcagtacctcgccgtgaagagcctcatcagcgatgagaaggatgatatggctaacgcggactccgaaaagttccgctccatcatcagcaaggtggagagcctgcacgagcatgttcagaggccaagggagcaaatagctgatgcagaagccctgctggaccttgctgccagtttggtaacatcagtaaggtcccattcagttatgggaattacgccttctgattttgttgctggactgctgaataagtttggaaagctaggggggcctgatgatgagcatgcctcgttggactgggctcatcttggacgtggcgcttctcatattttcatggttgctcctggatgtgccacaatggttggccccatgaagatagaagtgaacccacgaagggtgtgtattaggaaaaagaggactgcaagacctcgtggaagttcttgccctgaacagcttgctgaccccacagagaaaacaaagagtgatactgataagaatatgtctgctatatttaatctgctgaggaggaagaaaaatgcaaagcttgaacaccttgttttgaacaggatatcatttgcccaaacagtggaaaacatctttgccttgtcattcctagtgaaagatggcagagttgaaatcaaggtgaatgatgaggggcatcatattgtctatccaaggaatgcacctgctgctagcgccattgcctcaggaaaagtgatctacaaccacttcgtcttcagatttgatttcaaagactggaagctcatgaaaggggtggttccagagagggaagagcttatgccgcacaggtcttctcaggatgcacctggcataacagcaagcagtcaccctgaacctgagttgtcccagcccacacagagcgcaccgatcaggaagcgatgcaggaatcggggcctggtcttgcaagacgagattgttgccaccgggcggcacggggaaatcacggc

SEQ ID NO: 35393 - protein, 358 aa, Panicum virgatum
  misc_feature: Ceres CLONE 1961293
  misc_feature (30)..(306): Pfam Name: Nse4 Pfam Description: Nse4
MPEAGARARGEEAEPVTPPPQQQAEGSQAVDDRRLLRSQYLAVKSLISDEKDDMANADSEKFRSIISKVESLHEHVQRPREQIADAEALLDLAASLVTSVRSHSVMGITPSDFVAGLLNKFGKLGGPDDEHASLDWAHLGRGASHIFMVAPGCATMVGPMKIEVNPRRVCIRKKRTARPRGSSCPEQLADPTEKTKSDTDKNMSAIFNLLRRKKNAKLEHLVLNRISFAQTVENIFALSFLVKDGRVEIKVNDEGHHIVYPRNAPAASAIASGKVIYNHFVFRFDFKDWKLMKGVVPEREELMPHRSSQDAPGITASSHPEPELSQPTQSAPIRKRCRNRGLVLQDEIVATGRHGEIT

SEQ ID NO: 35394 - DNA, 166 bp, Panicum virgatum
  misc_feature: Ceres CLONE 1961293-R
gtgttgcggcccctgctcccttcgcttcgctccggtgtgtttgggctgggccccttctcggtggcgtggcgggggtggtggtggcttttggcttggttcggcctgtcgcgttgttttgtttgtgcttttggtttttggtgttttttggcccggggcggccgttgtc

SEQ ID NO: 35395 - DNA, 1237 bp, Panicum virgatum
  misc_feature: Ceres CLONE 1961316
  misc_feature: Encodes the peptide sequence at SEQ ID NO. 35396
tcttttttgcctcgaggaagaggaaggcgaagggttcagcagcttcttccgattgactcccgctggccgcgtctcctccggtcggacttttgtccggcgagcctctcctccaggaagaggccgtggcactcggagaagtgctccaggcaaaatggagatcgaggccaatggaaagcgggcccgtgcaagcagcagcagcagcttgaccggcggcgaccggctcagctccctgccggattgcctcatccaccacatcatgtccttcatgaaggcccggcaggtggtgcagacctgcgtgctgtccaccaggtggaagcacctctggcgttccgtcccctgcctcgacatcgatgtggaggagttcgagaccacaggctcgaaccaccctcgcgaagcgtggggcaagtttgaggacttcaccgaccacttgcttatccctaataatatttccattgcgctattggatacattctgtctgcatgttagtggcatgtataaatcttatcggggtcagcacgcaactagatggatccggcatggcataaagtacagcactcgggcacctggcatgcagcgccagggattgagctcwwgctcctggcacctaagaaaactatacctttccaacttatatttggatgacaatttcacagagcatgtcagttcaggatgccaaaatttggaggatttggagctgaaaggttgctattgtagaacatttcatgagatcagctcccactcactgaagaaccttattctgaaagattgcgagtttagtaaactttctgcaattacatcaccggcactaaagagcttggttattgagagcgacggctatagtagaattccctctctgctagttatcactgcccctgctgttgcttatctgctcctggacgtgacagcttcgaacttttacggtggtgtctcatttgaggagatgccatctcttggcaaggcctcaattcatctaaggtgtgatgaagtagaaagtaaactcagccagaatcaactcaagcttctttgcagtgtgtctaatgtgacaagtttggtgttgtcgggtttcacaacgatggtttgccttctctgtctttactgatgtttccttttcgctcttattcatctttgtcgtgtgtctaatgtgacaagttttggtgttatcaaagtttccagacagtgttgtgctttctgtcttcatcggtatttccttttgctctttcattcatattcatattgt

SEQ ID NO: 35396 - protein, 315 aa, Panicum virgatum
  misc_feature: Ceres CLONE 1961316
  misc_feature (22)..(69): Pfam Name: F-box Pfam Description: F-box domain
  misc_feature (148)..(148): Xaa is any aa, unknown, or other
MEIEANGKRARASSSSSLTGGDRLSSLPDCLIHHIMSFMKARQVVQTCVLSTRWKHLWRSVPCLDIDVEEFETTGSNHPREAWGKFEDFTDHLLIPNNISIALLDTFCLHVSGMYKSYRGQHATRWIRHGIKYSTRAPGMQRQGLSSXSWHLRKLYLSNLYLDDNFTEHVSSGCQNLEDLELKGCYCRTFHEISSHSLKNLILKDCEFSKLSAITSPALKSLVIESDGYSRIPSLLVITAPAVAYLLLDVTASNFYGGVSFEEMPSLGKASIHLRCDEVESKLSQNQLKLLCSVSNVTSLVLSGFTTMVCLLCLY

SEQ ID NO: 35397 - DNA, 1552 bp, Panicum virgatum
  misc_feature: Ceres CLONE 1961323
  misc_feature: Encodes the peptide sequence at SEQ ID NO. 35398
accatttctttcagttcttccagccagcgagcctgagctcttgccgccatggcaagccttagcactggagcggggcctccagtggtgaatgtgtaccatgagaagtccatgatcttacccgatgtatcaagggtgctcacatgcctgtatgagaaaaatgtcaagtttgagacaatcaaagcctcttacaaggacatactaagcctccaggcatcgaggagtgttccagttccattctacgatggacctgtatttcttcaagattcaagagcaatctgtcgttatctagcagagatctacgagcaccaggggtatcctttcctcctgggaaaggatgtccttgagagggcctccattgaacaatggctccggaacgaggagcatgccttcgaccctccgagccgagcattgttctgccatattgccttcccatttcatgatgaggatgacgacaacaacgaagacatcaaccgagagaagcggaagctggaggaagttttggaagtctacgagcagaggcttggtgagagcaattaccttgctgggaataagttcaccctggccgaccttgttcatctgcctggcacccaccatgtcattacatctgagaaattcgcctacctatatgactcaagaaagaatgtgcagaagtggtggaacaggatctcagcccgggattcctggcagcaggtgctgagggacatgaggaccgtggaggaggagcataaaaaggaggaacatgagaggcagcagcagcaatggcaaacagaacatttgccacagtttggtgtccgcaacattcacataagccatcggcagcaggagggcacaaagtcacagacagtgctggttgcacctcccagcactggtaccatcataacttccattccaccagctccaccagatcatgaaaatacctctgaccctaagccttcctcacctatgcaaagaaatcaaggaggcttctttacaacctctgaaaaaactcaaccaacatcagggcagacagattctaccacacagaaacaacctagtggtgtacagagcactaaaagtagcttcttcacccagccttccagtcctaccactgccaagatacatcagagaactgatgctgagaagtcaagccgcaaagatgcctcatctcctagcaaaaacaatcaagcatcacccaaagaagctcctgataagccccacctttccgatttttccaagattggctacaatgctgaggcgggatcccttgtcaagcccagtccccaagcttcctccaagatccctggagccaggcaggccagtgaagcagttgctcctgacaagcccagtccaggatcagccaaatctccccacagaattactgaacctgattacaatgaaactgagagcaaaccttttggtgtccatcctcatgttgacaagcctgatgaacaaaaacagcaaacaccttatggaaagcctcctgaacagagagtagcagacactattgttggtcctgaatcaggtgaaaaacaagaaagtgcgattggctctccttatgctcgaggtaaaacgg

SEQ ID NO: 35398 - protein, 501 aa, Panicum virgatum
  misc_feature: Ceres CLONE 1961323
  misc_feature (118)..(210): Pfam Name: GST_C Pfam Description: Glutathione S-transferase, C-terminal domain
  misc_feature: SWISSPROT Homolog: EC 2.5.1.18 Glutathione transferase
MASLSTGAGPPVVNVYHEKSMILPDVSRVLTCLYEKNVKFETIKASYKDILSLQASRSVPVPFYDGPVFLQDSRAICRYLAEIYEHQGYPFLLGKDVLERASIEQWLRNEEHAFDPPSRALFCHIAFPFHDEDDDNNEDINREKRKLEEVLEVYEQRLGESNYLAGNKFTLADLVHLPGTHHVITSEKFAYLYDSRKNVQKWWNRISARDSWQQVLRDMRTVEEEHKKEEHERQQQQWQTEHLPQFGVRNIHISHRQQEGTKSQTVLVAPPSTGTIITSIPPAPPDHENTSDPKPSSPMQRNQGGFFTTSEKTQPTSGQTDSTTQKQPSGVQSTKSSFFTQPSSPTTAKIHQRTDAEKSSRKDASSPSKNNQASPKEAPDKPHLSDFSKIGYNAEAGSLVKPSPQASSKIPGARQASEAVAPDKPSPGSAKSPHRITEPDYNETESKPFGVHPHVDKPDEQKQQTPYGKPPEQRVADTIVGPESGEKQESAIGSPYARGKT

SEQ ID NO: 35399 - DNA, 674 bp, Panicum virgatum
  misc_feature: Ceres CLONE 1961327
  misc_feature: Encodes the peptide sequence at SEQ ID NO. 35400
ctctgtgtgtgtgtgtgtgtatcagagcctccgtctctcctctcctctccgcctccgcctccgcctccaccccaccccaccccaccccaccccacacctccgccccacccccgccgccgcaggcaggaaggaaggatggaggcccctggctccccctacgcctcctcgccggaatccgccccgaagcgcgccccacgttcccctccgcagcatcagcagcagccgccctccgaggaaggagatgacaaggacaagccaacacatttgaggttcctggtgtctaatactgcagcaggatgtattattggcaagggtggatcaaccatcaatgactttcagtcccagtctggggctcgtattcagttatcacgtagccatgagttcttccctggtacaaatgaccgaatcatcatggtttctggaatgtttgatgaagtaatgaaggccatggagctaattcttgagaaacttttggctgagggtgaagagttcaatgaagctgaagctagacctaaagttagacttgtagttcctaacagctcttgtggtgggataattggtaaaggtggatcaacaataaagtcttttattgaagaatcgcacgctggaatcaaaatttcgccacaggataacaactatgctggtttgcatgacaggcttgttactgtcccagg

SEQ ID NO: 35400 - protein, 179 aa, Panicum virgatum
  misc_feature: Ceres CLONE 1961327
  misc_feature (43)..(108): Pfam Name: KH_1 Pfam Description: KH domain
  misc_feature (127)..(174): Pfam Name: KH_1 Pfam Description: KH domain
MEAPGSPYASSPESAPKRAPRSPPQHQQQPPSEEGDDKDKPTHLRFLVSNTAAGCIIGKGGSTINDFQSQSGARIQLSRSHEFFPGTNDRIIMVSGMFDEVMKAMELILEKLLAEGEEFNEAEARPKVRLVVPNSSCGGIIGKGGSTIKSFIEESHAGIKISPQDNNYAGLHDRLVTVP

SEQ ID NO: 35401 - DNA, 613 bp, Panicum virgatum
  misc_feature: Ceres CLONE 1961334
  misc_feature: Encodes the peptide sequence at SEQ ID NO. 35402
gctctgggttgagagaagagagagagagagaccccactggtgcctgagccgcagaagagaaggataatcaataagtgaggagatcaatcgacgagaagcggaggggctgtggtgtggtggtagccatggacgactcggcgccgaggaagctggacgagatcgcgggagggggaggggcgcccggggactggagctacctcacgtcggaaggcgcttccgcttccttcccgctcttccccttccccagggacgccctctccacgccgccctcggtcgcctcgctgctactctccatggaccccgccgccctcttcgacatccacggcgccttccccccgccgtcctccgctgccggcggcggcggaggctccgcgctgcccgccttccacgacttcacctccaccaaccccttcgacgacgccgggcagttcctcgccgcgcccccgccggcgccggcggagcagcaccaggggcacaaaggtgggttcttggcgccgccgccggccccggccttcgggatcgactgggacgacgacgatgagatggagcacagcgtcgacgcgtcctccctggccatatcggcctctatggagaatgctgcgggccgcgtcca

SEQ ID NO: 35402 - protein, 162 aa, Panicum virgatum
  misc_feature: Ceres CLONE 1961334
  misc_feature: The sequence is a functional homolog of SEQ ID NO 1378 in the 10/374,780 US patent application
  misc_feature: The sequence is a functional homolog of SEQ ID NO 1499 in the 10/412,699 US patent application
MDDSAPRKLDEIAGGGGAPGDWSYLTSEGASASFPLFPFPRDALSTPPSVASLLLSMDPAALFDIHGAFPPPSSAAGGGGGSALPAFHDFTSTNPFDDAGQFLAAPPPAPAEQHQGHKGGFLAPPPAPAFGIDWDDDDEMEHSVDASSLAISASMENAAGRV

SEQ ID NO: 35403 - DNA, 643 bp, Panicum virgatum
  misc_feature: Ceres CLONE 1961357
  misc_feature: Encodes the peptide sequence at SEQ ID NO. 35404
gtttaagcaagcagcactgggcattatcttggcaggctcaatagctggtgctattgcactgtccgtggtagccactaccctcatagcgagaaggcgttcaagacatagtacagtctcgaagcgttcattgtcaaggttttctgtcaaaattgatggtgtcagatgcttcacatttgatgaaatggctatagccacaaacaactttgatctatcagcccaagttggccaaggaggttatggaaaagtctacaaaggtattctagctgatggagcaattgtagcaatcaaaagaccacatgaggattctctccaaggttcaaaggagttctgcacagaaatagagttattatcaagattgcatcatcgcaatttggtttcattggttggctattgtgatgaagaagatgagcagatgcttgtttatgaattcatgtcaaatggtactttacgtgatcatctttctgccaagtccaaaagacctcttagttttggtttgaggctgaaaatcgcattgggtgcctcgaaaggaattttgtatctgcatactgaagcaaatccacctatattccaccgtgatgtgaaggccagtaacattctgttggactccaaattcatcgcaaaggtagccgattttggtctgtca

SEQ ID NO: 35404 - protein, 213 aa, Panicum virgatum
  misc_feature: Ceres CLONE 1961357
  misc_feature (68)..(213): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Functional homolog of the protein sequence given in SEQ ID NO 51140
  misc_feature: Useful for making plants with altered carbohydrate content
FKQAALGIILAGSIAGAIALSVVATTLIARRRSRHSTVSKRSLSRFSVKIDGVRCFTFDEMAIATNNFDLSAQVGQGGYGKVYKGILADGAIVAIKRPHEDSLQGSKEFCTEIELLSRLHHRNLVSLVGYCDEEDEQMLVYEFMSNGTLRDHLSAKSKRPLSFGLRLKIALGASKGILYLHTEANPPIFHRDVKASNILLDSKFIAKVADFGL

SEQ ID NO: 35405 - DNA, 705 bp, Panicum virgatum
  misc_feature: Ceres CLONE 1961363
  misc_feature: Encodes the peptide sequence at SEQ ID NO. 35406
agatctcgaccagcaccagcagtgtcagtcgccggcgagcggtaagggcggacggaccacccgacgcgatgccgccgcccctccaaaccctaaccactcccgccctcctcatcctcgtcctgctcaccgcttccgccgtttcctgttcttccttgccgccggaggacggcatccgggttgtctctgccgagaaaaggatcgacctcaccagtcccattgtcaaagtctatctaacattgaaggttgagaatgctccagctgcctctgatgcctcccaaattcttctcgccttcacgcccacagaggctcaacatcttgctattgtcaaggccacaagagcagaggggaagcgcaagaagaagacatatgtgcccctctcggttgaagcctctgatctcgcctccactgccctgaatggtgctcgcctctactctgttttgctgggcgctcctctgaaacctggcgagacaaccactcttgaagtgttatacgtgctgacacacactttagagccctttcctgctgagattagccagtcagagtcccagctggtttacttccgtgacagtgcggtgcttctctcgccttaccatgttctggagcaggttacctacatcaaaacaccaagcaataggattgagtccttcacaagggtcgatccaaccagtcgtgctggtactgaattgaaatatggcacatataaaa

SEQ ID NO: 35406 - protein, 212 aa, Panicum virgatum
  misc_feature: Ceres CLONE 1961363
  misc_feature: SWISSPROT Homolog: EC 2.4.1.119 Dolichyl-diphosphooligosaccharide--protein glycotransferase
MPPPLQTLTTPALLILVLLTASAVSCSSLPPEDGIRVVSAEKRIDLTSPIVKVYLTLKVENAPAASDASQILLAFTPTEAQHLAIVKATRAEGKRKKKTYVPLSVEASDLASTALNGARLYSVLLGAPLKPGETTTLEVLYVLTHTLEPFPAEISQSESQLVYFRDSAVLLSPYHVLEQVTYIKTPSNRIESFTRVDPTSRAGTELKYGTYK

SEQ ID NO: 35407 - DNA, 1257 bp, Panicum virgatum
  misc_feature: Ceres CLONE 1961364
  misc_feature: Encodes the peptide sequence at SEQ ID NO. 35408
gaacacgaaaaagtgagtcgtaaagcttctcgctcataaaccgaaaaaccttctttctcgttctcagtcagactcttatgaaaagaaagagagacgagatggaggttagcactgaagctaatccaaatgccacctatcattacactgacccctggatagttctcaaaaatctgagcaagttatttcaagacccacaaaatacgagtgatattactttgattgttggtccaaggaattcattgccttcctcttcttcctcttcttcctcttcttccacttgttcctcttcttccacttcttccacttcttccacacccacttcctccacccccttcgacgctgaaaatacttcttctgttgcctcttctcaactctcttctgtacgtgtgtcccgttgggactctttcagtgattatgcccttccgaactcaagtagccaaattatgccttttaaagcccataaaatagttcttgcttctcaaagtgaggtctttcgggccatgttttatggaggaatgaaggaagccaaacaaagcgaaatctacattcctgatgttgaccccaacatttttcacatcatgcttcaatttttttactctggaagcttctcgttcacatcttctgaagttcttcctctgattgctgcagcaagcttatatggggtggagggtttaaaggaagggtgcctgaagaggcttgacctttccaactgtctccagttgctcactgctgcctatacgtatcatgagaaagagctcacacaaacttgcttaaaattcatctggaaggtggctccttcggttttcttactggatacctttctcgacgttcctaaagaccttctcgcatgtatcttagagagtgacgaacttgaagcggacgaaatttgtgttttccgtggggccctctcatggctcaggagtaatacaggggaacaagtagccgatggtgaacaagaagatcttaaaccagaagaaatatggaatcttgttcggtttcctctcatcagcggacaagaacttatctccgaagtaaagccctgtctttccttaccttgggctggcattcctcagaaactgtacgttgaggcccttgagcataaattatgcccaaattccacctctgctccaacttcttctcttgcttcagcctctggttccccctcagcacctgctacctcaacaacttcacccactgcttcacctccctccgtgactactgctccctccccacctccagtttcccccttccagctga

SEQ ID NO: 35408 - protein, 386 aa, Panicum virgatum
  misc_feature: Ceres CLONE 1961364
  misc_feature (25)..(204): Pfam Name: BTB Pfam Description: BTB/POZ domain
  misc_feature (205)..(313): Pfam Name: BACK Pfam Description: BTB And C-terminal Kelch
MEVSTEANPNATYHYTDPWIVLKNLSKLFQDPQNTSDITLIVGPRNSLPSSSSSSSSSSTCSSSSTSSTSSTPTSSTPFDAENTSSVASSQLSSVRVSRWDSFSDYALPNSSSQIMPFKAHKIVLASQSEVFRAMFYGGMKEAKQSEIYIPDVDPNIFHIMLQFFYSGSFSFTSSEVLPLIAAASLYGVEGLKEGCLKRLDLSNCLQLLTAAYTYHEKELTQTCLKFIWKVAPSVFLLDTFLDVPKDLLACILESDELEADEICVFRGALSWLRSNTGEQVADGEQEDLKPEEIWNLVRFPLISGQELISEVKPCLSLPWAGIPQKLYVEALEHKLCPNSTSAPTSSLASASGSPSAPATSTTSPTASPPSVTTAPSPPPVSPFQL

SEQ ID NO: 35409 - DNA, 678 bp, Panicum virgatum
  misc_feature: Ceres CLONE 1961375
  misc_feature: Encodes the peptide sequence at SEQ ID NO. 35410
agcccacggcgcgcgcctgcggcgacgacgatggtggccgctcacggccgtgttcttcttcgcgtcgtcgcgcttctccttctcgccgccgcagctgccgggaacagcgcagtggtctccctgcgtgagttggatggacaacgggatgccgcgagggaggcacggaacagccgctacgctgctgacatgctaggggagcgcaagaaatcaggggcagcaagaacaccgaccaccgtgctagagctgaagcaccactcgctcaccgccatccccgacgagcccgcagctcgcgaccgatacctccgccgcctcctcgccgccgacgaagcgcgtgccaactcactgcaggtccacgataacagggcggcagcgtccacgacgcagtcccgctccgccgaggtcccgctgacccccggcataagcttccagacgctcaactacgtcaccaccatcgggctcggcggcagctccggctccgccgtcaccaacctcaccgtcatcgtggacacgggcagcgacctgacgtgggtgcagtgcaagccctgctccacgtgctacgcgcagcgcgacccgctcttcgaccccgcgggctccgccacctacgccgccgtccggtgcaacgcgtcggcgtgcgcggcctccctcaaggccgccacgggcacgccgggctcctgcgcc

SEQ ID NO: 35410 - protein, 215 aa, Panicum virgatum
  misc_feature: Ceres CLONE 1961375
  misc_feature: SWISSPROT Homolog: EC 3.4.23.12 Nepenthesin
MVAAHGRVLLRVVALLLLAAAAAGNSAVVSLRELDGQRDAAREARNSRYAADMLGERKKSGAARTPTTVLELKHHSLTAIPDEPAARDRYLRRLLAADEARANSLQVHDNRAAASTTQSRSAEVPLTPGISFQTLNYVTTIGLGGSSGSAVTNLTVIVDTGSDLTWVQCKPCSTCYAQRDPLFDPAGSATYAAVRCNASACAASLKAATGTPGSC

SEQ ID NO: 35411 - DNA, 1356 bp, Panicum virgatum
  misc_feature: Ceres CLONE 1961384
  misc_feature: Encodes the peptide sequence at SEQ ID NO. 35412
actgcgcgccgccacgccacgcaccatcagcccagccatggcgttcgccgcgcggaggagcatcgccgcgcgaatatcccaccacctcacacgccgcgtccatccctgcgtcccccacgcgctcacctcccgctcccccgacgaccaggcgagctcgtcgccggggatcccggccccgctcccaccgctcgacaccccgttccagcaccgttctggagcggcccaaaccctaggcttcctccctttctcgctccaccttgctgggccaacccgccgcagcttctcctcctcagcccccggccccacccccgaccttgagcccagccctgccgcggaggtcgatgccgcaggcgtccttgcagatgcagcggaggcagcggcggcggtgccggcgccgttcccgggggaggtggccgccgcggctgccgactcgttcctccccgtcgccgcgcttcagcacttgattgacgccgtccatacctttactgggctgaactggtgggcgtgcatcgcgctgacaactttgattatccggaccgcgacaatcccgctgcttgtgaaccagttgaagtccatgacgaagttaaatgcaataaagccagagatggaagccattaaagatcagacggataccatggatctaaaatcagcacaggagggaaaagctaaaatggacgcactattcaagaagcatggtgttagtccatttgctccaatgaaaggacttctgattcaaggaccagtgttcgtgagctttttcttcgctatatcaaacatggttgagaaggtcccgtcaatgaaaggaggtggagcattgtggtttactgatctgacgactccagattctctttacctccttcctgtggtaacaggactgaccgccttcgctacagtggagtttaacttgcaacaaggaatggagggaactcctatgaccggtaaaatgaagaacgttgctagagggatggcttttttgacagtcccatttacaatgaattttgccaagggaattttttgttactggatcacatcaaacatattttcccttgcatacggtattgttatccgacagccagctgtgaggaagctgttcaatcttcctcctttggcagctgagccctcgccagcaacaaaaaggccaatcttcaatttgttaggtggatctcctgcagtagagtcacccgtagcaattgcaggagcccagagatctgctctggggcaacctgatgctgctgctcttggatataaggtcaaaaatcttgaaaagaaagtgaaatccagggggaaaaggaaaaacaggtgaatttgtgggcgtatgggcacctgatatgggcccaaaagtcagatttttgcatt

SEQ ID NO: 35412 - protein, 421 aa, Panicum virgatum
  misc_feature: Ceres CLONE 1961384
  misc_feature (153)..(348): Pfam Name: 60KD_IMP Pfam Description: 60Kd inner membrane protein
MAFAARRSIAARISHHLTRRVHPCVPHALTSRSPDDQASSSPGIPAPLPPLDTPFQHRSGAAQTLGFLPFSLHLAGPTRRSFSSSAPGPTPDLEPSPAAEVDAAGVLADAAEAAAAVPAPFPGEVAAAAADSFLPVAALQHLIDAVHTFTGLNWWACIALTTLIIRTATIPLLVNQLKSMTKLNAIKPEMEAIKDQTDTMDLKSAQEGKAKMDALFKKHGVSPFAPMKGLLIQGPVFVSFFFAISNMVEKVPSMKGGGALWFTDLTTPDSLYLLPVVTGLTAFATVEFNLQQGMEGTPMTGKMKNVARGMAFLTVPFTMNFAKGIFCYWITSNIFSLAYGIVIRQPAVRKLFNLPPLAAEPSPATKRPIFNLLGGSPAVESPVAIAGAQRSALGQPDAAALGYKVKNLEKKVKSRGKRKNR

SEQ ID NO: 35413 - DNA, 638 bp, Panicum virgatum
  misc_feature: Ceres CLONE 1961433
  misc_feature: Encodes the peptide sequence at SEQ ID NO. 35414
aaaaaaaaaaaaaaaaacgcctcccaacccctctctcctcctctgctcccaagatctcctcatctcccggcccggcagcagcgcgcggggtgggcagagagatcgagatccggaggaggcgcggcacctcgcggcaccagcaatggcgggcacggtgacggtcccgggggcgaacgtcccctccacgccgctgctcaaggacgagctcgacatcgtgatcccgacgatccgcaacctcgacttcctggagatgtggcggcccttcttccagccgtaccacctcatcatcgtgcaggacggcgacccgaccaagaccatcaaggtgcccgagggcttcgactacgagctctacaaccgcaacgacatcaaccgcatcctcggccccaaggcatcctgcatctccttcaaggactccgcctgccgctgcttcggctacatggtctccaagaagaagtacatctacaccatcgacgacgactgcttcgttgccaaggatccatctggcaaggacatcaatgctcttgagcagcacatcaagaacctcctcagcccatccaccccgttcttctttaacacgctgtatgacccctaccgtgagggtgctgactttgtgcgtgggtaccccttcagcctcaggg

SEQ ID NO: 35414 - protein, 165 aa, Panicum virgatum
  misc_feature: Ceres CLONE 1961433
  misc_feature (13)..(165): Pfam Name: RGP Pfam Description: Reversibly glycosylated polypeptide
MAGTVTVPGANVPSTPLLKDELDIVIPTIRNLDFLEMWRPFFQPYHLIIVQDGDPTKTIKVPEGFDYELYNRNDINRILGPKASCISFKDSACRCFGYMVSKKKYIYTIDDDCFVAKDPSGKDINALEQHIKNLLSPSTPFFFNTLYDPYREGADFVRGYPFSLR

SEQ ID NO: 35415 - DNA, 1334 bp, Panicum virgatum
  misc_feature: Ceres CLONE 1961439
  misc_feature: Encodes the peptide sequence at SEQ ID NO. 35416
gtaaaaggatatgccaccgtgtttgattttcgagttttttgggggggaaatcggccgcgttcaggtatctccgtgttgccgagccctgccaaggatttcgggtggcatgaccccggctacatccattcggtcatcatgactgggctccagccctctcaatcctacacctaccgctatggaagtgattctgtgggttggagtgacacgatcaaattcagaactccaccagctgcaggttcagatgagctatcctttgtgatctatggtgatatgggaaaggctccgctggatccatctgtggaacactacattcagcctggatcgatttctgtggccaaggcagtggctaaagagatccaaacaggaaaggtcgactccatcttccatataggagacatcagctatgctacgggtttcctggtggaatgggacttcttccttcacctaatcacgccacttgcttctcaagtttcctacatgaccgccattggcaatcacgaaagggattacgcgaactctgcatctgtgtatgtgactcctgattcaggtggtgaatgtggagtcgcctacgagtcatacttccccatgcctgctgtcagcaaggacaagccatggtattcgatcgaacaagggagcgttcacttcattgtgatgtctaccgagcatgagtggtcagagaagtcagagcagtacaattggatggacgaagatttgtcatcgattgatagatcaagaacaccatgggtaaccttcattgggcatagaccgatgtattcctcccatggcggtatactgcccaatgtggattccaactttgttgcgtctgttgagccactcctgctcaactaccaggtggatttggttttcttcggacatgtacacaactatgagaggacttgtgcagtataccagggaaactgcaatggcattccaacaaaggatgcaaacggaattgacgtctatgacaacagcaactataccgcaccagttcatgctattgttggagcaggagggttcagcttggataacttccctaacaatggggagacctggagcttatcgagggtttcagagttcggctatgccagggttcatgccacaagagccgacatgcttgttcagtttgtaaactcaagtacgatggaagtccgggaccaatttaggattgtgaagggatcttcagcaaagaagaccccgagcctgataattcaacaatagctgcagcaaagaaaacttgtttattttttgttatactgtaaatagttgctgaatcacacattactacgctagtgtatattattctacatatacacgtgtacaatgacaatagacgt

SEQ ID NO: 35416 - protein, 405 aa, Panicum virgatum
  misc_feature: Ceres CLONE 1961439
  misc_feature (83)..(296): Pfam Name: Metallophos Pfam Description: Calcineurin-like phosphoesterase
  misc_feature: SWISSPROT Homolog: EC 3.1.3.2 Acid phosphatase
VKGYATVFDFRVFWGGNRPRSGISVLPSPAKDFGWHDPGYIHSVIMTGLQPSQSYTYRYGSDSVGWSDTIKFRTPPAAGSDELSFVIYGDMGKAPLDPSVEHYIQPGSISVAKAVAKEIQTGKVDSIFHIGDISYATGFLVEWDFFLHLITPLASQVSYMTAIGNHERDYANSASVYVTPDSGGECGVAYESYFPMPAVSKDKPWYSIEQGSVHFIVMSTEHEWSEKSEQYNWMDEDLSSIDRSRTPWVTFIGHRPMYSSHGGILPNVDSNFVASVEPLLLNYQVDLVFFGHVHNYERTCAVYQGNCNGIPTKDANGIDVYDNSNYTAPVHAIVGAGGFSLDNFPNNGETWSLSRVSEFGYARVHATRADMLVQFVNSSTMEVRDQFRIVKGSSAKKTPSLIIQQ

SEQ ID NO: 35417 - DNA, 1097 bp, Panicum virgatum
  misc_feature: Ceres CLONE 1961458
  misc_feature: Encodes the peptide sequence at SEQ ID NO. 35418
atacaagaagatggttctgatggcacaccctgctcttctcctggtgctcctcctctcttcccctgcaatttcttcctccaagagaatccagcccaagtttccggccatcttctactttggcgactccgttcttgataccggcaacaacaatcgtctccctacggtggccttggcaaaccatgttccttacgggagggacttcccagggaagaagccgacagggaggttctccaatggccggctcgttccagacctcctcaatcagaggctgcagctcaaggaattctctccgccatacctggattccaagctgtcgaacaacgacatcatgacaggggtcaactttgcgtctgcgggttcagggttcgatgacaagacgtcgcagctggccaataccctgccaatgtcgaagcaggtgaacctcttcagggactacctcatccggctcaggaacattgttggagataagaacgcttccaggatcattgccagctccctgatttttgtcagctcagggaccaatgatttctcacattactaccgttcgtcaaagaagaagaagatggacattggtgaataccaagatactgttctccagatggtataagctcgtgtcaaggaactatatgaccttgggggccgccaattctccttggcaggccttcccccgtttggttgcacacctatccaaatcacattgagcagagaccctgacagggcatgcgtggatgagcagaactgggatgctcaggtctacaactctaaacttcaagaattacttccaacattgcaaggctcactccatggaagcaaaattgtgtacctagatgcatacagggctctcatggagatccttgaggagcccgcgaaatatggatttacagaaacaacacgaggatgttgcgggactgggctcagagaggttgccctgctttgcaatgcattcactcctatctgcaaaaatgtgtcgtcctatgtattttacgatgctgtgcacccaacagaaagggtatacatgttagtaaatgactacatagtgaaaaatgttattccacagttttaattaatcacatatccatataaggttttctccttgt

SEQ ID NO: 35418 - protein, 198 aa, Panicum virgatum
  misc_feature: Ceres CLONE 1961458
  misc_feature (33)..(197): Pfam Name: Lipase_GDSL Pfam Description: GDSL-like Lipase/Acylhydrolase
  misc_feature: SWISSPROT Homolog: EC 3.2.1.51 Alpha-L-fucosidase
MVLMAHPALLLVLLLSSPAISSSKRIQPKFPAIFYFGDSVLDTGNNNRLPTVALANHVPYGRDFPGKKPTGRFSNGRLVPDLLNQRLQLKEFSPPYLDSKLSNNDIMTGVNFASAGSGFDDKTSQLANTLPMSKQVNLFRDYLIRLRNIVGDKNASRIIASSLIFVSSGTNDFSHYYRSSKKKKMDIGEYQDTVLQMV

SEQ ID NO: 35419 - DNA, 683 bp, Panicum virgatum
  misc_feature: Ceres CLONE 1961462
  misc_feature: Encodes the peptide sequence at SEQ ID NO. 35420
agaagcaaagatgagacaaagaggcaaattgctgtggcaacataccttattgataaactagcccttagggcaggcaatgaaaaggacgatgatgaagctgatactgttggttgctgtacgctaaaaattgataatgttacttgtttgcccccaaataagatccagtttgactttctgggtaaagattctataagatattttaacaccgtagaggttgaagaacttgtgtacaaggcgattgagggtttccgccttggaaagccaccgggatatgatctctttgacaaacttgatacaactaggctaaacgcacacctgaaggacctgatgcctgggcttactgcaaaagtgttccgtacatataatgcttccatcacattggatgacattttgcacaaggaaacagaagatggaactcttctcgaaaaaattgctgtatatcagcgcgcaaacaaagaggttgccataatctgtaaccatcaacgtagtgtgtcaaaatcacatgaatcccagatgaccagacttaatgaaaagattgatgatttaaaggcccagagagatgagttaaaagttgacttgggcaaagcaaagaaaggaaagcctctgggcaatgataaagatggaaagccaaagaagacctcgccccctgaacagattgaaaagaagatttcagctattgaaac

SEQ ID NO: 35420 - protein, 227 aa, Panicum virgatum
  misc_feature: Ceres CLONE 1961462
  misc_feature (1)..(201): Pfam Name: Topoisom_I Pfam Description: Eukaryotic DNA topoisomerase I, catalytic core
  misc_feature: SWISSPROT Homolog: EC 5.99.1.2 DNA topoisomerase
RSKDETKRQIAVATYLIDKLALRAGNEKDDDEADTVGCCTLKIDNVTCLPPNKIQFDFLGKDSIRYFNTVEVEELVYKAIEGFRLGKPPGYDLFDKLDTTRLNAHLKDLMPGLTAKVFRTYNASITLDDILHKETEDGTLLEKIAVYQRANKEVAIICNHQRSVSKSHESQMTRLNEKIDDLKAQRDELKVDLGKAKKGKPLGNDKDGKPKKTSPPEQIEKKISAIE

SEQ ID NO: 35421 - DNA, 667 bp, Panicum virgatum
  misc_feature: Ceres CLONE 1961475
  misc_feature: Encodes the peptide sequence at SEQ ID NO. 35422
aaaaaaaaaaaaaaagctcacctttgagccctgtgattcctacagtgatctgagctgagctacggccaggaaggaggagaggagaagaacaggagatgatgcgcgaagcgtatatggaggtgctcccgccgatggaccacatagcctcgcagaggaacggctggtatcatcatccggctttgcgcatctggacggcggaggagaacaagcagttcgagcgggcgctcgccgggctcgacctgcgctgcccggactgggagcaggtggcgcgggccatccccggcagaacggtccgcgaggtcgtccatcacttcaagagcctcgaggtcgacgtccagcagatcgagaacggcatggtgcccttcccgttctacggcggcggcggcggctcgttcaccctgcagtgggacggcaatggcggcgggggccccggggacttcaggcacgggtaccgcttcggcggaggctgcgggaagcggcaccccggccgcacgccggagcaggagaggaagaagggcgtgccatggaccgaggaggagcacaagttgtttctcttgggcctcaagaagcatggcaaaggggattggaggaacatatcccgtaacttcgttcagaccaggacacctactcaagtggccagtcacgcacagaagtacttcatcaggct

SEQ ID NO: 35422 - protein, 190 aa, Panicum virgatum
  misc_feature: Ceres CLONE 1961475
  misc_feature (141)..(188): Pfam Name: Myb_DNA-binding Pfam Description: Myb-like DNA-binding domain
  misc_feature (29)..(77): Pfam Name: Myb_DNA-binding Pfam Description: Myb-like DNA-binding domain
  misc_feature: The sequence is a functional homolog of SEQ ID NO 120 in the 11/375,241 US patent application
  misc_feature: The sequence is a functional homolog of SEQ ID NO 2680 in the 10/374,780 US patent application
  misc_feature: The sequence is a functional homolog of SEQ ID NO 654 in the 10/225,066 US patent application
  misc_feature: The sequence is a functional homolog of SEQ ID NO 1897 in the 11/479,226 US patent application
  misc_feature: The sequence is a functional homolog of SEQ ID NO 22 in the 10/225,066 US patent application
  misc_feature: The sequence is a functional homolog of SEQ ID NO 2870 in the 10/374,780 US patent application
  misc_feature: The sequence is a functional homolog of SEQ ID NO 886 in the 11/435,388 US patent application
MMREAYMEVLPPMDHIASQRNGWYHHPALRIWTAEENKQFERALAGLDLRCPDWEQVARAIPGRTVREVVHHFKSLEVDVQQIENGMVPFPFYGGGGGSFTLQWDGNGGGGPGDFRHGYRFGGGCGKRHPGRTPEQERKKGVPWTEEEHKLFLLGLKKHGKGDWRNISRNFVQTRTPTQVASHAQKYFIR

SEQ ID NO: 35423 - DNA, 627 bp, Panicum virgatum
  misc_feature: Ceres CLONE 1961479
  misc_feature: Encodes the peptide sequence at SEQ ID NO. 35424
gaaaaacccttgttttatttccgcagctcctccctcccttgtccgctccaccaccctgctctgcccaagcagcacgcgcatcgcgctcccagatccccctcccgcattccccgaggccagcttgtagtgaacacgatgagtgcttcagcagctgctggtgtgaagatggtgtctgcacgcccctgcatctcggcttcacaaggaatgcttgcctcgagggcagcggtttccaggattgaaaccaccgctagatttgcaagctgccccaaaatctgctgctccaggcctcttggttctaagcgcgctggttttgtcgtaagagcaatgtcaggagagagtggcccacaggggcttcccattgatctcagaggtaaaagggcatttattgctggagttgctgatgacaatggctatggatgggcaattgcaaaagctcttgctgcagctggtgcggaaattcttgttggtacatgggtgccggcacttaacatatttgagacaagtctgaggcgtggaaagttcgacgaatcacgcaagttgccagatggatctcttatggatattgttaaagtctatccacttgatgctgtctatgattcccctgaagatgttcctgaagatgtaaaa

SEQ ID NO: 35424 - protein, 163 aa, Panicum virgatum
  misc_feature: Ceres CLONE 1961479
  misc_feature: SWISSPROT Homolog: EC 1.3.1.9 Enoyl-[acyl-carrier-protein] reductase (NADH)
  misc_feature: The sequence is a functional homolog of SEQ ID NO 2 in US patent 7141721
MSASAAAGVKMVSARPCISASQGMLASRAAVSRIETTARFASCPKICCSRPLGSKRAGFVVRAMSGESGPQGLPIDLRGKRAFIAGVADDNGYGWAIAKALAAAGAEILVGTWVPALNIFETSLRRGKFDESRKLPDGSLMDIVKVYPLDAVYDSPEDVPEDV

SEQ ID NO: 35425 - DNA, 1161 bp, Panicum virgatum
  misc_feature: Ceres CLONE 1961489
  misc_feature: Encodes the peptide sequence at SEQ ID NO. 35426
actcaactgcctgcgaaccacgaaaggggccgagaaaaaaaaatcaataaaagcgtctccacaagcggacgcggcattgtcctcggcgcggttcctcccggcgaccacgaagacgaacacaccgaggcaagtcagcgtctcagcgatgaatcccttcgcgaagaagccagcgccgcgagaggtgatgcggagcagcaagcgagacctgacgaatgctacgcgagggattgagagggatgtcgcatcattacaacaagaggagaagaagctagttgctgaaattaaaaggacagcaaaaactggcaatgaggcagcaacaaaaattctagcccgtcagctgatcaggttaaggcagcagatttctaatttgcaaggtagccgagctcagattcgggggattgcaacacatactcaggcaatgcatgccaacacttcagtggctactggtttacaaagtgcgagcaaagcaatgggagctcttaataagcaaatggcacctgaaaagcagatgaaaataatgaaagaattccaaaagcagtcagcacaaatggatatgacaaatgagatgatgtctgattcaattgatgatgtcttggacgatgatcaggctgaggaagagactgaagaacttgctaatcaggttctggatgagattggtgtggacattgcctcacagttgtcctcggctcctaaaggaaaaattgccggaaagaaggttcaggttgatgaaagttcagagctggaggaactagagaaaaggctggctgctttaaaaaatccgtaggatggtacctgttcgcatccttctctctacgcagagtccatatcctcgttagacattcaaaaaacatcgtgattttgtaaatattggatgaaagatgatcccagccccaagtttctcgacgaatcgatgagcacctatacagccatacatgctatcttgcagaagatggggctgtggtgcgttaacagtgacatattacttgattcagagcaacttatgtaatcgtgtaaaggaaattcgaatattttacagcttggccttttgtttctgatcattcaacatgataacattttgtttttgttcgtgtaaagaagttagaacctcacagcaacaatgattgctcgaatttttttaagcatcaaattactttgcgatcg

SEQ ID NO: 35426 - protein, 212 aa, Panicum virgatum
  misc_feature: Ceres CLONE 1961489
  misc_feature (16)..(186): Pfam Name: Snf7 Pfam Description: Snf7
MNPFAKKPAPREVMRSSKRDLTNATRGIERDVASLQQEEKKLVAEIKRTAKTGNEAATKILARQLIRLRQQISNLQGSRAQIRGIATHTQAMHANTSVATGLQSASKAMGALNKQMAPEKQMKIMKEFQKQSAQMDMTNEMMSDSIDDVLDDDQAEEETEELANQVLDEIGVDIASQLSSAPKGKIAGKKVQVDESSELEELEKRLAALKNP

SEQ ID NO: 35427 - DNA, 610 bp, Panicum virgatum
  misc_feature: Ceres CLONE 1961495
  misc_feature: Encodes the peptide sequence at SEQ ID NO. 35428
attccgctagctgttccgcgctctccaagcctccagctccattcgattcgactcgattccccttccctgcctcgtcctcgtccatggatgatcggatcaccaccgacggcgggacatgcgacgtcggagaatttgcgtgggacgtggtgctctggcgccggggccgcgccgacgtaagcgcctgcctgctggcggccaccgccgcctcctggctgctcttctacggcccgggccgcggctacaccgcgctctccctcgcctccgacgtgctcctgcacctcctcaccgtgctcttcctctggggcaaggccgcgcgcctcctcaacaggccggcgccccccgtcccggcgatgcgcgtctcgcagcgggtcgtggacgaggcggcggccctgctgcgcgccgccctcgacgccgtctgctccggcttccatgacatcgccacgggcggggactcgctcctcttctgccgggtcttcctctgcctgtgggccctctccatcgtcggcagcctcaccgatttccccaccttctgctacgcgagcatcgtggctgctctgacgctcccggcattgtaccagaaataccaagattgtgtggacacatacatgag

SEQ ID NO: 35428 - protein, 175 aa, Panicum virgatum
  misc_feature: Ceres CLONE 1961495
  misc_feature (18)..(175): Pfam Name: Reticulon Pfam Description: Reticulon
MDDRITTDGGTCDVGEFAWDVVLWRRGRADVSACLLAATAASWLLFYGPGRGYTALSLASDVLLHLLTVLFLWGKAARLLNRPAPPVPAMRVSQRVVDEAAALLRAALDAVCSGFHDIATGGDSLLFCRVFLCLWALSIVGSLTDFPTFCYASIVAALTLPALYQKYQDCVDTYM

SEQ ID NO: 35429 - DNA, 1172 bp, Panicum virgatum
  misc_feature: Ceres CLONE 1961500
  misc_feature: Encodes the peptide sequence at SEQ ID NO. 35430
agaattcagaaccgcggacgatccaatccaacagagagaggatttatacataaaccctgcaactactttcttctttcttttgttcgtcgtcggcagctgtctctaaactctccggcggcggctcctcagtcctcacccggagggtcggaggagaagatgagcttcttcgcccgcggcagcaggaaccagaggaccttcaggcccaagaagagcgcgccctcgggaaacaagggtatgcagctgaaaaggcacatcgacgccactctcggcagcggcaacctgcgcgaggcggtacgtctgcccatcggggaggacctcaacgagtggctggccgtcaacactgttgacttcttcaaccaagtaaacattctgtacggcaccctgatggagttttgcacgccagctacctgcccgaccatgtcagccggaccaaaatacgagtacagatgggctgatggagtcaagatcaagaggcctatcgaggtctctgcaccaaagtacgttgagtacctgatggattggatagaagcccagctcgacgatgaaaacatattccctcagaagcttggggctcctttcccttccaacttccgtgacgtcgtcaagacgatcttcaagcgtctcttcagggtgtatgcgcacatataccactcgcactttcaggtgattatgaagctccaggaagaggcgcatctcaatacttgcttcaagcacttcacactcttcacattggaattccggctgatcgacagggcagagctggctcctctcagcgagttgattgaccccataatacttgggcgctaaaccagggagagagctttgatgacgccaagtgtggatagaattttttttttctctcctgattaattttttgatcaattcggatggaacgtctccatttacatttttggaagcatatattataggctagcagttcgcaagtcagatgtgttctgtagcagcctgatcgcaacgtcatcagtgaaaatggagtggttcttgatccgcatcagcagggtgcctcggttggttaatgtttctattgctcgtggctgctgctaaactgcagtgggccttcgtgaatcatgtatatagtttcagacgactgattcggaccgctattgggctaataacggtttgggcctgagttttgcccaattttggatgac

SEQ ID NO: 35430 - protein, 216 aa, Panicum virgatum
  misc_feature: Ceres CLONE 1961500
  misc_feature (30)..(206): Pfam Name: Mob1_phocein Pfam Description: Mob1/phocein family
MSFFARGSRNQRTFRPKKSAPSGNKGMQLKRHIDATLGSGNLREAVRLPIGEDLNEWLAVNTVDFFNQVNILYGTLMEFCTPATCPTMSAGPKYEYRWADGVKIKRPIEVSAPKYVEYLMDWIEAQLDDENIFPQKLGAPFPSNFRDVVKTIFKRLFRVYAHIYHSHFQVIMKLQEEAHLNTCFKHFTLFTLEFRLIDRAELAPLSELIDPIILGR

SEQ ID NO: 35431 - DNA, 493 bp, Panicum virgatum
  misc_feature: Ceres CLONE 1961510
  misc_feature: Encodes the peptide sequence at SEQ ID NO. 35432
aataccgtcccgtcccgtccccacgcctccgcacccccaatccagtgaccacccgcctcccctgcggaggcggcggcgcaatgcgtctccttcccctcgtcctcatcctcgccctcgcgctcgccgcggcgtccgccgccgcgagagcgagcgcaagcgggccccggtccgtcctccgcacggtcacggacgtcccggcggcggtctcctccggcggcgacagcgacgcgctcttctgcgacagctggaggctgtccgacgagacggcgaacgcggggccctggcgcgccatccccgcacgctgcgaggcgttcgtgcggggctacatggagggcccccgctacgcgaccgactccaccgtcgccgccgccaactccctcacgtacgcctccggcgcgctggccgccgccgccggggcgggcgccgcgaagcccgcgtgggtgttcaacgtcaaaaaaacactgctctccaacgcgccctactacgagggcaa

SEQ ID NO: 35432 - protein, 137 aa, Panicum virgatum
  misc_feature: Ceres CLONE 1961510
  misc_feature: SWISSPROT Homolog: EC 3.1.3.2 Acid phosphatase
MRLLPLVLILALALAAASAAARASASGPRSVLRTVTDVPAAVSSGGDSDALFCDSWRLSDETANAGPWRAIPARCEAFVRGYMEGPRYATDSTVAAANSLTYASGALAAAAGAGAAKPAWVFNVKKTLLSNAPYYEG

SEQ ID NO: 35433 - DNA, 664 bp, Panicum virgatum
  misc_feature: Ceres CLONE 1961512
  misc_feature: Encodes the peptide sequence at SEQ ID NO. 35434
cacggagtcgcagtgacaccgcgccttccaagaaccgcagctcgcccatcccccgcggcttgctgagcggagcggcggcggcaatgtcttccaacggcaagcccaccccgcagcccccggccggcgccggaggcccgcccaagatgtaccagcggccaatctaccgcccgcagcaggggcccgccaagcgccgccgcggcgggcgctcctgcccgttcagctgctgctgctgcttcttctggacggtcctcgtcatcctcctcctcgccttcatcgccgccgtggtcgggggagccttctacctcctgtaccgcccgcaccgcccggccttcacgctcaccgtggcgcgcgtcaccaagctgagcgtctcctcctccgccacggcgcccgcggtcaccgacgccatcgacgtgacgctcaccgccaagaaccccaacaagaagctcgtctacttctacgacgacttcaccgtcacggccgccaccgccgccaacgccgtcccgctcggggaggcctccgtgcccgggttcgcgcacgaggccggcaacatcaccgtcatcaaggccaccgtctccgcctccgccctcgcgatcgaccccaccgccagctccgacatcaagaagtccggcgagttccccatcaccgtcgacctggagaccaaggc

SEQ ID NO: 35434 - protein, 193 aa, Panicum virgatum
  misc_feature: Ceres CLONE 1961512
  misc_feature (73)..(191): Pfam Name: Hin1 Pfam Description: Harpin-induced protein 1 (Hin1)
MSSNGKPTPQPPAGAGGPPKMYQRPIYRPQQGPAKRRRGGRSCPFSCCCCFFWTVLVILLLAFIAAVVGGAFYLLYRPHRPAFTLTVARVTKLSVSSSATAPAVTDAIDVTLTAKNPNKKLVYFYDDFTVTAATAANAVPLGEASVPGFAHEAGNITVIKATVSASALAIDPTASSDIKKSGEFPITVDLETK

SEQ ID NO: 35435 - DNA, 682 bp, Panicum virgatum
  misc_feature: Ceres CLONE 1961524
  misc_feature: Encodes the peptide sequence at SEQ ID NO. 35436
aaaaaaatcacaatccagatcaaacgggcgcagcagaaactccagcgatcccagcccgcacaagcgagcgcgattcctctcctccgccctcccccgagctcccgcggcagccatggagaccctcatctccccctccacattgttcaccccactccgcggcctcaggagaccgggcctcgctgctgccgccacgcccaggcccgccgccgccgccgccgcttcctcctcccatggagttggagacccctgcgccgtcggcggcaggagctgggtgtcgttcctgcaccacggcctggcggcggccgcgctgtcgctggccatcagcctggcgcccgcgcccgcgccggcggtggcgtcggagttcgacgtgctgaacgacggcccccccgtggactcgtacgtggtggacgacgccggcgtgctcagccgcgtgaccaagtccgacgtcaagcggctggcgcgcgacctcgaggcccgcaagaacatccgcctcaacttcatcaccgtccgcaagctcacgagcaaagccgacgcgttcgagtacgcggaccaggtgctggagaagtggtacccgacgattgaggagggcagcaacaagggcatcatcgtgctcgtcaccagccagaaggagggcgccgtcaccggcggcccggccttcatccaggccgtcggcgagcagatc

SEQ ID NO: 35436 - protein, 189 aa, Panicum virgatum
  misc_feature: Ceres CLONE 1961524
  misc_feature: Functional homolog of the protein sequence given in SEQ ID NO 51492
  misc_feature: Useful for biocontainment applications
METLISPSTLFTPLRGLRRPGLAAAATPRPAAAAAASSSHGVGDPCAVGGRSWVSFLHHGLAAAALSLAISLAPAPAPAVASEFDVLNDGPPVDSYVVDDAGVLSRVTKSDVKRLARDLEARKNIRLNFITVRKLTSKADAFEYADQVLEKWYPTIEEGSNKGIIVLVTSQKEGAVTGGPAFIQAVGEQ

SEQ ID NO: 35437 - DNA, 656 bp, Panicum virgatum
  misc_feature: Ceres CLONE 1961531
  misc_feature: Encodes the peptide sequence at SEQ ID NO. 35438
gactacctatccattttcccagatccaatcccgactactcccatggcggccggcggcggccgcggcggcccccggctgcccgaggatctcgttatctgggagatcctgacgcgtctgccggtgaagcccctcctccggtgccgcgccgtctgccgctcctggcgccgccgactcacctccgacgccaaattcctcctcgcccaccaccgtcgccagccctcgctcccgctccttaccactaccacctgggacacggacacgcatgagagaaggatcgacgccctggaccaccgcaccggcgagcggcatcctgtcgcgcggaggacgggcccgatcgctgccttcgagaacgaccaccacgtgctcgcttcctgcgacggcctcatcatcctccatgagtacggcggcctcgagatctgcaacccggcgacccgccagcgcgcccccctcacgctgccccacggcgccgcctgcatctgcgcgctttaccctcaccgcccatccgggtcgcaccgagtgctgtgctgcttcaagagagccgaggacggccacgccgtgtaccacgtgcacaccctcgggtccggcgagctcaggtgcgtcggagagcctcccgggccgtgggcgtccggggatgtggcgatggtggtgtcgatgtt

SEQ ID NO: 35438 - protein, 204 aa, Panicum virgatum
  misc_feature: Ceres CLONE 1961531
  misc_feature (7)..(55): Pfam Name: F-box Pfam Description: F-box domain
MAAGGGRGGPRLPEDLVIWEILTRLPVKPLLRCRAVCRSWRRRLTSDAKFLLAHHRRQPSLPLLTTTTWDTDTHERRIDALDHRTGERHPVARRTGPIAAFENDHHVLASCDGLIILHEYGGLEICNPATRQRAPLTLPHGAACICALYPHRPSGSHRVLCCFKRAEDGHAVYHVHTLGSGELRCVGEPPGPWASGDVAMVVSM

SEQ ID NO: 35439 - DNA, 1309 bp, Panicum virgatum
  misc_feature: Ceres CLONE 1961533
  misc_feature: Encodes the peptide sequence at SEQ ID NO. 35440
cagtttccaaaccgagaaaaaaaataaaaacaaaaatcccatctttttttctcccggaaaagtggctccgccgcgctcggcgagctcgatggtcatgcatcatcccggcgccggcgcggcccccgcgtcgtccgtcggcgacgacgacttccactgggatgacgcggctgaggcggagctccaggccatcgaggccgcctacgccgccgccaagcgccgccgcctccccgactggacctccccgtccccttcatcctgcccccgctacagccaaagtcctgtttccggcggatacagccaaagcccggtttccggcggatctacgccgtcgtgggtgctcacgcccccctccttccaagggaatgtgagggcaaggcaccagccaatttcattcggcggtaagattgtttactgcaggacatcttctgaggtggagaaggctgcaatggacatcttaagcaaaatcgagagcatcaaggcccctggtccagtttctcttgggtttgatcttgaatggaggccctttccgagaagaggagagcccccatgtaaagttgctgtaatgcagctctgcatggaaaagactctgtgctacattctgcatatcgctcactctggagtaccacctaaactaaaatctctcttggaggataattcatccattaaagttggaatatgcatagacaacgatgcaagaaaaatgttgaacaattatgatacctgcgtacaaccattgatggatttgtcaatcttggcaaatgccaagttagctaggccttctaaaagatggagtcttgcttctttaactgaaatgatcacgtgtaaagagttgccgaagccaagcaacataagaatgggaaattgggaggctgatgttctcaccaagaagcaacttcagtatgctgccactgatgcttacatctcttggtacttgtatgaggcactacagagtcttccagattgtaatgctgaagctgaaattgagtctgtaaaggtatcatagattcaaatgcacattctactgggaaatgtgttgccaatctatttgaatattcccagtgatcttttgtcttcacatctcaatcagggttgaattcattgtgttgtcaaaagtgaaaaccgaaggtcaaaggacgttgaattcattgtgctgtaacacctgcggtttctgcttgtcatttctgcctatgatggcttgtttactggaaagcagaactagaatgtaatttgcgttgtgttgtcaaaattcaattttctgtatgatgagatcctttctatcctctacttaatgcaagtatgcgcaattctc

SEQ ID NO: 35440 - protein, 304 aa, Panicum virgatum
  misc_feature: Ceres CLONE 1961533
  misc_feature (106)..(291): Pfam Name: 3_5_exonuc Pfam Description: 3'-5' exonuclease
  misc_feature: SWISSPROT Homolog: EC 3.1.13.5 Ribonuclease D
MVMHHPGAGAAPASSVGDDDFHWDDAAEAELQAIEAAYAAAKRRRLPDWTSPSPSSCPRYSQSPVSGGYSQSPVSGGSTPSWVLTPPSFQGNVRARHQPISFGGKIVYCRTSSEVEKAAMDILSKIESIKAPGPVSLGFDLEWRPFPRRGEPPCKVAVMQLCMEKTLCYILHIAHSGVPPKLKSLLEDNSSIKVGICIDNDARKMLNNYDTCVQPLMDLSILANAKLARPSKRWSLASLTEMITCKELPKPSNIRMGNWEADVLTKKQLQYAATDAYISWYLYEALQSLPDCNAEAEIESVKVS

SEQ ID NO: 35441 - DNA, 1376 bp, Panicum virgatum
  misc_feature: Ceres CLONE 1961554
  misc_feature: Encodes the peptide sequence at SEQ ID NO. 35442
acggcccatttcgcaccaccaaaccaccccgcgcgatgtcgccgccgccggcgaccccacgccctcgccccccttcgcctccgccatcaccacgcccgaccgcctcagcttcctgcccctcctcggctgcgcctcctccttgccgctcctctccgcgctccactcgctgctcctccgcctcggcttcctctcccaccacgccatcgccggcgcgctcctcaagccctaccctttgccgcacggccgcgtcttgttcgacgaaatcccccagaagaacaggtgcgcggtcgcgtacaacacgctcatcactgcgataatcaaggccagggacatccgcgccgcgcgccacctgtttgaggaaatgcagcggtacaggcaatccaggaggagcgtggtttcttggaaccttatgatcggagggtgtgcacggtgcggacgagatgacatggcggtgtggtttttcgagaggatggtcggagagagggaggtggcgcccaatgatgggaccttggcggccgtgctcccagcctatgggaggactggaaatgttggagcagggaggtgggcgcatgagtatgcgatgaagactgggctgttagaaagtacagtgaatgttgctaatatggtggtggatatgtactgcaagtgtggtgatgttgccagtgcaagggaggtgttcgaggggatgcagcagcagagcgtggtaagctggaacactatgattaccggattctcacttaatggccatggagttgagggaattgaactgttccaagagatgcagcggcaaggaatggagcctaatgctgtgacattcttgggggtgcttgggtgctgtgcgcatgctgggtcagtggaagttggacaggagatcttccagaaaatgcagttggagcatggtattgagccagaaattgagcattatgggtgtatggtggatttacttggaagatctggccttcttgaggaggcacatgcactgattcaggagattccaatgaagcctaatgctgcaatatggggagcactgttaagtgcatgccgtgcccatgctggtctcggcattgctgaggtagctctgaaagagcttatcaatcttgagccatggaactcggggaaatatgtgctgttagccaatctttatgcagaaacaggacgatgggaggacgcaggggaagtgaggagactgatgaggacaatgagtgtgaataaggctccagggcagagcttaatcgaagaatccggttttcagttgacaaatgtatgccaatagccgacccccaggaaataaaacttcagtttgaaagacaaaactgctgagtctcagtttggaagttatcatctgttagctggagcttgacatgcgctcataattg

SEQ ID NO: 35442 - protein, 423 aa, Panicum virgatum
  misc_feature: Ceres CLONE 1961554
  misc_feature (235)..(269): Pfam Name: PPR Pfam Description: PPR repeat
  misc_feature (132)..(166): Pfam Name: PPR Pfam Description: PPR repeat
RPISHHQTTPRDVAAAGDPTPSPPFASAITTPDRLSFLPLLGCASSLPLLSALHSLLLRLGFLSHHAIAGALLKPYPLPHGRVLFDEIPQKNRCAVAYNTLITAIIKARDIRAARHLFEEMQRYRQSRRSVVSWNLMIGGCARCGRDDMAVWFFERMVGEREVAPNDGTLAAVLPAYGRTGNVGAGRWAHEYAMKTGLLESTVNVANMVVDMYCKCGDVASAREVFEGMQQQSVVSWNTMITGFSLNGHGVEGIELFQEMQRQGMEPNAVTFLGVLGCCAHAGSVEVGQEIFQKMQLEHGIEPEIEHYGCMVDLLGRSGLLEEAHALIQEIPMKPNAAIWGALLSACRAHAGLGIAEVALKELINLEPWNSGKYVLLANLYAETGRWEDAGEVRRLMRTMSVNKAPGQSLIEESGFQLTNVCQ

SEQ ID NO: 35443 - DNA, 637 bp, Panicum virgatum
  misc_feature: Ceres CLONE 1961558
  misc_feature: Encodes the peptide sequence at SEQ ID NO. 35444
acacttccttttcgtgggctgcgagcgtctcccctctgcccccgccgcaggacgatagagcgagatcgccgtctctcttcgtcggtggtgcgggtgcccgccctcccctagcgagatctccctgccggtcctccagatctggataccgatcttgctgtgctgatggtgaagatctgctgcttcggtgctggttatgtcggtggcccccatcctggccgtccttgcccgcacgtgcccggacgttgaggtcgccctcgatgacatctccattccccgctttgatgcctggaacactgacaccctcccggtctgcaagcctggtctcgatgatgttgtgaggcggtgcaggggcaataacctcttcgtggggggtggtgttgagaagcacgtcgctgaggctgacatcatctttgtctcggtgaacacccccaccaagacccgtggtcttggagctggcaaggctgccgacctcacctactgggagagcgctgctcgcatgatcgctgatgtctccaagtctgacaagatcgttgttgagaagtccactgtccctgtcaagactgctgaggctattgagaagatcttgacccacaacagcaagggcatcaactaccagatcctctccaacccggagttc

SEQ ID NO: 35444 - protein, 147 aa, Panicum virgatum
  misc_feature: Ceres CLONE 1961558
  misc_feature (1)..(147): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature: Functional homolog of the protein sequence given in SEQ ID NO 50760
  misc_feature: Useful for making plants with altered carbohydrate content
  misc_feature: Functional homolog of the protein sequence given in SEQ ID NO 50761
  misc_feature: Useful for making plants with altered cell wall content and/or composition
MSVAPILAVLARTCPDVEVALDDISIPRFDAWNTDTLPVCKPGLDDVVRRCRGNNLFVGGGVEKHVAEADIIFVSVNTPTKTRGLGAGKAADLTYWESAARMIADVSKSDKIVVEKSTVPVKTAEAIEKILTHNSKGINYQILSNPE

SEQ ID NO: 35445 - DNA, 717 bp, Panicum virgatum
  misc_feature: Ceres CLONE 1961575
  misc_feature: Encodes the peptide sequence at SEQ ID NO. 35446
aggccggagcctcggccctccattgttgttcctcttcttcttcccttcaaccagcgaggatccttcaagtgttcttctccagcccatatcggaggtaccgaacaatctttaatttgacagtccacacttcgaagtagctcaaatcaacagaattactaatgatttcccccagatcgaaaataaatggccaacgatgccagtcaaggtaaaagactggagacacagcagagtctcacaagtacgttaccgtcggaactaacattagacttcctgaagaaaattactaatgatttctccccagatcgaaagattggtcaatccgcatttgggacatattacaagggaattcttgataataatgggggcattttagctgtgaagaagcttgctgaaaactcgccactgccacgggacatatcatttgctaatgaggttacaaaccttatggctcttgaacatgaaaatataacaaagttagttggcttctgccgtgaagcgcatacgaaagtggttcagcgccagggaagatacgtggctgttaatattgacgaatgtttgctctgctataaataccggcctaatggaagtcttgacctgcatcttttcgataaaacacgtgaaattgactgggacaaacgattcaaaatagttaaggggatctgcaatggtttgtgttaccttcataaaggattgagcaagccaatcattcatatgaat

SEQ ID NO: 35446 - protein, 177 aa, Panicum virgatum
  misc_feature: Ceres CLONE 1961575
  misc_feature: SWISSPROT Homolog: EC 2.7.11.1 Non-specific serine/threonine protein kinase
MANDASQGKRLETQQSLTSTLPSELTLDFLKKITNDFSPDRKIGQSAFGTYYKGILDNNGGILAVKKLAENSPLPRDISFANEVTNLMALEHENITKLVGFCREAHTKVVQRQGRYVAVNIDECLLCYKYRPNGSLDLHLFDKTREIDWDKRFKIVKGICNGLCYLHKGLSKPIIHM

SEQ ID NO: 35447 - DNA, 710 bp, Panicum virgatum
  misc_feature: Ceres CLONE 1961582
  misc_feature: Encodes the peptide sequence at SEQ ID NO. 35448
gaaaaaaaacttcccatccccccagcgccgccgcctcgcattcgcagcccctgcaaaccctaaccctcctccccaccatggccggcgcgcaggagaccctggtgctcgccggcgtgatgcgcggccacaatgacgtcgtgacggcgatcgccacgcccatcgacaactcccccttcatcgtctcatcctcccgcgacaagtcgttgctggtctgggacctctccaaccccgtccaggccgctggggacggcactaccaccgccgactacggcgtgccattccgccgcctcaccgggcactcccacttcgtccaagacgtcgtcctcagctccgacggccagttcgcgctctcgggatcctgggacggggagctccgtctctgggacctctccacgggcctcaccacccgccgcttcgtcggccacgagaaggacgtcctctccgtcgccttctccgtcgacaaccgccagatcgtgtccgctgcccgcgaccgcaccatcaagctgtggaacacactcggagagtgcaagtacaccattggtggcgaccacggcgccggcgagggccacaccggctgggtatcgtgcgtccgcttctcgcccaacatctcacagccgacgatcgtctccggctcctgggaccgcagcgtcaaggtctggaacctcaccaactgcaagctccgctgcactcttcaaggtcacggcgggtac

SEQ ID NO: 35448 - protein, 210 aa, Panicum virgatum
  misc_feature: Ceres CLONE 1961582
  misc_feature (155)..(195): Pfam Name: WD40 Pfam Description: WD domain, G-beta repeat
  misc_feature (107)..(145): Pfam Name: WD40 Pfam Description: WD domain, G-beta repeat
  misc_feature (65)..(103): Pfam Name: WD40 Pfam Description: WD domain, G-beta repeat
  misc_feature (8)..(47): Pfam Name: WD40 Pfam Description: WD domain, G-beta repeat
  misc_feature: SWISSPROT Homolog: EC 2.7.11.7 [Myosin heavy-chain] kinase
MAGAQETLVLAGVMRGHNDVVTAIATPIDNSPFIVSSSRDKSLLVWDLSNPVQAAGDGTTTADYGVPFRRLTGHSHFVQDVVLSSDGQFALSGSWDGELRLWDLSTGLTTRRFVGHEKDVLSVAFSVDNRQIVSAARDRTIKLWNTLGECKYTIGGDHGAGEGHTGWVSCVRFSPNISQPTIVSGSWDRSVKVWNLTNCKLRCTLQGHGG

SEQ ID NO: 35449 - DNA, 1432 bp, Panicum virgatum
  misc_feature: Ceres CLONE 1961584
  misc_feature: Encodes the peptide sequence at SEQ ID NO. 35450
aaccactctgctgccgcccccaaccttggcgacgggaaaacaccccgaactcccccctccattcccaccccgaatccagcgaaacagcccgaccaaaatgccgcctcccaagcgcccccacctcgtcgccgccgccgccgccctcctcttcctggtcctactccccgtccacctcgccctcgccgccgcgcaggagttccgcggcttctcctaccttctcaactgcggcgccgcgtcctccaccaccgacggccgcggcctccgctgggagcctgacgggccctacgtctccgctggcactcccggggcgctcgcgctcccgggcccgggcggcctcctcgaccccacgctcgccatgctccgcaccttcccgcaccgccgcggggccaagttctgctacgagctccccgtcgacagaaaccgccgctacctgctccgccccaccttcttctacggcgcgctctccgccgccacctcctcctccgcggcgccttcgccgccagtcttcgatctgatcgtggacggcacactctggacagctgtcaacaccaccgacgacgcgctggccggcgccgcgtcgtcctacgagggcgtcttccccgcgagcggcaggaacatgagcttctgcctcggggtgaacccggactacaccgacgctggcccgttcatctccgcgctgcaggtgatccagctcgacgactccgtgtacaacgccacggatttcaggaccagcgccttgggcctcatagctcgcaccaaatttggctccaccggcgatatcgagaggtaccccagcgacagttttgatcgctattggctgccattcccagacagcaagcatgcaattagtagcacccaaaatgttacatcagctgatttctggaacctcccccctcccaatgtgtttaacacagctttcgtagcggaacaagatgcaccccttgtgttacaatggcctccaatgcctctccagaatgctagcttttatgttgccctctactttgccgatacattatctgagagttcaaggacctttgatgtatatataaatgattacctgtttctcaaaggtctaaatgtcacatcagctggtctctctgtctttgcaacacaatggattctctcaggcttgaccagagttatattgaaacctgcttctccttctgctcttcccccacttatcaatgctggcgaggtctttgggctttttcccataggaagattgacacatccacgggatgtacttgccctggagagtataaagaaacaccttcaaaatatacctgaagattggaatggagatccatgtatgccttcggggtattcttggactggagttacatgcgacgaaggatcaagaatacgtgtgatctctttgaacttctccggtatgggcctctctgggtctcttccacctgaaattgcaaacctg

SEQ ID NO: 35450 - protein, 444 aa, Panicum virgatum
  misc_feature: Ceres CLONE 1961584
  misc_feature (378)..(417): Pfam Name: LRRNT_2 Pfam Description: Leucine rich repeat N-terminal domain
  misc_feature: SWISSPROT Homolog: EC 2.7.11.1 Non-specific serine/threonine protein kinase
MPPPKRPHLVAAAAALLFLVLLPVHLALAAAQEFRGFSYLLNCGAASSTTDGRGLRWEPDGPYVSAGTPGALALPGPGGLLDPTLAMLRTFPHRRGAKFCYELPVDRNRRYLLRPTFFYGALSAATSSSAAPSPPVFDLIVDGTLWTAVNTTDDALAGAASSYEGVFPASGRNMSFCLGVNPDYTDAGPFISALQVIQLDDSVYNATDFRTSALGLIARTKFGSTGDIERYPSDSFDRYWLPFPDSKHAISSTQNVTSADFWNLPPPNVFNTAFVAEQDAPLVLQWPPMPLQNASFYVALYFADTLSESSRTFDVYINDYLFLKGLNVTSAGLSVFATQWILSGLTRVILKPASPSALPPLINAGEVFGLFPIGRLTHPRDVLALESIKKHLQNIPEDWNGDPCMPSGYSWTGVTCDEGSRIRVISLNFSGMGLSGSLPPEIAN

SEQ ID NO: 35451 - DNA, 538 bp, Panicum virgatum
  misc_feature: Ceres CLONE 1961584-R
  misc_feature: Encodes the peptide sequence at SEQ ID NO. 35452
ctgcaagaaaacaagctatttggattagtaccaggaaatctggggacaatcaagacattgcgtgaactatttttgtacaacaattctttatctggaccagttccagataacttactgaacaagcaaggactgacttacagatttctccctagtaatctcttcgccccaaaaccaccgcactgacagcaggatattttgtgcaaacaaccactatatatgtacacaacatgattcagagctagcaggacaatcgttgattctttaagggtggctatagcaagattttgtaaccattcttctgtacataaagcaagttagcattcatgtgatctggaccaagaccaaccaatgcaaagatgttggccacagctggtcaagatacatatactggtttcgatcatgtagtttatactgaatgtatgcattacaaaatgttgggatagagtaggatagtggaacagtgtttacattggttggtcaacttgagattctgtacgttacaaacttggaatggtgcttacagcagctttgcgtttgc

SEQ ID NO: 35452 - protein, 60 aa, Panicum virgatum
  misc_feature: Ceres CLONE 1961584-R
  misc_feature: SWISSPROT Homolog: EC 2.7.11.1 Non-specific serine/threonine protein kinase
LQENKLFGLVPGNLGTIKTLRELFLYNNSLSGPVPDNLLNKQGLTYRFLPSNLFAPKPPH

SEQ ID NO: 35453 - DNA, 1397 bp, Panicum virgatum
  misc_feature: Ceres CLONE 1961601
  misc_feature: Encodes the peptide sequence at SEQ ID NO. 35454
ctgagaaaaactgaggtgagggtgcctacagccctactctgcctttctagtcaagtcatattattgtttgagcttagccaagtcttctgggtccatttaatcaaatggtcttgcaaaaaaaaattgcgcagccagttataccagttgcagcagccaggatcagtaatggcattcaacgatgatgacaagcctcctacttccaacaccgggagcaccaagggtctggtgaacatcaagccggtgaagtacttcaaggacgatgcggcgctgacggcggacactgtgacggcggaggtggagatcaacgcgacatcctccaccgtcgtgagggaggggctggacctggtggccgtgctcgacgtcagcggcagcatgcgcggggacaagatcgcgagcctgaagaaagccatgacgttcgtgatcatgaagctcaccccggtggaccgcctctccatcgtcaccttctccaacgacgccgccaggaagaccccgctgcgctccatgagcccggccgcccagaccgagctcaaggctctcgtcgacggcctggaggccggcggctggaccaacatccaggccggccttgagaccgggctggccgtgatcgccggccgcgtcaacaccaaggcccgcaccgccaacatcttcctcatgtcggacggggagcagaagcccggcgacgccaggcaggtcgaccccggccaggtggccatctacacgtttggcttcggcaaggacacgaaccacctgctgatgagcgacattgccaagagatcgccgggcgggaccttcagctccgtgccggacgggtccacggtgactctgcccttctcgcagctgctggctggtctcctcaccgtggtggcgcaggacgtggagctcaccctgactcccaagaccgacgacggcgacgtggacacaatagtggtggctcccggcaccgactacaagacgaccaccgacgccgccaccggcgtggtcaccatcgcgttcggcaccctcttcgccggagaagggcgcagggtcgtcatcaccctcacgctcaaggacgtgagcgccaccaacaatgaggagtacgacgcgcccttagccgaggcccagcacagctacaccgcccagggaagaccaagggaccctcagcttccacaggacatccagatcaggcgcaccccgactccatcccaagcccctggcgcgagcagcaaggcgcggcaggtgcaggccgagatcgccaggaggaaccacgccgaggccatcaggcaggcgaggctgctggcggacaaaggcgaccccgaaagcctggacgaggcgcggtacaagctggtggacgcgcagaacgcattggaggacatcgtgctggacagcctggccgacggccggatgctggtgaactcgct

SEQ ID NO: 35454 - protein, 410 aa, Panicum virgatum
  misc_feature: Ceres CLONE 1961601
  misc_feature (59)..(225): Pfam Name: VWA Pfam Description: von Willebrand factor type A domain
MAFNDDDKPPTSNTGSTKGLVNIKPVKYFKDDAALTADTVTAEVEINATSSTVVREGLDLVAVLDVSGSMRGDKIASLKKAMTFVIMKLTPVDRLSIVTFSNDAARKTPLRSMSPAAQTELKALVDGLEAGGWTNIQAGLETGLAVIAGRVNTKARTANIFLMSDGEQKPGDARQVDPGQVAIYTFGFGKDTNHLLMSDIAKRSPGGTFSSVPDGSTVTLPFSQLLAGLLTVVAQDVELTLTPKTDDGDVDTIVVAPGTDYKTTTDAATGVVTIAFGTLFAGEGRRVVITLTLKDVSATNNEEYDAPLAEAQHSYTAQGRPRDPQLPQDIQIRRTPTPSQAPGASSKARQVQAEIARRNHAEAIRQARLLADKGDPESLDEARYKLVDAQNALEDIVLDSLADGRMLVNS

SEQ ID NO: 35455 - DNA, 1102 bp, Panicum virgatum
  misc_feature: Ceres CLONE 1961613
  misc_feature: Encodes the peptide sequence at SEQ ID NO. 35456
ctctctctctctctctgcccccccaccatatagcaggcagccgcagaggacacgaactagatcgtcgtacctcctgcttgattggatccagcattttggtagtcgcgtgcttggttctcctttgagcctgtggcgtggctacgcggcccctctgtctgcctatcagccagcttccatggattccaccctcttcatcatcggaatcataggcaacatcatctcagttctagtcttcatatctcctatcaagaccttctggaggatcgtgaggagcgggtcgacggaggacttcgagccggcgccgtacgtgttcacgctgctcaacgcgctgctgtggctctactacggcctcaccaagcccgacggcctcctcgtcgccaccgtcaacggctttggggccgtcatggaggccatctacgtcgtcctcttcgtcgtctacgccgccgatcacgccacaaggattaaggctgcaaagctggcgacagcattggacattggtggctttggagttgtgtttgcagccaccacattcgccatccgtgaattggacttgagaatcatggtgatcggaatgatatgtgcctgcctcaatgtgctcatgtacggctctccccttgctgccatgaaaacggtgatcaccaccaagagcgtggagttcatgcccttcttcctctcattcttcctcttcctcaacggaggcatctgggcaacgtacgccgtgcttgaccgagacatctttctcgggatccccaatgggataggcttcgtccttggcagcatccagctgatcatctacgcgatctacatgaacagcaaggcctcccagagcagcaaagaaacagcggaagatgcggctcctcttctagcctcaaacgcttgatacaggcaggagaagcatctagccatgtttgatgcgcggcgtgctggagtagaagctggtcttaaaaactgtcaaacttcacaagtgtgcctaccactatcctagtgattagtgattattcattgttcaataagcgtgtaaagtttctttggtgaatgctatttttctttgtaagctgaggaatgttgagtactctatcctacttgtgatgagtgaattgtc

SEQ ID NO: 35456 - protein, 234 aa, Panicum virgatum
  misc_feature: Ceres CLONE 1961613
  misc_feature (6)..(93): Pfam Name: MtN3_slv Pfam Description: MtN3/saliva family
  misc_feature (129)..(215): Pfam Name: MtN3_slv Pfam Description: MtN3/saliva family
MDSTLFIIGIIGNIISVLVFISPIKTFWRIVRSGSTEDFEPAPYVFTLLNALLWLYYGLTKPDGLLVATVNGFGAVMEAIYVVLFVVYAADHATRIKAAKLATALDIGGFGVVFAATTFAIRELDLRIMVIGMICACLNVLMYGSPLAAMKTVITTKSVEFMPFFLSFFLFLNGGIWATYAVLDRDIFLGIPNGIGFVLGSIQLIIYAIYMNSKASQSSKETAEDAAPLLASNA

SEQ ID NO: 35457 - DNA, 620 bp, Panicum virgatum
  misc_feature: Ceres CLONE 1961617
  misc_feature: Encodes the peptide sequence at SEQ ID NO. 35458
tgccaaacgacacaaagcgaaggcggcggcgtgcggcctcgacatcccgcgccgcgttccacctccatcgacggcggcctagttccggcaagctcccgagctccacatcctcaagcccactaccctcgagcagtcccgcggataaggacctcagggtcgccgcctccggcggcgggttcttttcttgcttccggtggtgggagcacgcgtgggcgatggcgggggaccgcgggctcctgctcctcttcctcctctcggccgccgccctggccggggtcgcctctgccgccgctcctttcttgtccgacggcgtgttccaggtgaccgctggatccacggggaggagcttgttgcaggccaagaaggattgccctgtgagctttgagttccaaaactacacaatcatcacaagcaagtgcaaagggccgaaatttcctgctagccaatgctgcgctgctctcaaggaatttgcctgcccattctatatgtacctcaatgatgacagcaacagctgtgcgtcgaccatgttcacctacatcaacctcaacggtaagtacccaccaggtctgttctccagcgagtgcaaggaaggcaagttggggctttcttgcgaaaatgcc

SEQ ID NO: 35458 - protein, 134 aa, Panicum virgatum
  misc_feature: Ceres CLONE 1961617
  misc_feature: Functional homolog of the protein sequence given in SEQ ID NO 50713
  misc_feature: Useful for making plants with altered carbohydrate content
  misc_feature: Functional homolog of the protein sequence given in SEQ ID NO 50714
  misc_feature: Useful for making plants with altered cell wall content and/or composition
MAGDRGLLLLFLLSAAALAGVASAAAPFLSDGVFQVTAGSTGRSLLQAKKDCPVSFEFQNYTIITSKCKGPKFPASQCCAALKEFACPFYMYLNDDSNSCASTMFTYINLNGKYPPGLFSSECKEGKLGLSCEN

SEQ ID NO: 35459 - DNA, 683 bp, Panicum virgatum
  misc_feature: Ceres CLONE 1961618
  misc_feature: Encodes the peptide sequence at SEQ ID NO. 35460
atctgctccgcccatcgtctccctcggctttcttaagccctccgctccccttctctctcccacaggagtcccaatcaacaaggtcggccatggcgcaggatgattcggttgtttctgctcagtggctgcaccagcacctaggagcgcctgacgttaaggttttggatgcttcctggtacatgccggtagagaacagggatccatgggaagaataccaggtggcacatatccctggtgcgttgttcttcgacatagatggcatagtcgatcagacaactgacttaccacacatgttgccatcagaagaggcttttgcagcagcagtttctgcgctggatataaaaaaccaggataaagttattgtttatgatggaaaaggattcttcagtgcacctcgtgtttggtggatgtttagagtttttgggcacaataaagtttgggtgttagatggaggtttacctcagtggcgagcttcggggtttgatcttggaagtgccaaccctgatgatgcagttgttaaatccaaaactgccaataaggctgttgaaagggtttataatggtgaactgacaaatacaatcacattcaagactgaatttcagcctcatctatattggacactggaaaaggtcgcgcataatgttgctgctaagaattaccaacaagtagatgccagatcaaag

SEQ ID NO: 35460 - protein, 197 aa, Panicum virgatum
  misc_feature: Ceres CLONE 1961618
  misc_feature (9)..(129): Pfam Name: Rhodanese Pfam Description: Rhodanese-like domain
  misc_feature: SWISSPROT Homolog: EC 2.8.1.2 3-mercaptopyruvate sulfurtransferase
MAQDDSVVSAQWLHQHLGAPDVKVLDASWYMPVENRDPWEEYQVAHIPGALFFDIDGIVDQTTDLPHMLPSEEAFAAAVSALDIKNQDKVIVYDGKGFFSAPRVWWMFRVFGHNKVWVLDGGLPQWRASGFDLGSANPDDAVVKSKTANKAVERVYNGELTNTITFKTEFQPHLYWTLEKVAHNVAAKNYQQVDARS

SEQ ID NO: 35461 - DNA, 721 bp, Panicum virgatum
  misc_feature: Ceres CLONE 1961619
  misc_feature: Encodes the peptide sequence at SEQ ID NO. 35462
ctcctcgcaggtcgcaagaaagcatggcgccggtcaaggtattcgggtccgcagtgttcgcgaacgccgcgcgggtgatggcgtgcctggaggaggtgggcgtcgagtacgacgtcatcgaggtcgactacatggccaaggagcacaaggacctcgagcatctggcgagaaacgtatgcaacaacacccttgatcctattgctttcattgttcactgcatctctgcatatggatgcttcatcatccctttacctggtttccactcgtactggtagacaaactgatcgatgtgccctgtacatccacgctgatgtttgcttgcagccgttcggccaaatcccagcgtttcaggatggggacatcatgctcttcggtattcttacagccttataacaactactgtccttccacagaaatagttgctctcgaatccccgtctacaagagtattaattccttcggtctcaaaagtcaaaacgactaataatttaatacggaggaagtactatgttattatttgtaattctcaacgaatttcttccagagtcccgagcaatctcaaagtatgtgctccgaaaatatgccaagtcagcccaagatgacctgctgcgagagggcaacccggaggaagctgcgatggtggatgtgtggacagaagtggaggcacaccactacctaccggccatggcacccatcttctacgagtgcgtcgtgtacccccg

SEQ ID NO: 35462 - protein, 83 aa, Panicum virgatum
  misc_feature: Ceres CLONE 1961619
  misc_feature: SWISSPROT Homolog: EC 2.5.1.18 Glutathione transferase
MAPVKVFGSAVFANAARVMACLEEVGVEYDVIEVDYMAKEHKDLEHLARNVCNNTLDPIAFIVHCISAYGCFIIPLPGFHSYW

SEQ ID NO: 35463 - DNA, 1522 bp, Panicum virgatum
  misc_feature: Ceres CLONE 1961628
  misc_feature: Encodes the peptide sequence at SEQ ID NO. 35464
acccatccgcctcctccccctcctccctccgccttaaccctccctcctctccaccaccgccgcttcatcccctcccccccgaggcggccgacgctcccatgcccgccggcgcccggcccgacaagcccgagccggaccgcgcggcctagcggtgctgttttttcttctttttctggctagccagcccggagcagttcctgtgccccatctcctcggagatcatgagggatcccgtcgtcctcgcctccggccagacatatgaccgtcgcttcattcaagaatggttaagtgctggaaaccgaacatgtccacagacccagcaagtcctttcaaatacaattctcatcccaaaccatcttgtgagaagcatgatctcacagtggtgcacggataatgggatcactctgccaccagttgagaaccaagaagaagatctggtcacaaataatgagcggaagacatttagtaaaatatttgagaggattgcatcatcgtcaaacctatctgagcagagggaagctattaaagatctcaggctgctgactaagtgcaacagttcactgagagcagccattggagagaaaccagattcaatctcacagatgatttccactgtatctaacccagagctagagaacaatgccgaggttctggaagatatggtgacaactattcttaatctttcaattcatgagagcaacaagaagatcattggagatgacccattagcaatccccttcctcataaggaccttacagtcaggaaccatggaggcccgcagcaatgctgcagctgccatcttcagtttgtctgctcttaacagcaacaaggcaaagattggtgaactaggcgcgatgagacatctggtggatctcctcgaacacggcagcatgatagcgaagaaagatgcagcatcagctatcttcaacctctgcatgctgcacgagaacaaatcaagggccaccaagagcggggtcatcgacgtgaccctgaaggccattgctgacgactcgcttgtggacgagtccctggccatccttgccctgctgtcaggtgaccacgagacggtggaggagattggcgagaccggcggtgtggcctccatgctccgcgttataaaggaggaccagtgcaagcgcaacaaggagaatgcggtggcggtgctgtttgcggtctgcatgtacgaccgcaccaagctgcgggagatcgcggaggatgagaacctgaacggctccctcgcttggcttgcgcagaatggcacctcgagggcgcggaggaaggccgcagggatcctcgacaagatgacgagggccgtgcaccacacccactactcttgctagtgccctgcccgccatggttgtgtagttatgggaataaggggctgctggttgcttcgctgtatatataaattcggctgcatatatagctacacttggtctttgggttggtacatatgaggttacagtttcggtcttgtagagtaaaatggtggttttcctctgaaagcgttcatgttcttctc

SEQ ID NO: 35464 - protein, 372 aa, Panicum virgatum
  misc_feature: Ceres CLONE 1961628
  misc_feature (199)..(239): Pfam Name: Arm Pfam Description: Armadillo/beta-catenin-like repeat
  misc_feature (1)..(61): Pfam Name: U-box Pfam Description: U-box domain
MRDPVVLASGQTYDRRFIQEWLSAGNRTCPQTQQVLSNTILIPNHLVRSMISQWCTDNGITLPPVENQEEDLVTNNERKTFSKIFERIASSSNLSEQREAIKDLRLLTKCNSSLRAAIGEKPDSISQMISTVSNPELENNAEVLEDMVTTILNLSIHESNKKIIGDDPLAIPFLIRTLQSGTMEARSNAAAAIFSLSALNSNKAKIGELGAMRHLVDLLEHGSMIAKKDAASAIFNLCMLHENKSRATKSGVIDVTLKAIADDSLVDESLAILALLSGDHETVEEIGETGGVASMLRVIKEDQCKRNKENAVAVLFAVCMYDRTKLREIAEDENLNGSLAWLAQNGTSRARRKAAGILDKMTRAVHHTHYSC

SEQ ID NO: 35465 - DNA, 1257 bp, Panicum virgatum
  misc_feature: Ceres CLONE 1961637
  misc_feature: Encodes the peptide sequence at SEQ ID NO. 35466
aaccactaccaggaccgccgccgccgagcccagcacccgctacgatttcccaatcccggtgcccggccgccggctcgccgatccctcccctagacgcgtcctcaatcccagcgtcccaccttcctcatcccggcgcatctcagcctcccgtcggcgaccctcgggacatcccgacgtagcgctgcgcggtcggctcccatcccgccctagcgattcattccgctcgccgtgtcatcgcccgttccgagttccgccgccgccgcccgttgcgagctcctccgccgtcgtcgcggtcgaccgccggccggagtcctacgacctgatccacctaacgcgtgagaactcatacatcagttcgccatcattcgtgactccgttccaagctccgcgaggtcgctccgctcccgtcgtcgtcgcccccaggtcttcttggctgtgaatctagaagcccaatttttggacgatgcagcagcagttgcatatgtgccgctcgccgccggcggatggggccacgtgcagaggcaatgggatgggaagcgacatcaccgtctagggagcctgtacttgctgctgagtgcatgatcccttcaattcaaccatccctgtcccagcggcctagccgaatttgtgttccctgctctttgtcccctgttcttcttcactggatacaggtccaaattgacgtggaaagctttgtgaattatttccgacctgacataatggaagcggtgtattcatgggccaaagggtcgatctatcaaatcatggagatgactcaagtgtttgaaggcagcttcaacagggccatcaggaggctggaagaggctctgcagcagctaatttttgcatccaggtcgattggggaaaccgaactggaagcaaaacttgaggaggcagtcagcaagatcaagagggatagatatagtattcgctgcatctttgtacttgtaacatatcttgatggcgtcatgatttcgtaaaagtgcatagagaaattaaatctctcttagctattttatttcaagtgttgttggcctgacagaactgtctactggtaacatgtagcagtgatatggcaggcaaagttttgttagtgctgttaacctcgtagggcatgtttggaatgcaagatctaagaattttgcaggattgtaagaattttgcaggaacctttacagttctaccagaaactttggagaaccacaggaattgatgtcgcttgtacgcactaaaatccattttttattttttttgttc

SEQ ID NO: 35466 - protein, 158 aa, Panicum virgatum
  misc_feature: Ceres CLONE 1961637
  misc_feature (6)..(142): Pfam Name: DSHCT Pfam Description: DSHCT (NUC185) domain
MGPRAEAMGWEATSPSREPVLAAECMIPSIQPSLSQRPSRICVPCSLSPVLLHWIQVQIDVESFVNYFRPDIMEAVYSWAKGSIYQIMEMTQVFEGSFNRAIRRLEEALQQLIFASRSIGETELEAKLEEAVSKIKRDRYSIRCIFVLVTYLDGVMIS

SEQ ID NO: 35467 - DNA, 659 bp, Panicum virgatum
  misc_feature: Ceres CLONE 1961646
  misc_feature: Encodes the peptide sequence at SEQ ID NO. 35468
aacactgccacagcagccgtgtccacctcacgtatgatctgtagccactcatagtcatagatagacgctagctgcttagcctgttctgccgtagctgtctcgtgtcctttactctgcctgcctgcctgtctgattgcccctcgcgcctctgagcggccgccatggatatctggaagtccaaggtgctgcccaagatcaagctcgtcttcgccaagtccgccggcaagaaggccgccgccgccgccgagctcgtcaagtccttcgacgagtccaaggaggggatcaatggcgagttcgaggagaagaaggcggatctccagcctaaggtcgtcgagatctacgagtctgttcctgccccgctcaaggttctgatcaaggagaggagcaaggtgtccgggatcaagaagaactcggccgccatcaccaagttcttcgaggatctggccaagatcggtgagtatagtagcctagtaggccagccagccacacagctatacacgacaacttctcacatcaacgaactgttaggtgcatgatacacctgcaatgtactgaattactcccttcttccccgtttataaggcatacacgtatttcaagattcaaaccttctcatctttgaccaataatttgactattaaatttttatttttataatg

SEQ ID NO: 35468 - protein, 124 aa, Panicum virgatum
  misc_feature: Ceres CLONE 1961646
  misc_feature (1)..(124): Pfam Name: DREPP Pfam Description: DREPP plasma membrane polypeptide
MDIWKSKVLPKIKLVFAKSAGKKAAAAAELVKSFDESKEGINGEFEEKKADLQPKVVEIYESVPAPLKVLIKERSKVSGIKKNSAAITKFFEDLAKIGEYSSLVGQPATQLYTTTSHINELLGA

SEQ ID NO: 35469 - DNA, 1352 bp, Panicum virgatum
  misc_feature: Ceres CLONE 1961693
  misc_feature: Encodes the peptide sequence at SEQ ID NO. 35470
agttctcacttctcagcaccgtgaggtcgacctccccgttccctcctccacttccaaatctcacctccatccagctcatagtcgctcgcgttgactcgcctctacctccaatcagcggctgcttggatcggcttagggacgccggcgggccgtgtcggcgccgaatctcgcgcccatttcgcgttcctgttggttgccggagtggtttggatccgaggactggtctcgaattcttggatctcctccccctcgatggcggggctcgtggagctgttcctgggctccacggcggcgccggtggactgggaggcggaggcctacccgacctatggggacttcgccgtgctccccttgctcgtcgccttcttccccgccgtccggttcctcctcgaccgactcgtcttcgagatattagcacgaagacttatatttggaaagggatatgacaagctttctgaaacagatgatagtcgaaagaaaatcaataaatttaaggaatcagcgtggaagtttatttattttctttctggagaggtgctttcgttatctgtaacatacaatgagccatggtttaagaacaccagatacttttgggtagggcctggtgatcagatctggcctgatcaaaagatgaaattgaagctcaaagctgtctacatgtatgctgctggattttacacatattcaatctttgctcttctgttctgggaaacaagacgttcagattttggagtttcaatgtctcaccatgtagcaactgttgttctgattgttctatcctatattttcagatttgctcgtgtcggctctgttgttttagcccttcatgatgcaagcgatatattcctggagattgggaagatggccaagtacagtagctgcgagtggctagctgttgtggcatttcttctttttgttgcatcgtggatacttcttcgcctcattattttccctttttggattctaagaagcacaagctatgaagtcctgctgaccctggacaagaataagcatcgattttacggccccatatactactatgttttcaattgtcttctgttctcactcctagttcttcacatatattggtggatactaatatggcggatgctagttaaacaaattcaatcaaaaggacgcgttggtgatgatgttcgatccgattctgaaggcgaagatgagcatgaagattaactttttaggttgaatgcttaactgaagaactatgtctggtgttccctgctgcatggcacaccatctgaaagccgtttttccccccttttacagaagacatgcagatattagatctcattagacaatcattctttcagcatcaaaagatggaaaccttt

SEQ ID NO: 35470 - protein, 313 aa, Panicum virgatum
  misc_feature: Ceres CLONE 1961693
  misc_feature (98)..(310): Pfam Name: LAG1 Pfam Description: Longevity-assurance protein (LAG1)
  misc_feature: SWISSPROT Homolog: EC 2.3.1.24 Sphingosine N-acyltransferase
MAGLVELFLGSTAAPVDWEAEAYPTYGDFAVLPLLVAFFPAVRFLLDRLVFEILARRLIFGKGYDKLSETDDSRKKINKFKESAWKFIYFLSGEVLSLSVTYNEPWFKNTRYFWVGPGDQIWPDQKMKLKLKAVYMYAAGFYTYSIFALLFWETRRSDFGVSMSHHVATVVLIVLSYIFRFARVGSVVLALHDASDIFLEIGKMAKYSSCEWLAVVAFLLFVASWILLRLIIFPFWILRSTSYEVLLTLDKNKHRFYGPIYYYVFNCLLFSLLVLHIYWWILIWRMLVKQIQSKGRVGDDVRSDSEGEDEHED

SEQ ID NO: 35471 - DNA, 486 bp, Panicum virgatum
  misc_feature: Ceres CLONE 1961703
  misc_feature: Encodes the peptide sequence at SEQ ID NO. 35472
acacacaagcctgaaacgtaaggcaaatcacctattcggctattccaccgcctccgagaaagacaactagccagctagtgtggtgccctggcgggcggcggcgccggcagcgacgacgttgttcacgtcgtcatgttcccctttctcgccttcggccacataagcccgttcgtgcagctggcgcgcaggctggcctccggcgaggccggggtccgcgtcacgttcctcacggccgccgggatcgcgccgcgcgtcgaggccatgctggagtccgccgccggcgcggtgagggtccagcccctgagcctggccccggtccccggcctgcccgcgggggccgccagcaccgcggacgtctcgggcgacggcgccgagctgctgaagctcgccctcgacggcacccggcccgaggtgagcgcgctgctcgccgagctccgcccggacgccgtgctgctcgagttcgccacctcgtgggtccgcgacgtc

SEQ ID NO: 35472 - protein, 117 aa, Panicum virgatum
  misc_feature: Ceres CLONE 1961703
  misc_feature: SWISSPROT Homolog: EC 2.4.1.115 Anthocyanidin 3-O-glucosyltransferase
MFPFLAFGHISPFVQLARRLASGEAGVRVTFLTAAGIAPRVEAMLESAAGAVRVQPLSLAPVPGLPAGAASTADVSGDGAELLKLALDGTRPEVSALLAELRPDAVLLEFATSWVRD

SEQ ID NO: 35473 - DNA, 689 bp, Panicum virgatum
  misc_feature: Ceres CLONE 1961713
  misc_feature: Encodes the peptide sequence at SEQ ID NO. 35474
gggggtcacgggctccgcggtcgcgcactcacgccacgcctgacgcgggaagccggccggaaccatccaacgcgcagcggccgccgcgtcgtcgtcgtcgccgccgccgccgccgccggcgtgacgcctcgcctacagaaacaaacacgagctgcctaattttccactcccgcggaacagcgcgacccgggaggcgaatcagatcaaccccccccccccccctccgcgcaccgaccgtccgggatcgcgaggtgggtttggaacccccgcggttgcgggccgagttaggttgtcttggtcccgtcctcgcgccggctccccttgccggccaaatccccagcggctccgctccttccccaggcagcattttgtttccttgacgtgcaagctttgttgattggagttcgcaatgggaggctgtgcggggaaggcacgtcgggaagacgatgataagcttgatttcaaaggtggaaatgtgcatatcataacaaccaaagagggctgggatcagaagattgcagaagcaaacagagatgggaaaaccgttgtggcaaatttcagcgcttcctggtgcggaccatgccgtgtcattgctcctgtctatgctgagatgtcaaagacttatcctcaactcatgttcttgacaatagatgttgatgacctgatggatttcagctcctcatgggatt

SEQ ID NO: 35474 - protein, 93 aa, Panicum virgatum
  misc_feature: Ceres CLONE 1961713
  misc_feature (22)..(91): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MGGCAGKARREDDDKLDFKGGNVHIITTKEGWDQKIAEANRDGKTVVANFSASWCGPCRVIAPVYAEMSKTYPQLMFLTIDVDDLMDFSSSWD

SEQ ID NO: 35475 - DNA, 644 bp, Panicum virgatum
  misc_feature: Ceres CLONE 1961727
  misc_feature: Encodes the peptide sequence at SEQ ID NO. 35476
atccctatcctctactccgacccctcgccccggccgcgcccgccttcgcatccggcacccccccacctcgccctctccctctcccctctgaacccacgcccgccgccgccaccaccgccgccggcgcgatggccatgcgggtggtgcggaacctggacctggagcggtacgcggggcggtggtacgagatcgcttgcttcccgtcggcattccagcccaagacgggcaccaacacgcgcgccacctacgcgctcaacccggacggcaccgtgcgggtgctcaacgagacgtggaccgacggccgccgcggccacatcgagggcacggcgtggcgcgccgacccggccggcgacgaggccaagctccgggtccgcttcttcgtcccgcccttcctccccgtcttccccgtcaccggcgactactgggtgctccacgtcgacgccgactaccagtacgcgctcgtcggccagccctccaggaagtacctctgggtgcgtgcgcgccgatccctccccaattctccacccaactgctgattccacacgcatctgtggtgtggctgacctctctgattgctcgcgcgcagatcctgtgcaggcagccgcacatggacgaggccgtgtacggcgagctggtgaggcggg

SEQ ID NO: 35476 - protein, 135 aa, Panicum virgatum
  misc_feature: Ceres CLONE 1961727
  misc_feature (9)..(133): Pfam Name: Lipocalin_2 Pfam Description: Lipocalin-like domain
MAMRVVRNLDLERYAGRWYEIACFPSAFQPKTGTNTRATYALNPDGTVRVLNETWTDGRRGHIEGTAWRADPAGDEAKLRVRFFVPPFLPVFPVTGDYWVLHVDADYQYALVGQPSRKYLWVRARRSLPNSPPNC

SEQ ID NO: 35477 - DNA, 645 bp, Panicum virgatum
  misc_feature: Ceres CLONE 1961738
  misc_feature: Encodes the peptide sequence at SEQ ID NO. 35478
caccaatggatgccaagatatcgacgagtgccagcatccagatctttacccatgccatggaacctgtatcaatttgccagggacataccggtgctcatcaaagaaaaacatcagcagccttccaggtttaattacaataatagcgataagtgctggttttggcctactgttttctgttctgggtgttgccaaaatcgccaataagttcaagcaacgaagggtcaaaaagttgagacaaaagtttttcaagaaaaaccatggattgcttctccaacaattaatatcgtcaaataaagatatagctgaaaggacaaagattttcagcttggaggaactagatcaagcaaccaacaaatttgatcataatcgtatcattggtggtggaggccatggcacagtctacaaaggcatattatctgatcaacatgtcgtggccatcaagaagtctaaaactgtggttcaaagtgaaattaatcagttcattaatgaggttgttatactttcacagactaatcatagaaatgtggtgaagctcttcggttgttgcctcgagacagaagttcctttactggtatatgagtttatatcaaatggaactttgtcatatcatcttcatggacaaagtgaaaattccttgtcatggaa

SEQ ID NO: 35478 - protein, 214 aa, Panicum virgatum
  misc_feature: Ceres CLONE 1961738
  misc_feature: SWISSPROT Homolog: EC 2.7.11.1 Non-specific serine/threonine protein kinase
TNGCQDIDECQHPDLYPCHGTCINLPGTYRCSSKKNISSLPGLITIIAISAGFGLLFSVLGVAKIANKFKQRRVKKLRQKFFKKNHGLLLQQLISSNKDIAERTKIFSLEELDQATNKFDHNRIIGGGGHGTVYKGILSDQHVVAIKKSKTVVQSEINQFINEVVILSQTNHRNVVKLFGCCLETEVPLLVYEFISNGTLSYHLHGQSENSLSW

SEQ ID NO: 35479 - DNA, 1217 bp, Panicum virgatum
  misc_feature: Ceres CLONE 1961749
  misc_feature: Encodes the peptide sequence at SEQ ID NO. 35480
ccgcgaccgcgagcgcctccgcgtttcgaacggaaagggaaaagggagggatcgagagaaataaaaaaaaaaatccaccggcttctcgtggtctccttccaaaccctagcgccgcgccgcccccgcccccacctcgccgtcgccgccgcgcgctcatggcgaagtcgcggccgcccaagcggatcctcgagtcctacaccatcaagggatccgacaaagtcatcaagcctggtgattgtgtgctaatgagagcatttgatgcatcaaagccaccctatgtggcaagagttgaggcaattgaggcagcaggatctcgaggcacaaatgtgagagtacgggtgcgatggtattataggcctgaggagtccattggtgggaggcggccttttcacggttccaaggaggtcttcctctcggaccactatgatgtacaaagcgctgacacgattgaggggaagtgcaatgtgcacagcttccggacttatacaaagcttgattctgtcaatgctgaggacttcttctgccgctttgagtataaatcagcgacaggcagcttcgtgcccgaccggattgctgtgttttgcaagtgtgagatgccatacaaccctgatgatcttatgatccaatgcgaagaatgttctgattggtttcaccctgcttgcattgggatgactatcaaagaagcaaagaaattggaacattttttctgccatacttgtactaccgaaaatgggaagatggcagagaattctcatgaagctacagcgcaatcagaagaaaagccagtggagtcaaaaagacggagaagatgatggccctgctgattaatctatgaaaattctgtgcggttgtacaaaagccatctgaggtctgtaatgctatttgttgtcgcagtttgtggctctggggtccccctaatgtcaggcacacgctgtacatagttgcgtgcaacctgatcagattgttgtattagagagcatactaggatttgcatggtagtgtcagactatcagagtatgtgtagggtatggcagcccaatgccagcatcaggtgatcaagcttctctgggcattttagcactcctggatcatccagcaataatattgccacgcagctgggcctggccagtcatcgtgttcattcttgggaaaactttgtaccgtcatgtgaactttgaaattgtccatgtaatgcaagcatctcggtgtggtacctg

SEQ ID NO: 35480 - protein, 218 aa, Panicum virgatum
  misc_feature: Ceres CLONE 1961749
  misc_feature (21)..(138): Pfam Name: BAH Pfam Description: BAH domain
  misc_feature (142)..(191): Pfam Name: PHD Pfam Description: PHD-finger
MAKSRPPKRILESYTIKGSDKVIKPGDCVLMRAFDASKPPYVARVEAIEAAGSRGTNVRVRVRWYYRPEESIGGRRPFHGSKEVFLSDHYDVQSADTIEGKCNVHSFRTYTKLDSVNAEDFFCRFEYKSATGSFVPDRIAVFCKCEMPYNPDDLMIQCEECSDWFHPACIGMTIKEAKKLEHFFCHTCTTENGKMAENSHEATAQSEEKPVESKRRRR

SEQ ID NO: 35481 - DNA, 1253 bp, Panicum virgatum
  misc_feature: Ceres CLONE 1961771
  misc_feature: Encodes the peptide sequence at SEQ ID NO. 35482
aaatatttgctcagtttagtttcgcatcttagtgttcctcttattttggttctaagttgtattcaccaaattttctctggatttttttttctatctcctaaatttttatcatcattttagtgtatgtgtgtatctagataaatttacctgttcttagttgtacagtaaaagtaaaattaaaatttattaaaaatggaagccattaaaaagaagatgcaggccatgagagcagaaaaagaatctgctgtcgaaagggccgaaagtgctgaaacatctgccaaagaagcaaaccaaaaggcggaaaagtctgaagaggaagtcagatctctacaaaagaaaatccaacaagttgaaaacgaattagatcaagtacaagagaatttaacaggagcctgtactaaattagaggaaaaagacaaagcattgcaattggctgaaggtgaagtcgccggtctaaaccgtagaatccagttgatcgaggaagacttagaaagatcagaagagcgtttaaagatcgctacacaaaaattagaagatgctagccaaactgcagatgagagtgaacgtatgcgtaaattactcgagcatcgttcaatcaccgatgaagagagaatggattcattggagaaccagcttaaagaagctagaatgatggcagaagatgcagacagaaaatacgatgaagttgccagaaagttagccatggtagaagctgatttagaaagagcagaacaaagagccgaagaaggcgaatctaaaatcgtagaattagaggaagaattacgtgttgttggtaataatttaaaatccctcgaagtttcggaagaaaaggctcaacaaagagaggaaacctatgaaactcaaatcagacagatgacaaataagcttaaggaggctgaagcaagagcagagtttgcggaaagatcagtacagaaattgcagaaggaagttgatagattggaagacgaattggtacacgagaaagagaagtacaagcacatttcggacgacttggacaatacgtttaccgaactctgtattgtttagaatgttcgaatgcaaccacgaaaatcgaacttaccagctattaacttcgaacttaccaacaatcttacaacctctcttaaatgtatcaatcgcattctaaattttttcttaccacacactatcataacatgcttatttgattctttaattcgttttagactttcttttattttcttttatctttttgctcatgaaatcggctagac

SEQ ID NO: 35482 - protein, 284 aa, Panicum virgatum
  misc_feature: Ceres CLONE 1961771
  misc_feature: SWISSPROT Homolog: EC 2.7.11.1 Non-specific serine/threonine protein kinase
MEAIKKKMQAMRAEKESAVERAESAETSAKEANQKAEKSEEEVRSLQKKIQQVENELDQVQENLTGACTKLEEKDKALQLAEGEVAGLNRRIQLIEEDLERSEERLKIATQKLEDASQTADESERMRKLLEHRSITDEERMDSLENQLKEARMMAEDADRKYDEVARKLAMVEADLERAEQRAEEGESKIVELEEELRVVGNNLKSLEVSEEKAQQREETYETQIRQMTNKLKEAEARAEFAERSVQKLQKEVDRLEDELVHEKEKYKHISDDLDNTFTELCIV

SEQ ID NO: 35483 - DNA, 1178 bp, Panicum virgatum
  misc_feature: Ceres CLONE 1961805
  misc_feature: Encodes the peptide sequence at SEQ ID NO. 35484
attgcgttccttctctgcatctgatccgttcagttctgtgttctgtagacgccattcttggcctcccgtctcgctctgcaaagtaattgagtaccattgagccatggctgccaagctgactcgcctccacagtcttcgcgaacgacttggtgccaccttctcctctcatcccaatgagctgattgcactcttttccaggtatgttaaccagggcaagggaatgcttcagcgccatcaactgcttgctgagtttgatgcgctgtttgatagtgacaaggagaagtatgcaccctttgaagactttcttcgtgctgctcaggaagcgattgtgcttcccccctgggttgcacttgctatcaggccaaggcctggtgtctgggactacattcgggtgaatgtaagtgagttggctgtggaagagctgagtgtttctgaatacttggcattcaaggaacagctggtggatggacacaacaacagcaactttgtgcttgagcttgactttgagcccttcaatgcctcattccctcgtccttccatgtcaaagtccattggaaatggagtacagttccttaacaggcacctgtcttccaagttgtttcaggacaaggagagcttgtaccccctgctgaactttctcaaagcccataactacaagggcacgacaatgatgttaaatgacagaattcagaatcttcgcgggctccagtcatccctcagaaaggcagaggagtacctactgagcatccctcaagatactccatactcagagttcaaccacaggttccaagagctcggcttggagaaaggttggggtgacaccgcaaagcgtgtacttgacacactccacttgcttcttgaccttcttgaggctcctgatcctgccaacttggagaagttccttggaactatgcctatgatgtttaatgttgttatcctgtctccacatggctactttgcccaatccaatgtacttggataccctgatacgggtggtcaggttgtgtacattttggaccaagtccgtgctttggagaatgagatgcttctcaggattaagcagcaaggccttgatatcacccctaagatcctcattgttaccaggttgttgcctgatgctgttggtactacttgtggccagcggcttagagaagggcattggaactgagctaccctgt

SEQ ID NO: 35484 - protein, 354 aa, Panicum virgatum
  misc_feature: Ceres CLONE 1961805
  misc_feature (6)..(354): Pfam Name: Sucrose_synth Pfam Description: Sucrose synthase
  misc_feature: SWISSPROT Homolog: EC 2.4.1.13 Sucrose synthase
  misc_feature: Functional homolog of the protein sequence given in SEQ ID NO 51467
  misc_feature: Useful for making plants with altered carbohydrate content
  misc_feature: Functional homolog of the protein sequence given in SEQ ID NO 50270
  misc_feature: Useful for making plants with altered cell wall content and/or composition
  misc_feature: The sequence is a functional homolog of SEQ ID NO 12 in US patent 7091398
  misc_feature: The sequence is a functional homolog of SEQ ID NO 2 in US patent 7091398
MAAKLTRLHSLRERLGATFSSHPNELIALFSRYVNQGKGMLQRHQLLAEFDALFDSDKEKYAPFEDFLRAAQEAIVLPPWVALAIRPRPGVWDYIRVNVSELAVEELSVSEYLAFKEQLVDGHNNSNFVLELDFEPFNASFPRPSMSKSIGNGVQFLNRHLSSKLFQDKESLYPLLNFLKAHNYKGTTMMLNDRIQNLRGLQSSLRKAEEYLLSIPQDTPYSEFNHRFQELGLEKGWGDTAKRVLDTLHLLLDLLEAPDPANLEKFLGTMPMMFNVVILSPHGYFAQSNVLGYPDTGGQVVYILDQVRALENEMLLRIKQQGLDITPKILIVTRLLPDAVGTTCGQRLREGHWN

SEQ ID NO: 35485 - DNA, 759 bp, Panicum virgatum
  misc_feature: Ceres CLONE 1961814
  misc_feature: Encodes the peptide sequence at SEQ ID NO. 35486
gacacagagcgtaaacccaaggcggccgccgacgatggaggcgctcctccggtgggcggccgagcttggcgtttccgactcgccgcctccgccgttcccatcctctgcctccgcagacgcttcctcctcttcgccgtcctcctgcatcggccgctccctcgtcgtcgccgacttccccaacgccggcgggaggggcctcgcggcggcgcgcgacctgcggcgcggtgagctggtgctgcgcgtgccccgcgccgcgctgctcacaagcgaccgcgtcatggccgacgacccccgggtcgccgccttcgtcagcgccctccggcaccacctctccgccgtgcagatattgatcgtgtgcttattggctgaagtggagaaagggaggaattctgtctggtatacctatctgtctcagctgcccagctactacactgtcttggctaccttcaatgattttgaagttgaagctctccaagttgatgatgccatttgggttgcacaaaaggctaccagtgccataaaatcagactgggaagatgcaacaccactgatgaaagaattggattttaaacctaagcttttgatgtttaaatcctggatctgggcatttgcaacggtgtcttcacgcacattacatattgaatgggatgaagctggttgcctatgccctgtgggtgatttgttcaactatgctgctcctgatgatacttcatttgaggaagatgatatacctgaagctgagagattaacagatggtgg

SEQ ID NO: 35486 - protein, 241 aa, Panicum virgatum
  misc_feature: Ceres CLONE 1961814
  misc_feature (1)..(236): Pfam Name: SET Pfam Description: SET domain
MEALLRWAAELGVSDSPPPPFPSSASADASSSSPSSCIGRSLVVADFPNAGGRGLAAARDLRRGELVLRVPRAALLTSDRVMADDPRVAAFVSALRHHLSAVQILIVCLLAEVEKGRNSVWYTYLSQLPSYYTVLATFNDFEVEALQVDDAIWVAQKATSAIKSDWEDATPLMKELDFKPKLLMFKSWIWAFATVSSRTLHIEWDEAGCLCPVGDLFNYAAPDDTSFEEDDIPEAERLTDG

SEQ ID NO: 35487 - DNA, 1232 bp, Panicum virgatum
  misc_feature: Ceres CLONE 1961821
  misc_feature: Encodes the peptide sequence at SEQ ID NO. 35488
accattcagttccattccagccatcgcaacaaggcagctgctagctagctagtgctggttacgtcctcatctccgaagctgaggtgcaggtaaggtagtgcggcagcaagcgacgacaatggcggcggcgaccaacggcggggcgcccctggtggtgttcgacttcgacaagaccatcgtcgactgcgacagcgacaactgggtcgtcgacgcgctcggcgccaccgaacgcttcgacgaactcctccgccacctcccctggaaccacgccatcgacgcgatgatgggggagctgcacgcggcgggcaggacggcggaggacgtgcgggcctgcctccgggcggcgccgctgtccccgcacgccgccgcggccatcagggccgcgcacgcgcgcgggtgcgagctccgggtcctcagcgacgccaacgccttcttcatcgacgccgtcctcgcgcaccacggcctcgccggctacttctccggcaccgacaccaacccggccagcgtcgacaccgccggccgcctcaggatccgcccctaccacgagttcgccgcccccgccgccggccacgggtgcgcgctcccatcctgcccgcccaacatgtgcaagggcaaggtgatggagaggatactccaagaggaagaggaaacggccgccgcggcgaggcggccgaggagggccgtggtgtacctcggcgacggccggggcgactactgcccgtcgctgaagctgcgcgagggcgactacgtgatgccgcgggcagggtaccccgtgtgcgacctcatcgcggcctcgccgccggccgccgccgtgcgcgggtgggacggattcgaggacctcgccagggtgctgctcggcatcgtcgacgccgagatcgcccgcgccgcggcggagcagggcgaggcccccgccgccacgtcgaacgtcgtcgtcggcgccgtcgtgccggactgccgcacgctgccgctgccggcgcgtcaggaggcggcgctcctcccgcaggcggtccgcgtgcccaactgatcggtgggggccaaggcaggcgtgccagcaaataactctactccaccctgaaccctccattgatttacttggagatgacgcagggattctgcctgcagcatctgctgcttcacctcaaactgaaagcctttcagtgtgtaccatgatatataatactgtaccatccaaagcccaacatgagacatgttctcatgttgttcgtttctaa

SEQ ID NO: 35488 - protein, 301 aa, Panicum virgatum
  misc_feature: Ceres CLONE 1961821
  misc_feature (10)..(249): Pfam Name: Put_Phosphatase Pfam Description: Putative Phosphatase
  misc_feature: SWISSPROT Homolog: EC 3.1.3.74 Pyridoxal phosphatase
MAAATNGGAPLVVFDFDKTIVDCDSDNWVVDALGATERFDELLRHLPWNHAIDAMMGELHAAGRTAEDVRACLRAAPLSPHAAAAIRAAHARGCELRVLSDANAFFIDAVLAHHGLAGYFSGTDTNPASVDTAGRLRIRPYHEFAAPAAGHGCALPSCPPNMCKGKVMERILQEEEETAAAARRPRRAVVYLGDGRGDYCPSLKLREGDYVMPRAGYPVCDLIAASPPAAAVRGWDGFEDLARVLLGIVDAEIARAAAEQGEAPAATSNVVVGAVVPDCRTLPLPARQEAALLPQAVRVPN

SEQ ID NO: 35489 - DNA, 603 bp, Panicum virgatum
  misc_feature: Ceres CLONE 1961833
  misc_feature: Encodes the peptide sequence at SEQ ID NO. 35490
gcaacgacctctcctccgtcctcactcccactctcgacctctctacaatggcgagaaggtgcaggagcagcggcggcggcaacgtgcctggcttggccgcggcggcggcggcgtcatggctcctggtggcggtggcgctcgccggcgtcgccgacgcccagctgcaggtggggttctactccaggtcctgcccgggcgccgagtccaccgtcgcggacgtcgtccggcaggcaggctccgccgaccccaccatcctgccggcgctcctccgcctccagttccacgactgcttcgtccggggctgcgacggctccgtcctcatcaagggcggcggcggcggcagcgccgaggtggacaacagcaagcaccagggcctccgcgggctcgagatcatcgagggcgccaagacgcagctcgaggcccagtgccccggcgtcgtctcctgcgccgacatcgtcgtcctcgccgcccgcgacgccgtcgcattcgtacgcatactttatttattacatatatataaatatatatacttatatataaatatatatagatatatatattatatatatgtataaattgtatatgggtctgacaacatacatg

SEQ ID NO: 35490 - protein, 175 aa, Panicum virgatum
  misc_feature: Ceres CLONE 1961833
  misc_feature (55)..(173): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50376
  misc_feature: Useful for making plants with altered carbohydrate content
  misc_feature: Functional homolog of the protein sequence given in SEQ ID NO 50377
  misc_feature: Useful for making plants with altered cell wall content and/or composition
MARRCRSSGGGNVPGLAAAAAASWLLVAVALAGVADAQLQVGFYSRSCPGAESTVADVVRQAGSADPTILPALLRLQFHDCFVRGCDGSVLIKGGGGGSAEVDNSKHQGLRGLEIIEGAKTQLEAQCPGVVSCADIVVLAARDAVAFVRILYLLHIYKYIYLYINIYRYIYYIYV

SEQ ID NO: 35491 - DNA, 693 bp, Panicum virgatum
  misc_feature: Ceres CLONE 1961856
  misc_feature: Encodes the peptide sequence at SEQ ID NO. 35492
acctctaaatttggtgatcggcttcgcctcgaaccctcgcgcttaccaaaatccccatccgattccaccccgctaaaccccccacaccccaaaccgaggtcggaaccgctatgggttggacctctggctctggaggatccaatattcgccggatttgagatctggtgggttccgacgcgcggatccggaggagacgccaccagtttgtagggtttgttggctcctttgcgatccggaaggtcatggagtaccgggtcttcgacagcagcgcacttgattattttccttaattttagggaccgatgatgagctccctccaacatataaatttcgaggaccaggagtgcatttcaggggcaacggaagggcgttatcaggcacactttctcagccaaggccacacagcaatttggatagtgacatacatcagatggaacaacaagcatatactggtgttctcagagcattcaaaatgcaatctgatgccctaacttgggagaaagaaagtttaattactgaattaagaagagaactgaaagtctctgatgaggaacacagagcgctattaaacaaggtcaatgaagaggaagctgtccatagaataaggcagtcaaggcagggatgtggaatgcaatctagcttgcatcgtaacagtgtagttgcttacaatcttgtacctctaaagaggcagaa

SEQ ID NO: 35492 - protein, 87 aa, Panicum virgatum
  misc_feature: Ceres CLONE 1961856
  misc_feature (1)..(67): Pfam Name: ENT Pfam Description: ENT domain
MEQQAYTGVLRAFKMQSDALTWEKESLITELRRELKVSDEEHRALLNKVNEEEAVHRIRQSRQGCGMQSSLHRNSVVAYNLVPLKRQ

SEQ ID NO: 35493 - DNA, 722 bp, Panicum virgatum
  misc_feature: Ceres CLONE 1961874
  misc_feature: Encodes the peptide sequence at SEQ ID NO. 35494
gggttcgtgctcttcttcctcgtccctctccctccccaagttctcccctttggggaagttcgccttttttttcgtcctccatctctcgtgattctgccgcatttctttcacgagttagttttttggactttgggttgtcccccgcgcaggggagcagggaggaggaggatggaaggccctccagtcgcgcttttcgacagcctcaaggctgccaaaccattcttcttgctagctgggcccaatgtgattgaatcggaggagcatgtcctgaagatggccaaacacattaaaggcatcacaaccaagcttgggatcccacttgtgttcaaatctagcttcgataaagcaaatcgtacatcatcaaaatctttccgtggccctggtctggaagaaggcctgaagatccttgaaaaggtgaaagcaacatatgaccttccagttgtcactgatgtgcatgaaagccaccagtgtgaagctgttggaaaagttgctgacattatacaaattccagctttcctctgtcgccagactgatcttctcgtggctgctgctaagactggaaaaattatcaatatcaagaaaggacaattctgtgcaccctctgttatggtcaactctgcggagaaaataagacttgctggaaatcctaatgtgatggtctgtgagcgtggtaccatgttttggctacaatgatctaatttgttgacccaagggaattttga

SEQ ID NO: 35494 - protein, 174 aa, Panicum virgatum
  misc_feature: Ceres CLONE 1961874
  misc_feature (11)..(174): Pfam Name: DAHP_synth_1 Pfam Description: DAHP synthetase I family
  misc_feature: SWISSPROT Homolog: EC 2.5.1.55 3-deoxy-8-phosphooctulonate synthase
MEGPPVALFDSLKAAKPFFLLAGPNVIESEEHVLKMAKHIKGITTKLGIPLVFKSSFDKANRTSSKSFRGPGLEEGLKILEKVKATYDLPVVTDVHESHQCEAVGKVADIIQIPAFLCRQTDLLVAAAKTGKIINIKKGQFCAPSVMVNSAEKIRLAGNPNVMVCERGTMFWLQ

SEQ ID NO: 35495 - DNA, 1386 bp, Panicum virgatum
  misc_feature: Ceres CLONE 1961891
  misc_feature: Encodes the peptide sequence at SEQ ID NO. 35496
acacaattcccacgcccacaccccaccgtctccgcaggccatcccctccccttcctccctcaaacccccaccaaatgctccacccctccgctccccgtcgccggcccgcaaaaccctagcaccgcccgcgccctcgccgatgtcgccgccggcgtggctccgcggcctcccgcgcgccccggaataccgccccacggagtcggagttcgccgaccccatcgccttcctctcccgcgtggagcgcgaggcggccgcctacggcatctgcaaggtcatcccgccctaccggcgcccctcccgccgcttcgtcttcgctcacctcaaccgctacctcacctcctccttcgacgccgccaatccagccgtccccggctcctcctccagcactgctccctcgcggccggaatccgcggctgtgttcactacccgccaccaggagctcggcaccccgcggcgtgggcgcccgccgccacaggtgctgaagcaggtgtggcagagcggcgagcagtacacgctcgaacagtttgaagccaagtcccgcgccttctccaaggtccacctcgccggacttcgcgagccaactccactggaggtggaatccctcttttggaaggcgtcagcggaccgtcctatctacatcgagtatgcgaatgacgttccagggtctggctttgccgccccaccgcagtccaggcggaggaagaagcggagacgagacggtgatcaggtggaagagggggagaaaggttctgggtggcggctgtcagggagcccatggaacctccaagcaattgcacgggctcctgggtcactcacacgattcatgccggatgatgttcctggggttacctcaccaatggtgtacattgggatgctttttagttggtttgcatggcatgtcgaagatcatgagttgcacagtctcaacttcctccacactggggcacccaagacgtggtatgcagtccctggcgaccgggcctcagagctagaggaagttattcgtgtgcatggatatggaggaaaccctgaccgccttgcatcgctggcagtgctcggggagaaaacaacattgatgtccccagatgttcttgtagctcgtggtgtgccgtgctgtagattagtacagtatcctggagagtttgtcgtgaccttccccagggcctaccacattggatttagccatggatttaattgtggtgaggctgcgaactttgcaactccccaatggttaaaatttgcaaaagaggctgctgttcgaagggctgtaatgaattatctcccaatgctctctcatcaacagctcctgtacttgttagcagcatcttttataatcaaaacgccgaacgtattgtctggaattcgaacttctcggttgagagatcg

SEQ ID NO: 35496 - protein, 415 aa, Panicum virgatum
  misc_feature: Ceres CLONE 1961891
  misc_feature (240)..(359): Pfam Name: JmjC Pfam Description: JmjC domain
  misc_feature (14)..(57): Pfam Name: JmjN Pfam Description: jmjN domain
  misc_feature: Functional homolog of the protein sequence given in SEQ ID NO 51493
  misc_feature: Useful for making plants with modulated flowering time
MSPPAWLRGLPRAPEYRPTESEFADPIAFLSRVEREAAAYGICKVIPPYRRPSRRFVFAHLNRYLTSSFDAANPAVPGSSSSTAPSRPESAAVFTTRHQELGTPRRGRPPPQVLKQVWQSGEQYTLEQFEAKSRAFSKVHLAGLREPTPLEVESLFWKASADRPIYIEYANDVPGSGFAAPPQSRRRKKRRRDGDQVEEGEKGSGWRLSGSPWNLQAIARAPGSLTRFMPDDVPGVTSPMVYIGMLFSWFAWHVEDHELHSLNFLHTGAPKTWYAVPGDRASELEEVIRVHGYGGNPDRLASLAVLGEKTTLMSPDVLVARGVPCCRLVQYPGEFVVTFPRAYHIGFSHGFNCGEAANFATPQWLKFAKEAAVRRAVMNYLPMLSHQQLLYLLAASFIIKTPNVLSGIRTSRLRD

SEQ ID NO: 35497 - DNA, 555 bp, Panicum virgatum
  misc_feature: Ceres CLONE 1961895
  misc_feature: Encodes the peptide sequence at SEQ ID NO. 35498
accacaaagggccccgcgctcgggaccaccatgacaacccgacttcacctcgccctcctcgtcctcctaagctcgtcaggcctcgtttcatccatccgtcgagcctccgacaacaacagcccgctcgccgcctacctcgtcaccgtccgccgcccggatggcctgctcagcgacgacgagccggatgcgtctgagatgtggcacacgtacctcctcgggcaggtgtgcaacaccagcgacccggccacggcggagcggttcccgacggcggagtcgcggctcatctactcgtacagccacgtggtgagcggcttctcggcgtggctcacgccgcaggaggtcgatgccatggcttggttcccctggttcgtcgaggctgtcccggacaagagctacaagctcatgtccgtggacacgccgacggcgccggagctctcctggctcgacggcgttcgggacggcgtgtggaacaagggcaacacgggcgaggggatcaccattggcgtccttgacgctggcatcaccgcgggtaaccttccggtcagccccgacgcc

SEQ ID NO: 35498 - protein, 184 aa, Panicum virgatum
  misc_feature: Ceres CLONE 1961895
  misc_feature (43)..(135): Pfam Name: Subtilisin_N Pfam Description: Subtilisin N-terminal Region
TTKGPALGTTMTTRLHLALLVLLSSSGLVSSIRRASDNNSPLAAYLVTVRRPDGLLSDDEPDASEMWHTYLLGQVCNTSDPATAERFPTAESRLIYSYSHVVSGFSAWLTPQEVDAMAWFPWFVEAVPDKSYKLMSVDTPTAPELSWLDGVRDGVWNKGNTGEGITIGVLDAGITAGNLPVSPD

SEQ ID NO: 35499 - DNA, 668 bp, Panicum virgatum
  misc_feature: Ceres CLONE 1961902
  misc_feature: Encodes the peptide sequence at SEQ ID NO. 35500
gattgctgacgatgagttcctccacttgccccgctctcccgctctcttccctcgtgctcctctccccgctgaccctaactcactatggctccctcacctcagacgccggtcacacggtcttcatcctccgcgcgggtgtgcctcgtatttctcctgctcttaccctgtccagacgcggcgataaccgacctgctcattctggagccaacgtacctgctcggcggccggatgcacatgaagaacttctccggcatcagcgtccagatctgccccgactgcttggagggcttccactgccggcacatcacccccatctggcccatcaccaacgaaacgctcccgctccaccacttcctctccgactttagtgccgcccctcacatctacaaggacgacagcggcctctacaatgaagcttacattcacaacataattgaccgatcctatgccatgcaaagtaaacgacacaacctgtctgccactttgcccgccactggaatctaccacatttccatccttgcgctgcctcgcctctacgatcacctcccgatcgagccggtgacgccggtggacatggagctgtactacttcaagaacgacttctacggggcggacccgccgcacgtgagcatcctgcagaccaacatccctatccagatctgcaccga

SEQ ID NO: 35500 - protein, 194 aa, Panicum virgatum
  misc_feature: Ceres CLONE 1961902
  misc_feature: SWISSPROT Homolog: EC 1.5.3.11 Polyamine oxidase
MAPSPQTPVTRSSSSARVCLVFLLLLPCPDAAITDLLILEPTYLLGGRMHMKNFSGISVQICPDCLEGFHCRHITPIWPITNETLPLHHFLSDFSAAPHIYKDDSGLYNEAYIHNIIDRSYAMQSKRHNLSATLPATGIYHISILALPRLYDHLPIEPVTPVDMELYYFKNDFYGADPPHVSILQTNIPIQICT

SEQ ID NO: 35501 - DNA, 568 bp, Panicum virgatum
  misc_feature: Ceres CLONE 1961915
  misc_feature: Encodes the peptide sequence at SEQ ID NO. 35502
agcggcccaccccatctgaccgtctctcctcgcccccgcaccagtgactcgacttcctccgcggaccgccaccgccacctcacccaccacctcgccggagatcacgagaggagcctcgccgctgcccccccgcccgccatgggggatgccgcctccggccgcggccacgttgtctaccctccccgctccgccgaggacatcttcaaggactaccgcgcccgccgctccgccatcctccgggccctcacccacgacgtcgaggacttctacgcgcagtgcgatccagagaaggagaacctctgcctgtacgggtacgcgaacgaggcctgggaggtggcgctgccggcggaggaggtgccaacggagctgccggagcccgcgctggggatcaacttcgcgcgcgacggcatgaatcgccgcgactggctcgcgctcgtcgccgtccactccgactcatggctcctctccgtcgctttctactacgctgctcggctcaatcggaatgaccggaaacgtttatttggtatgattaacgaattgcaaactgtttttgaagttgtctccggtg

SEQ ID NO: 35502 - protein, 143 aa, Panicum virgatum
  misc_feature: Ceres CLONE 1961915
  misc_feature: Functional homolog of the protein sequence given in SEQ ID NO 50175
  misc_feature: Useful for making plants with altered lignin content
  misc_feature: Useful for making plants with modulated flowering time
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: The sequence is a functional homolog of SEQ ID NO 1981 in the 11/479,226 US patent application
  misc_feature: Functional homolog of the protein sequence given in SEQ ID NO 50174
  misc_feature: Useful for making plants with altered alkaloid content
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
MGDAASGRGHVVYPPRSAEDIFKDYRARRSAILRALTHDVEDFYAQCDPEKENLCLYGYANEAWEVALPAEEVPTELPEPALGINFARDGMNRRDWLALVAVHSDSWLLSVAFYYAARLNRNDRKRLFGMINELQTVFEVVSG

SEQ ID NO: 35503 - DNA, 1268 bp, Panicum virgatum
  misc_feature: Ceres CLONE 1961917
  misc_feature: Encodes the peptide sequence at SEQ ID NO. 35504
acactgccaagtgccaaaacacatcacctattcacctccctcccgttttcccaaactgagccaccgagctagaggccgggaatagtattcttctagcccgtctcgactctcgagagccttctcccaatggccaagcacgttgccgccctcctgctgctactgatggcggtcgccgtaagggccccgccgtcagcggcgttcctggtccagccccagccgaacctcctcacgtaccacaacggcgccgtactgagcggcgacatccctgtctccatcatatggtacggccgcttcacgccggcgcagaaggccgtcgtctccgacttcctcctctccctctccgcgacgccgtcgtcgtcgtcccgcgccccgtccgtcgcgcagtggtggagcagcatcaaccggctctacctctccaaggcggcggccgtcggcaagaacggcgcccacggcggcgccgggagcgcgcgggtggtcttggccgggcaggtctccgacgaggcgtgctcgcttgggaaaagcctcaagatgtcccagctcccggcgctcgcggccgcggcgcgccccgccaaggctggcggcatcgcgctagtgctcacggcgcaggacgtggcggtggagggcttctgcgcgagccggtgcgggcaccacgggtcgtacggcggcggcggcggccgcgcccgcgcggcgtacgcgtgggtggggaacccgggcgcgcagtgccccgggcagtgcgcgtggccgttccaccagccggcgtacgggccccaggcgccgccgctggtgccgccgaacggggacgccggcatggacggcgcggtgatcagcgtggccgccatggtggccggcgcggtgaccaacccgttcggggacgggttctaccagggcgaccgcggcgcgccgctggaggccgccacggcgtgcgcgggcgtctacggcagcggcgcctaccccgggtacgccgggcggctgctggtggacgcggcgacgggcgccagctacaacgcgcgcggcgcgcgcgggaggaagtacctgctcccggcgctgttcgaccccgacacgtcggcgtgctccacgctggtgtagccgccgtacgtagacccgatcgtgccgaggtgacggaccctccaaattaaaaaaatgtttctcaagtgttgctatctgtgtaaatactgtatagacgtatagtacagtgagtatcatcgtacgtatacgtacgtagctgccggccgggcagtgctaaataaagggcctgagaattaagttgc

SEQ ID NO: 35504 - protein, 319 aa, Panicum virgatum
  misc_feature: Ceres CLONE 1961917
  misc_feature (34)..(319): Pfam Name: Phi_1 Pfam Description: Phosphate-induced protein 1 conserved region
MAKHVAALLLLLMAVAVRAPPSAAFLVQPQPNLLTYHNGAVLSGDIPVSIIWYGRFTPAQKAVVSDFLLSLSATPSSSSRAPSVAQWWSSINRLYLSKAAAVGKNGAHGGAGSARVVLAGQVSDEACSLGKSLKMSQLPALAAAARPAKAGGIALVLTAQDVAVEGFCASRCGHHGSYGGGGGRARAAYAWVGNPGAQCPGQCAWPFHQPAYGPQAPPLVPPNGDAGMDGAVISVAAMVAGAVTNPFGDGFYQGDRGAPLEAATACAGVYGSGAYPGYAGRLLVDAATGASYNARGARGRKYLLPALFDPDTSACSTLV

SEQ ID NO: 35505 - DNA, 687 bp, Panicum virgatum
  misc_feature: Ceres CLONE 1961924
  misc_feature: Encodes the peptide sequence at SEQ ID NO. 35506
tgttggtgatgaaagtgggatgatcaaccgaattgctggggtttttgctagaagaggatataacatcgagtcattggctgttgggctgaacaaggataaagcattgtttacaatagtagtgtcaggaacagacaaaatattgaaccaagttgtagagcaactaaacaaacttgttaatgtcataaaggttgttgacttatcaaaagaaccacaagttgaaagagaactgatgcttataaaaataaatgcggagcgagataagctgcctgagataatgggtttggttcgcattttcaaagcagaagtggttgatctttcagacgatacactaactattgaggtaactggagatccaggaaagatggttgcaatacagaagactctgagcaaacatgggatcagagagattgctagaactggcaagattgctttgcgccgtgaaaaaatgggagaaactgctccattttggaggttctctgcagcttcttatcctgatcttgaagtggcagtaccttcaatttctcggcggagctctggagtggatgcagtcaatcagatttccaacgaatcttcagggggcgatgtttatccagtggaatcttatgaaaacttctcagcaaatcaaattcttgatgctcattggggtgttatgaccgatggtgatccaacagggttttgttcacatac

SEQ ID NO: 35506 - protein, 228 aa, Panicum virgatum
  misc_feature: Ceres CLONE 1961924
  misc_feature: SWISSPROT Homolog: EC 2.2.1.6 Acetolactate synthase
VGDESGMINRIAGVFARRGYNIESLAVGLNKDKALFTIVVSGTDKILNQVVEQLNKLVNVIKVVDLSKEPQVERELMLIKINAERDKLPEIMGLVRIFKAEVVDLSDDTLTIEVTGDPGKMVAIQKTLSKHGIREIARTGKIALRREKMGETAPFWRFSAASYPDLEVAVPSISRRSSGVDAVNQISNESSGGDVYPVESYENFSANQILDAHWGVMTDGDPTGFCSH

SEQ ID NO: 35507 - DNA, 721 bp, Panicum virgatum
  misc_feature: Ceres CLONE 1961930
  misc_feature: Encodes the peptide sequence at SEQ ID NO. 35508
acatttgtgaagctgcgatgggggctagggtttcctagtgcctcttccctccatcgccgccttcgctcagcgctccgctccacccggacggtagatcgagtcttctccaagtcaaatcacatttggatctctaggcgtgcgcgaggagacaaggagcgagcagatcagcaccgcacctgctcctgggcagcggcgagcagattggcaccctcctccccatcggcgacctccctctccgtcgggcatcagcgaataggggccgttcccgtccgcagcttcactccccaccagggattcgacaccgtctgcgcctccttcccgttctggtgtgagcgtcactgaaacagcaagatcggtgccccgacgtcccatcgacgacctccctcaaccgcacggtctcagcttcgtttccacaacgagaggccggggtttggcctgagagaatgcaagatcctaacggcgacgatttctctgccccaaagttgcacaagaagaaggttgtataccggccgcttccatcaggcatgctgaagggtgaacctgaactgctgcgtagagaggttccgcattcatcaggcatggtccataagctgcccaaaagaagcttgaagagtgagcgccctgccacacctccatctgacagagggactcctgattccctgccggactctggtcctaccgatgaatatcgtgcgctgcggaggaaatacatgatgctggg

SEQ ID NO: 35508 - protein, 92 aa, Panicum virgatum
  misc_feature: Ceres CLONE 1961930
  misc_feature: Functional homolog of the protein sequence given in SEQ ID NO 51029
  misc_feature: Useful for making plants with modulated nitrogen use efficiency
MQDPNGDDFSAPKLHKKKVVYRPLPSGMLKGEPELLRREVPHSSGMVHKLPKRSLKSERPATPPSDRGTPDSLPDSGPTDEYRALRRKYMML

SEQ ID NO: 35509 - DNA, 644 bp, Panicum virgatum
  misc_feature: Ceres CLONE 1961946
  misc_feature: Encodes the peptide sequence at SEQ ID NO. 35510
aagagacacccagcgccgcagcccgcagccactcgacctcccgagcccccaggcggccaggcaccaggtgcggcggcggcggcaagatggcggtgggcaagaacaagcggatcagcaaagggaagaagggcggcaagaagaagaccgtcgatccattcgcgaagaaggattggtatgatatcaaggcgccctctgtcttctccgtgcgcaacattggaaagacactcgtgtccaggacacagggtactaagattgcttctgacggtctgaagcaccgtgtcttcgaggtctccctagctgatcttcagagtgatgaagaccaagcctacaggaagatcaggctccgtgctgaagacgtccagggtcgtaatgtccttaccaacttctggggaatggattttacgacagacaagctccggtcgcttgtcaggaagtggcagactttgattgaggcccatgttgatgttaagaccactgataactacatgctgcggctcttctgcattgggtttacaaagaggagacccaaccaagtgaagcgcacttgctacgcacaggcctcccagatccgccagatacgccgtaagatggttgagatcatggccaaccaggcctctacctgtgacctgaaggagttggttttc

SEQ ID NO: 35510 - protein, 185 aa, Panicum virgatum
  misc_feature: Ceres CLONE 1961946
  misc_feature (11)..(185): Pfam Name: Ribosomal_S3Ae Pfam Description: Ribosomal S3Ae family
MAVGKNKRISKGKKGGKKKTVDPFAKKDWYDIKAPSVFSVRNIGKTLVSRTQGTKIASDGLKHRVFEVSLADLQSDEDQAYRKIRLRAEDVQGRNVLTNFWGMDFTTDKLRSLVRKWQTLIEAHVDVKTTDNYMLRLFCIGFTKRRPNQVKRTCYAQASQIRQIRRKMVEIMANQASTCDLKELV

SEQ ID NO: 35511 - DNA, 1348 bp, Panicum virgatum
  misc_feature: Ceres CLONE 1961951
  misc_feature: Encodes the peptide sequence at SEQ ID NO. 35512
agacatccaccacctcaggagccacaccactctctacctgagcgctcgaatcctatcgagccgagagagccaagcagccctcgtcgtgctcgccttgccttgccaatagatagataatggcggccgcggcaggcgacgagaggaagaagacggcgtgcgtgaccggggggaacgggtacatcgcgtcgttgctcatcaagatgctgctggagaagggatacgtcgtcaagacgacggtcaggcaccccgaggacaaggaggccaactcccacctcgaggacctcaagaagctcggcacactggaggtgttccgcgccgacctggccgaggaaggcagctacgacgccgccgtcgccggctgcgactacgccttcctcctcgccgccccggtcaactacacgtccaagaatcccgagaaagagctgatcgagctcggtgtccaaggcacgctcaacgtcctgcggtcctgcgtcaaggccggcacggtgaagcgcgtgatcctgacctcctcgacggcggcggtctccagcaagccgctggaaggcgacgggcacgtgctggacgaggagtccttctccgacgtcgagtacctctccgccaaaaggactggcctctgggcgtacccggtgtccaaggtgctcctggagaaggcggcgaccaggttcgcggcggagcacggcatcagcctggtgaccctgtgcccgtccgtcaccgtcggcgaggcgcccgaccggaaggtgtacaccaccgtccccgccatcctctccctgctgtccggcgacgaggcggagctgaaggtgctcaagggcatcgagagggcctccggctcggtgccgctcgtgcacgtgcgcgacgtctgccgcgccgagatcttcgccgccgaggcggaggccgtcgccggcaggtacatctgcaacggcctcgacacgaccatcctcgagatggcccgcttcctggcggccaagtacccgcagtacaacgtgaacacggacatctccggcgacctcctggcgaagccggtagcgctgctgccgtcgacgaagctggagaaggcggggttcgagttcaagttcaggacgctggagcacatctacgacgacatggtggagtacggcaaggccctggggatcctgcccaactcatgagagtgttaggtgtgctgcgccgtccgtgtgtgtttgggtcggcgatctagcagtacccaccgcaaaataagtccgtgtccgtgctttttgtcacgtcaggacgcaaaataattgcgggtggcttgagtgtatctcttctttctatcttttttttttgccctttttgagatgaagtttgaatgttagctcgtgtgttcccttag

SEQ ID NO: 35512 - protein, 342 aa, Panicum virgatum
  misc_feature: Ceres CLONE 1961951
  misc_feature (13)..(267): Pfam Name: Epimerase Pfam Description: NAD dependent epimerase/dehydratase family
  misc_feature: SWISSPROT Homolog: EC 1.3.1.77 Anthocyanidin reductase
MAAAAGDERKKTACVTGGNGYIASLLIKMLLEKGYVVKTTVRHPEDKEANSHLEDLKKLGTLEVFRADLAEEGSYDAAVAGCDYAFLLAAPVNYTSKNPEKELIELGVQGTLNVLRSCVKAGTVKRVILTSSTAAVSSKPLEGDGHVLDEESFSDVEYLSAKRTGLWAYPVSKVLLEKAATRFAAEHGISLVTLCPSVTVGEAPDRKVYTTVPAILSLLSGDEAELKVLKGIERASGSVPLVHVRDVCRAEIFAAEAEAVAGRYICNGLDTTILEMARFLAAKYPQYNVNTDISGDLLAKPVALLPSTKLEKAGFEFKFRTLEHIYDDMVEYGKALGILPNS

SEQ ID NO: 35513 - DNA, 732 bp, Panicum virgatum
  misc_feature: Ceres CLONE 1961956
  misc_feature: Encodes the peptide sequence at SEQ ID NO. 35514
gtgtttcgatcatcagtagacatttgaggacgacgtagaagatacaattcctcatagatggctgcttccccatctttccgttccgctgccgccgccggcgtgctgctggcaatggtggtggccgccgtgtgcctccccggcgcggcggcgcagctgtgcgaggactactacgacgacacgtgccccgacgcctacgacatcgtcaagcaggtcctcatggacgcgcaccagtcggacacgcgcatcttcgccagcctcatccgcctccacttccacgactgcttcgtccagggctgcgacgggtcgctgctgctggacaccgtgccggggatgcagtcggagaaggagtcgccgcccaacaacggctcggcgcgcgggttcccggtggtggacgccgtcaaggcggcgctggaggactcatgccccggcgtcgtctcctgcgccgacatcctcgccatcgccgctgagatctcagtcgagctgtcgggaggccccagctggggtgtgcttctgggaaggctggatggcaagacctccgacttcaacgggtccctggatctcccggcgcccaccgacaacctcaccgtgcttcagcagaagttcagcaacctcagcctcaacgacgtcgaccttgtcgccctctcagggggccacaccttcggccgggtacaatgccagttcgtcacggaccggctctacaacttcagcggcacaaacatgcccggacccgac

SEQ ID NO: 35514 - protein, 224 aa, Panicum virgatum
  misc_feature: Ceres CLONE 1961956
  misc_feature (49)..(223): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51034
  misc_feature: Useful for making plants with modulated nitrogen use efficiency
  misc_feature: Functional homolog of the protein sequence given in SEQ ID NO 51174
  misc_feature: Useful for making plants with altered carbohydrate content
  misc_feature: Functional homolog of the protein sequence given in SEQ ID NO 51488
  misc_feature: Useful for making plants with altered cell wall content and/or composition
MAASPSFRSAAAAGVLLAMVVAAVCLPGAAAQLCEDYYDDTCPDAYDIVKQVLMDAHQSDTRIFASLIRLHFHDCFVQGCDGSLLLDTVPGMQSEKESPPNNGSARGFPVVDAVKAALEDSCPGVVSCADILAIAAEISVELSGGPSWGVLLGRLDGKTSDFNGSLDLPAPTDNLTVLQQKFSNLSLNDVDLVALSGGHTFGRVQCQFVTDRLYNFSGTNMPGP

SEQ ID NO: 35515 - DNA, 655 bp, Panicum virgatum
  misc_feature: Ceres CLONE 1961968
  misc_feature: Encodes the peptide sequence at SEQ ID NO. 35516
aagaacaatatacttgactattatgtccagtgttgattttgaagaagctggtcacaagcttatgaaaattaaactcgagcctggtcaagagatggagctgtgtattatgcttcttgagtgttgcagtcaagagagaacataccttcggtattatgggctgctaggacagcgattttgcatgatcaacaaagtgtaccaagagaactttgaaaaatgtttcgtccaacaatattctatgattcatcgccttgaaacaaacaagttgaggaatgttgccaagttctttgcgcatttgttggggactgatgcactcccttggcatgttttggcttacatccggctgacagaggaagacacaacatcctcttcccgaattttcataaaaattctattccaggagttatcggagcacctgggcatacgcctactcaatgagagactgaatgatcctaacatgcaaggttccttcgagtcgatcttccccaaggatcatccaaagaacacaaggttctccatcaatttcttcacctccattggtcttggcggtatcacagagagcctgagggaatacttgaagaacatgccacgcctcataatgcagcagcagaaaccggagtcatctgaatcagaatcaatcggatcagaatctggttca

SEQ ID NO: 35516 - protein, 217 aa, Panicum virgatum
  misc_feature: Ceres CLONE 1961968
  misc_feature (1)..(105): Pfam Name: MA3 Pfam Description: MA3 domain
RTIYLTIMSSVDFEEAGHKLMKIKLEPGQEMELCIMLLECCSQERTYLRYYGLLGQRFCMINKVYQENFEKCFVQQYSMIHRLETNKLRNVAKFFAHLLGTDALPWHVLAYIRLTEEDTTSSSRIFIKILFQELSEHLGIRLLNERLNDPNMQGSFESIFPKDHPKNTRFSINFFTSIGLGGITESLREYLKNMPRLIMQQQKPESSESESIGSESG

SEQ ID NO: 35517 - DNA, 686 bp, Panicum virgatum
  misc_feature: Ceres CLONE 1961972
  misc_feature: Encodes the peptide sequence at SEQ ID NO. 35518
accaaattgatgcgactatgcgagtagatcgaaaatcgcggcggcggcggactcgactgtagcagcgaccactgcggacaagatggcggcggcgttatcgcagctggatgacgagatcgtccacggcatggtcatcggcgcggtcttcaccgattacgccgggaaaataaactgcctcgatttccaccgcaaggaggatctcctcgtcacctccagcgaggacgactccatacgcctctacaacatcactagcgccacgttgctaaagactacatatcataggaaacatggtgctgaccgtgtctgttttactcatcatccgagttctatcttatgctcatcaagatacaatctagagtctgcagagtcactccgttatctgtcattgtatgacaaccgttgcttaagatacttcaaagggcacaaagacagggttgtctcattatgtatgtcacccatcaatgatagctttatgtcaggatcacttgatcacagtgtcagaatatgggatcttcgtgtaaatgcttgtcagggcatactaagacttcgaggcaggccttctgttgcatatgatcagcaaggacttgtttttgctgtagcaatggaagggggagctattaagttatttgattcccgatcatatgataagggtccatttgatactttcttggttggcggagatacag

SEQ ID NO: 35518 - protein, 201 aa, Panicum virgatum
  misc_feature: Ceres CLONE 1961972
  misc_feature (105)..(143): Pfam Name: WD40 Pfam Description: WD domain, G-beta repeat
  misc_feature (16)..(54): Pfam Name: WD40 Pfam Description: WD domain, G-beta repeat
  misc_feature: SWISSPROT Homolog: EC 2.7.11.7 [Myosin heavy-chain] kinase
MAAALSQLDDEIVHGMVIGAVFTDYAGKINCLDFHRKEDLLVTSSEDDSIRLYNITSATLLKTTYHRKHGADRVCFTHHPSSILCSSRYNLESAESLRYLSLYDNRCLRYFKGHKDRVVSLCMSPINDSFMSGSLDHSVRIWDLRVNACQGILRLRGRPSVAYDQQGLVFAVAMEGGAIKLFDSRSYDKGPFDTFLVGGDT

SEQ ID NO: 35519 - DNA, 512 bp, Panicum virgatum
  misc_feature: Ceres CLONE 1961973
  misc_feature: Encodes the peptide sequence at SEQ ID NO. 35520
aaaaaaactccccacttctcttccccaaacaacccctacccaccggcggcggcggcggcggcggcgcgagggctttgcttgctgccttgctcccatggctctcgtcgccggctcctacgagcgcttcatctggggcttctccctcaagaccctgaccacctcggccgccgccgccgactcgtcgtccgaaaccctcaccctcgtgccgctcttctcctacccggcccacacgggcccggtccgctgcgtggccgcggcgccgcgtgcggggctcgcggcctccggaggcgccgacgactccgtccgcctctacgacctccccaccgccgccgacctcggcccgctcctcgacccgtccgccgccgtctccgcgctcgccttctactcccggggccccgtgccgcggaacctcctcgccgcctgcgacgacggcgcgctccacctctacgacgccgacggcttcgcgctcctcgccacgctccgcgcgttcccgcgccacgaggccgcagagg

SEQ ID NO: 35520 - protein, 139 aa, Panicum virgatum
  misc_feature: Ceres CLONE 1961973
  misc_feature (36)..(74): Pfam Name: WD40 Pfam Description: WD domain, G-beta repeat
MALVAGSYERFIWGFSLKTLTTSAAAADSSSETLTLVPLFSYPAHTGPVRCVAAAPRAGLAASGGADDSVRLYDLPTAADLGPLLDPSAAVSALAFYSRGPVPRNLLAACDDGALHLYDADGFALLATLRAFPRHEAAE

SEQ ID NO: 35521 - DNA, 318 bp, Panicum virgatum
  misc_feature: Ceres CLONE 1961973-R
acatcactaaaatgagttgcagagttcaagtgaagagcaaatgatgaagcatatcgttgaaaagccgctgtgcttatctttgtaacatttagtttagtccctataatggattggtatgcgagaactgggcatgaaagaaggattgaagctggagatctggcacgcaaacataagctggatgcatttgaaatgtatgatagtcgtcgattatacataacatagtttggctaaagtgcgtgaactgaaactcagtgagattgcgtgatttgattgtaccacaagttttgcagtaatggccatttccaaagttaactgggc

SEQ ID NO: 35522 - DNA, 1315 bp, Panicum virgatum
  misc_feature: Ceres CLONE 1961981
  misc_feature: Encodes the peptide sequence at SEQ ID NO. 35523
ctctctctctctctcgctggcggctgggcccgcctccttcccgagcacgccgcctccaattcttcccttgcccctccgcccctcctcgtcctccccgcttctgtcgtcggctgccgctgctggggtcggttgccgtggaggagagcggcgggggttccatctccgcgccgcagcctgcctccacccgccgccggttccgtctcctcccggtctcaagatgatcggctccctcgttaccggagctctaacccttgttcttggatatgcataccctgcctatgactgctacaagacagtggagctaaacaggcccgaggttgagcagctacggttctggtgtcagtactggattttacttgcagttctcactgtactggagagagttggggaaaatttcgtgtcatggttgccaatgtatagtgaagcaaagctggcatttatcgtgtacttgtggtatccaaatacacgtgggactgcctacgtgtatgagactttctttaagccatacattgcaaaacatgaaactgagattgatcgaaatctgcttgagttgaggacaagagccggtgatatggcagttgtttacttccagagggttgcaaactatgtacagacaaggtcctatgaaatcttgcagtatattgcctcacagtcaccgtctcaaagacctcgccctcagggacagcaacagcagcagcgcccacctccaccacggactcggcaggtgaaccctggacctccacctgttcccgcgccatcggctcctccgttgccaccacagcctgcccaagcccaagttcctccggcaccaccaaggcccccagttccagttgcccctcctggtgcagtgcctcccacccagccacaggcaccacctgctcctggagctgccgccatcaatggtcctcagaacaccgaagccatgcaagtcgacccaccccgcgcgtccacgagcggcgcaccgccaccactgccatccgaggagacgctcatcgaggaggcgatccgcctgactcggggccggctcaggaggcgcgtggctggaggatctggaccgccgccaaattagcatcgaccaaggttcatctcgtgcaggccactccacactgggctggttctgttgctccactgagaagagatgaggggaatgctgagttggttaaacagatttcggtttccaagcattcattcctaccgttcaaactggaacctgtttggtgttgcttcacgactcaaatgtgtatagattcccaggagcagagatggatttcgtgatgctcgtagatcagtccacaggatataactaggaaatacg

SEQ ID NO: 35523 - protein, 283 aa, Panicum virgatum
  misc_feature: Ceres CLONE 1961981
  misc_feature (3)..(98): Pfam Name: TB2_DP1_HVA22 Pfam Description: TB2/DP1, HVA22 family
MIGSLVTGALTLVLGYAYPAYDCYKTVELNRPEVEQLRFWCQYWILLAVLTVLERVGENFVSWLPMYSEAKLAFIVYLWYPNTRGTAYVYETFFKPYIAKHETEIDRNLLELRTRAGDMAVVYFQRVANYVQTRSYEILQYIASQSPSQRPRPQGQQQQQRPPPPRTRQVNPGPPPVPAPSAPPLPPQPAQAQVPPAPPRPPVPVAPPGAVPPTQPQAPPAPGAAAINGPQNTEAMQVDPPRASTSGAPPPLPSEETLIEEAIRLTRGRLRRRVAGGSGPPPN

SEQ ID NO: 35524 - DNA, 105 bp, Panicum virgatum
  misc_feature: Ceres CLONE 1961981-R
caggagcagagagggaagccgcgaggcgcgaagaccagcccacaggaaaaaacaaggaaagacgacggggcaccacggggggcaaacaggccggaacacccccgg

SEQ ID NO: 35525 - DNA, 1228 bp, Panicum virgatum
  misc_feature: Ceres CLONE 1961991
  misc_feature: Encodes the peptide sequence at SEQ ID NO. 35526
aagcagctcgatcggcgtgaccagctaccactgctgattgtttggaaaaagaaagtgttttgagcgccagatcggggctcccctggggatcagaaaaacaatgtcacagtctggggccttgcatctttctacgggcttgcaagggaaaaacattgacaaggatcaacttgactcgaccgttgaacaatatgcaaagtatcatgacctgcacggaggtgatgaggaattcaggaagtcgaactatagtgacttggtaaaaaagtattacgatcttgtaaccaccttcactgaataccactggggtcaatcattccatttcgccccaagatggcatggagaaactcttcgcgaaagtatcaagagatttgagcattttattgcccttcaattggggctcaagaaggggatgaaggtcctggatgttggatgtggaattgggggacccttaagagaaatcgcaaaattcagctcagcagagataactgggttgaacaacaatgcttaccagatatcaaggggcaaggagctcatttctttggcagcctatgcaattgaggccacaattcatgcacctgatgcactaggtgcctacagggagatatacagagtgctgaaaccaggccagtatttcgcactagatgaactgtgcttgactgataagtttgatccaaacaacactaaacatagggacatcaaggcagaaattgagcttggcagtgggctgcctgacatccgtagaactcgcgagtgcatccaagcgatgaaagatgcaggattcgaggttatcttcgcgaaggatcttgctgaggaatccgagtgcccttggtaccatgaattagagccaggccacttctcattgaagagcatcagtaactcacgtgttggcacacttgagttcctccgtattgcccccaaaggctgcaatagattgttcagcatcctgcagactgcttctcacggcctgctgatgggcagccgggaacagatttttacgatgaccttctttgtcctgggccggaaacctctcaaggagagtgaaatttaaagcagcctacaacaataatgccgtatgtagtatgggcttatactcaggagctataggactaaagttggctgtgatccttgcactgtactaaatattgctaaagttctataaaataatgttgtatgcagtgttctgaattactgggaaattaagattactatctgcaataaacatacttgtagc

SEQ ID NO: 35526 - protein, 314 aa, Panicum virgatum
  misc_feature: Ceres CLONE 1961991
  misc_feature (188)..(308): Pfam Name: Sterol_MT_C Pfam Description: Sterol methyltransferase C-terminal
  misc_feature (106)..(179): Pfam Name: Methyltransf_11 Pfam Description: Methyltransferase domain
  misc_feature (1)..(147): SWISSPROT Homolog: EC 2.1.1.41 Sterol 24-C-methyltransferase
  misc_feature (148)..(313): SWISSPROT Homolog: EC 2.1.1.143 24-methylenesterol C-methyltransferase
MSQSGALHLSTGLQGKNIDKDQLDSTVEQYAKYHDLHGGDEEFRKSNYSDLVKKYYDLVTTFTEYHWGQSFHFAPRWHGETLRESIKRFEHFIALQLGLKKGMKVLDVGCGIGGPLREIAKFSSAEITGLNNNAYQISRGKELISLAAYAIEATIHAPDALGAYREIYRVLKPGQYFALDELCLTDKFDPNNTKHRDIKAEIELGSGLPDIRRTRECIQAMKDAGFEVIFAKDLAEESECPWYHELEPGHFSLKSISNSRVGTLEFLRIAPKGCNRLFSILQTASHGLLMGSREQIFTMTFFVLGRKPLKESEI

SEQ ID NO: 35527 - DNA, 1588 bp, Panicum virgatum
  misc_feature: Ceres CLONE 1961992
  misc_feature: Encodes the peptide sequence at SEQ ID NO. 35528
acccatctatccatctcgcagctctgtctctgacaaccgttcgcccccgccgccttgccgcgccgcccgcgcacgcactccgtctcgtcgccggcgcacccatgacgacggtgtcgcgcgcactcggctccgcgttcgcgggattcacgcggacccccgccgcggcgccggccgcgacgaccctgcactctccgtgcggctcgtcggcgctactgcggcactggcagtggagccgggccagccgcgcccggcggttctcctccggccgcgcggcacggattagcatgagcctccgcgcaggaattgtcgggctgcccaacgtcggcaagtccaccctcttcaacgccattgtcgaaaatgggaaggcacaagctgcaaactttcccttttgtacaatcagcccaaatgttggtgtggtggctatccctgatcctcgcctgcaggtgctctcgaaattaagcaagtcgcagcagactgtcccgacatccatagagcttgtggatattgcaggtcttgtcaaaggagcaagcaaaggagagggactaggaaatcaatttctttcaaacatccgtgaagtagattccatacttcaggttgtgcgatgctttgaggatgatgatattgttcatgtcaatggcaaagttgatcccaggtcagacattgatgttatcaacctagagctgatattttcagatcttgagcagatagagaagaggttagataagcttaaaaagagcaaaacaaaagatgcacaagtaaaagtgaaggaacaagcagagagaacaggactggaaaaaatacaggaggcgcttatggatggaaagcctgcaagatcggttgatttggctgaccatgagaaagaagctatacagcatctttgtctcctgactatgaaacctgtcatttatgttgctaatgtcacagaatcagatcttgctgaacctgatagcaatcctcatgtcaaagaggtgtttaaagcagcatcagacttgcagtctggcatggttacaatatcagctcaggttgaagctgaactggctgagctacctttggaagagagagtagagtatctaaaatctcttggtgttgctgaaagcggactaggaaatttggtaaaagcaacatatgacctattgggactacgaacttatttcacaaccggagataaggaaacgaaagcttggactattctttcaggcatgactgcgcctcaagcagctggagttattcacagtgactttcagaaaggatttatcagagctgaaactgtatcctacgacgattttgtggcggccggttctcttggagcagcaagggagaaagggctgttgaggttggaagggaaggattatgttgtgcaggaaggcgatgtcatgcttttcagattcaacgtgtgacagtagcacaaagcttcaaaatactggaattttgtacaaggcagattggcacaatataatttgcccatactgtgacaattcttttgggccttatgacacgactattcatgtactggcattattacttttcttattagggaaaacaaacatgatcgatgatccactgtttaactatcattcgccacattttg

SEQ ID NO: 35528 - protein, 431 aa, Panicum virgatum
  misc_feature: Ceres CLONE 1961992
  misc_feature (64)..(207): Pfam Name: MMR_HSR1 Pfam Description: GTPase of unknown function
MTTVSRALGSAFAGFTRTPAAAPAATTLHSPCGSSALLRHWQWSRASRARRFSSGRAARISMSLRAGIVGLPNVGKSTLFNAIVENGKAQAANFPFCTISPNVGVVAIPDPRLQVLSKLSKSQQTVPTSIELVDIAGLVKGASKGEGLGNQFLSNIREVDSILQVVRCFEDDDIVHVNGKVDPRSDIDVINLELIFSDLEQIEKRLDKLKKSKTKDAQVKVKEQAERTGLEKIQEALMDGKPARSVDLADHEKEAIQHLCLLTMKPVIYVANVTESDLAEPDSNPHVKEVFKAASDLQSGMVTISAQVEAELAELPLEERVEYLKSLGVAESGLGNLVKATYDLLGLRTYFTTGDKETKAWTILSGMTAPQAAGVIHSDFQKGFIRAETVSYDDFVAAGSLGAAREKGLLRLEGKDYVVQEGDVMLFRFNV

SEQ ID NO: 35529 - DNA, 537 bp, Panicum virgatum
  misc_feature: Ceres CLONE 1961993
  misc_feature: Encodes the peptide sequence at SEQ ID NO. 35530
actatgcctctcctgggtcgtgcaagcttagttcatctgaaggagctgagacaagaggagggaaacaatggcgagttcttccatggacactgaagctgcaggccaagagctcaagggcggtggctacaccgtcgcggctactgctcatgcagtagactcaggtaagaagcattcaggatcagagagctggcgtggttgttctgaattctgatcaggttagttcagttgatcgctgttcgttgctgttggtgaacagactcgtggcagcaggtggggctgttgctggtgatcggcttcaactgcgcctacgtgctgagcttctccaacctcatgatggcgccgctgggctggggctggggcgtcgcctgcctgctgctcgtcggggccgccgcctggtacgccaactggctcctcgccggcctccatttcatcgacggccagaggttcatccggtacagggacctcatgggcttcgtcttcgggaggaaaatgtactacatcacttatttcctgcagttcaccactctgcttctctgc

SEQ ID NO: 35530 - protein, 68 aa, Panicum virgatum
  misc_feature: Ceres CLONE 1961993
  misc_feature: Functional homolog of the protein sequence given in SEQ ID NO 51494
  misc_feature: Useful for making plants with altered carbon content
  misc_feature: Useful for making plants with altered nitrogen content
  misc_feature: Useful for making plants with modulated carbon-nitrogen partitioning
  misc_feature: Useful for making plants with modulated nitrogen use efficiency
  misc_feature: Functional homolog of the protein sequence given in SEQ ID NO 51495
  misc_feature: Useful for making plants with modulated oxidative stress sensitivity
MMAPLGWGWGVACLLLVGAAAWYANWLLAGLHFIDGQRFIRYRDLMGFVFGRKMYYITYFLQFTTLLL

SEQ ID NO: 35531 - DNA, 701 bp, Panicum virgatum
  misc_feature: Ceres CLONE 1961994
  misc_feature: Encodes the peptide sequence at SEQ ID NO. 35532
aagttgcaacacagagagggacaggtaactcaacagatactccataagcaatggctcctagaactacaagcagcgatgaggcggccacatcctggaaggcagcgcctgaggttcatcccagtgtgtggggggatttctttatcaattacatcccagagccactgcaggtttcagaagaaaagatgatcgagagagccgacaaattgaaaggggaagtgtgtggtctatttgaggcttgcaagaatgttgtggaaaaactggacctggtagatgttctgcagcgtttgggaatagatcaccattttcaagaacaaatagccaccaccttaagcatcatccacaaccaaagtgatgaattcaatagctcagaccttcatgaggtttgccttcgttttcgcttgcttaggcagcacgggttttgggttcctgcagatgaattcgacaggttcaagcttgaagatgggagctttatcgatagtatagctaatgacccaaagggcctgttaagtttatacaatgcagctaaccttctaactcacaataatgagggtgcacttgaagaagccctgatgtttgcaaggcgacatctagaattgatacaaagtagtctcgaatcccccttagcagaccaagttgcgcgtgccctgaaaataccactaccaaggaccttaaagagagtagaagcagtatcatatatgcaa

SEQ ID NO: 35532 - protein, 216 aa, Panicum virgatum
  misc_feature: Ceres CLONE 1961994
  misc_feature (26)..(216): Pfam Name: Terpene_synth Pfam Description: Terpene synthase, N-terminal domain
  misc_feature: SWISSPROT Homolog: EC 4.2.3.13 (+)-delta-cadinene synthase
MAPRTTSSDEAATSWKAAPEVHPSVWGDFFINYIPEPLQVSEEKMIERADKLKGEVCGLFEACKNVVEKLDLVDVLQRLGIDHHFQEQIATTLSIIHNQSDEFNSSDLHEVCLRFRLLRQHGFWVPADEFDRFKLEDGSFIDSIANDPKGLLSLYNAANLLTHNNEGALEEALMFARRHLELIQSSLESPLADQVARALKIPLPRTLKRVEAVSYM

SEQ ID NO: 35533 - DNA, 719 bp, Panicum virgatum
  misc_feature: Ceres CLONE 1962010
  misc_feature: Encodes the peptide sequence at SEQ ID NO. 35534
tcatttggacattctgatatagcttttaattccattgattctgcaatcaacgatggtgccctgttgaacagaaatccttggccccctgcacctccaccacagagaatgcggacattcaccaaggtctacaaacgtggagctgtaggtcggtcaattgacattggtaggtactctggatatgaagaattgaagcatgctttggcccgcatgtttggtattgagggccaacttgaggaccgacagagaataggctggaagctagtctacaaggatcatgaggatgacatcctacttcttggtgatgacccatgggaggagtttgtgaactgtgtgaagtgcattaggatcctatcccctcaagaagtgcaacagatgagcttagatggtgatttgggcaacaatgtcctctccaaccaagcttgcagcagctcagatggtgggaacgcctggaggcctcgctgtgaccagaacccaagtaacccttccattggcttctatgaccaatttgaatgacctgatcatcaacaaaaatggacagacgaggagtatggctgcaaaaagccagcagtgtttagccatgaacaaaattatgacctgaaagagttatgccgtgcagaatgctgtagatgcctaggcttttatatctgggagggcaaatgctcctcagattaggttatgttttggatatatgtgtagctttctcggttaaaacaatgcag

SEQ ID NO: 35534 - protein, 170 aa, Panicum virgatum
  misc_feature: Ceres CLONE 1962010
  misc_feature: Functional homolog of the protein sequence given in SEQ ID NO 50498
  misc_feature: Useful for making plants with modulated light quality sensitivity
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
SFGHSDIAFNSIDSAINDGALLNRNPWPPAPPPQRMRTFTKVYKRGAVGRSIDIGRYSGYEELKHALARMFGIEGQLEDRQRIGWKLVYKDHEDDILLLGDDPWEEFVNCVKCIRILSPQEVQQMSLDGDLGNNVLSNQACSSSDGGNAWRPRCDQNPSNPSIGFYDQFE

SEQ ID NO: 35535 - DNA, 1269 bp, Panicum virgatum
  misc_feature: Ceres CLONE 1962013
  misc_feature: Encodes the peptide sequence at SEQ ID NO. 35536
ggcgaggtcgagggtttcacttgaacccacaaaccgaaacaaaccctcgaaagctcggaagatcccgcggcgctgcaccctcctctcctctccactacccactcgtcgccgccgtcgcgagaccgccatggcgctgcacgcccccgtcctcgtgatgaaggactcgatgaagcgggagtcgggcgccaaggtgcaccgggccaatatccaggctgccaaggctgtggcagacatcatacgcactacactgggtcccagatccatgttgaagatgcttcttgatgctggcggaggtattgtggttactaatgacgggaatgctatattgagggaaatagacattgcacatcctgcagctaagtctatgattgaactaagccgtacacaggatgaggaagtgggcgatggcacaacctctgtgattgttctagctggtgagatgctccatgttgctcaagcattcattgacaagagctatcatccaaccgtcatttgccgagcatacaccaaagcgcttgatgacgctatagctgttcttgacaagattgcaatgcctgttgatgtgaatgatcgcgcggcaatgctaggtcttgtgaagagctccatcggtacamaattcactggtcagtttggtgaccttattgctgaccttgctatcgatgctactacaacagcaggtgttgacctaggtcagggtatgcgggaagttgatatcaagaagtatattaaagtagaaaaggttcctggtggccagttagaggattctacggtcctcaaaggagttatgatcaataaggatgttgtggctcctggcaaaatgagaaggaagatagttaacccacgtataatcctgctggacagccctattgagtataagaagggagaaaatcagaccaatgctgagttgatgaaggaagaagattggcaggttctgctagagatggaggaagagtacataaagaacctatgtgcacaaattctaaaatttaagcctgatttggtcatcacagagaaagggcttagtgatcttgctatccattatttgagcaaggctggtgttagtgtaattcatagacttcgaaaaactgacaacaacagaattgctaaggcttgtggagcagttatagtgaacaggcctgaggagctccaggaatctgatgtgggcacaggagctggcctatttgaggtcaaaaagataggtgatgaattcttttccgtcgttggtgattgaaagatcctaaggcttgcactgttctgttggaggggagc

SEQ ID NO: 35536 - protein, 367 aa, Panicum virgatum
  misc_feature: Ceres CLONE 1962013
  misc_feature (33)..(367): Pfam Name: Cpn60_TCP1 Pfam Description: TCP-1/cpn60 chaperonin family
  misc_feature: SWISSPROT Homolog: EC 2.7.1.68 1-phosphatidylinositol-4-phosphate 5-kinase
  misc_feature (163)..(163): Xaa is any aa, unknown, or other
MALHAPVLVMKDSMKRESGAKVHRANIQAAKAVADIIRTTLGPRSMLKMLLDAGGGIVVTNDGNAILREIDIAHPAAKSMIELSRTQDEEVGDGTTSVIVLAGEMLHVAQAFIDKSYHPTVICRAYTKALDDAIAVLDKIAMPVDVNDRAAMLGLVKSSIGTXFTGQFGDLIADLAIDATTTAGVDLGQGMREVDIKKYIKVEKVPGGQLEDSTVLKGVMINKDVVAPGKMRRKIVNPRIILLDSPIEYKKGENQTNAELMKEEDWQVLLEMEEEYIKNLCAQILKFKPDLVITEKGLSDLAIHYLSKAGVSVIHRLRKTDNNRIAKACGAVIVNRPEELQESDVGTGAGLFEVKKIGDEFFSVVGD

SEQ ID NO: 35537 - DNA, 1102 bp, Panicum virgatum
  misc_feature: Ceres CLONE 1962020
  misc_feature: Encodes the peptide sequence at SEQ ID NO. 35538
aatgctgcgccgcaaccccacccgcatcgagctccgctcctccgaccgcgacgagctcgaggaccaccaccgcgccgccgccggcaccaccccaccatccaccggctacaccacgccgcccccgcacaccacctcctcctcctcaaacaccctcctccacctcctccacccgccgcccggcgccgcgccttccaaggcccagcgcatcggcatctccaccaccaccaccaccccctccaacccacccaggccctcatagctcccccctcacacccccccaagtccatccccatggaggtcgagatcaagctccgcctccccgacgccgccgcccaccgccgcctctcctccttcctcgcgcccctcctcagccgcacccacgcccagcgcaacctcttcttcgacgccgccgcgcggaccctcgccgccgccaccgccgcgctccgcgtccgcctctacggatccgacgaccgcgcggtgctcgcgctcaagcgccgccccagcatcgacgccggcgtcagccgcgtcgaggaggtcgaggagccgctcgaccccgccctcgccctcgcctgcgctggcgaccccgcgcgcctcggcggggtcgactccccgatcctccgcctcgtcgccgccgagtacggcgtcggggggcacgccgcgcccttcgtctgcctcggcgggttccggaacacgcgcgccgtctacgagctccaggacgagggcctcgtgctggagctggacgagacgcggttcgacttcgggaccagctacgagctcgagtgcgagacggccgaccctgaccgggtcaaggaggtgctggagcgcctgctcacggtcgccggcgtgccgtaccagtactcccggagcaataagttcgcctgcttcatggcagggaagctgcttccttgagtaggcatgtacgtgtttgttcttggtagtattctcatcgctagattaaacaacttacttttcgaagaagattaaacaacttagtcacagagcaacattttgattaaggaaggaaggacttctcaatttgtatcgaattgatgtaaaatccttgaatttaataaaatttcccctatcgtaaaaagggcttctc

SEQ ID NO: 35538 - protein, 205 aa, Panicum virgatum
  misc_feature: Ceres CLONE 1962020
  misc_feature (1)..(202): Pfam Name: CYTH Pfam Description: CYTH domain
MEVEIKLRLPDAAAHRRLSSFLAPLLSRTHAQRNLFFDAAARTLAAATAALRVRLYGSDDRAVLALKRRPSIDAGVSRVEEVEEPLDPALALACAGDPARLGGVDSPILRLVAAEYGVGGHAAPFVCLGGFRNTRAVYELQDEGLVLELDETRFDFGTSYELECETADPDRVKEVLERLLTVAGVPYQYSRSNKFACFMAGKLLP

SEQ ID NO: 35539 - DNA, 1676 bp, Panicum virgatum
  misc_feature: Ceres CLONE 1962033
  misc_feature: Encodes the peptide sequence at SEQ ID NO. 35540
  misc_feature (1597)..(1597): n is a, c, t, g, unknown, or other
accgaacatcaacgcgacatcgtcatgctgcaagtttcttctcctccaggccggacgttcgagaccagggatccgcgctcgggggacgtcatcgctagcgtcgccgaaggtgacagggaggacgtcgacttggccgtgaaggcggcgagggacgccttcgaccatggcgagtggcctcgcatgtccggatccgagcgcggccggatcatgacgaggttcgccgagctggtggagcggcacgcggacgcgctggcggcgctggagagcctggacggcggcaagctcccggccgtgaccaaggcggtggacatcggcaacgccgccggcagcctgcgctacttcgccggcgcggccgacaagatccacggcgagacgctcaagatgcggggccagttccagggctgcaccctgcgcgagccgctcggcgtcgcggggctcatcatcccctggaacttccccaccaccatgttcgccatcaaggtggcccccgcgctggccgccggctgcaccgtggtcgtcaagcccgccgagcagacgcccctcagcgccctcttcctcgccgacctggccaagcaggcggggatccccgacggggtgatcaatgtcgtgccaggcttcggcccaacggcaggagctgcgatcgcgtcccacatggacgttgacacggtcagtttcaccgggtcgacggaggtggggcgcctcataatggaggcctcggcgaggagcaacctgaagccggtgtccctggagctgggcggcaagtccccgctcatcatcttcgacgacgccgacctcgacatggccgtcgagctcgccatcagcgcaaacttcttcaacaagggggaagcctgcgtcgccgcgagccgcgtctacgtgcaggagagcgcctacgaccggttcgagaagaagctggcggagaggatgaggagctgggtggtgggagaccctctgaacgatcctcgtgtcgaccagggccctcaggtggacaaggctcagtacgagagggtgctgagctacattgagcatggcaagagagagggcgccacccttctgacaggaggaagaccctgtggccagaaaggctactacatccagccggcagttttcaccaacgtcaaggaggacatggtcatagcaaaagaggagatcttcggacccgtcatgtgcctgatgaagttcaagacggtggaggaggcgatcgcgagggcgaacgcgacccggtacgggctgggcgcgggggtggtgacgcgggacatggacgtggcgagccgggtggtgcggtcggtgcgcgccgggctggtgtgggtgaactgctacttcgccctctccaacgactgccccttcggcgggcgcgggatgagcggcttcggcggggacgagggcatgcaggcgctcgacaagtacctcgccgtcaagtgcgtcgtcgccccgctccgcggactcgccgtggatgtgattccgatcgccgggccgcgtcgtgcggtgcaacgccgcgccgccggctgttaagaagtacgagtcctggtagggttgaagaagaagaataaagtgatgggaaaaaaaactgagatctgtatatgttggtaccaattggtgncgttctgcgttcatgtacagggtattcttcttctttctcgttttaggcctccattcggaacaggggatttatttccgtt

SEQ ID NO: 35540 - protein, 494 aa, Panicum virgatum
  misc_feature: Ceres CLONE 1962033
  misc_feature (4)..(466): Pfam Name: Aldedh Pfam Description: Aldehyde dehydrogenase family
  misc_feature: SWISSPROT Homolog: EC 1.2.1.3 Aldehyde dehydrogenase (NAD(+))
  misc_feature: Functional homolog of the protein sequence given in SEQ ID NO 50591
  misc_feature: Useful for making plants with altered carbohydrate content
MLQVSSPPGRTFETRDPRSGDVIASVAEGDREDVDLAVKAARDAFDHGEWPRMSGSERGRIMTRFAELVERHADALAALESLDGGKLPAVTKAVDIGNAAGSLRYFAGAADKIHGETLKMRGQFQGCTLREPLGVAGLIIPWNFPTTMFAIKVAPALAAGCTVVVKPAEQTPLSALFLADLAKQAGIPDGVINVVPGFGPTAGAAIASHMDVDTVSFTGSTEVGRLIMEASARSNLKPVSLELGGKSPLIIFDDADLDMAVELAISANFFNKGEACVAASRVYVQESAYDRFEKKLAERMRSWVVGDPLNDPRVDQGPQVDKAQYERVLSYIEHGKREGATLLTGGRPCGQKGYYIQPAVFTNVKEDMVIAKEEIFGPVMCLMKFKTVEEAIARANATRYGLGAGVVTRDMDVASRVVRSVRAGLVWVNCYFALSNDCPFGGRGMSGFGGDEGMQALDKYLAVKCVVAPLRGLAVDVIPIAGPRRAVQRRAAGC

SEQ ID NO: 35541 - DNA, 739 bp, Panicum virgatum
  misc_feature: Ceres CLONE 1962034
  misc_feature: Encodes the peptide sequence at SEQ ID NO. 35542
attcatcatcagcacaatcgatcgatcacacggctgcgaatcgcgagagagctaggcgaatacaatagcaatgcacggggtgaggaagaaggcctcgccgtcgccgtctttggtggtggtcctggccctggtcctgtcgtcggcggcggcggcggtctccggccagccgcagccggcggggaagcagacggcggcgaacaacccgcggctgcagcgggcgtacgtggcgctgcaggccctgaagcgcgccatcacggaggaccccaagaacctgacgcgcgggtggtgcggccccgacgtgtgcgcctacttcggcgtgttctgcgcgccggcgccggacgacccgcacgcgctcaccgtcgccgggctggacctgaaccacggcgacctcgcgggcacgttcccggaggagctgggcatgctgtcggacctcgcgctgctgcacctcaactccaaccgcttcgccggcgggctgccggagtcgctgcccaagctgcacctcctccacgagctggacgttagcaacaaccgcctctccggcggcttcccgcagcacatcctctgcctgcccaacgtcaagtacgtcgacctccggttcaacaacctgtgcgggcccgtgccgccggccatcttcgacaagccgctcgacgcgctcttcctcaacgacaaccacttcgacttcgagctgccggagaacctcggcaactcggccggcgtcggtcgtcgtgctcgccaaccc

SEQ ID NO: 35542 - protein, 222 aa, Panicum virgatum
  misc_feature: Ceres CLONE 1962034
  misc_feature: SWISSPROT Homolog: EC 2.7.11.1 Non-specific serine/threonine protein kinase
MHGVRKKASPSPSLVVVLALVLSSAAAAVSGQPQPAGKQTAANNPRLQRAYVALQALKRAITEDPKNLTRGWCGPDVCAYFGVFCAPAPDDPHALTVAGLDLNHGDLAGTFPEELGMLSDLALLHLNSNRFAGGLPESLPKLHLLHELDVSNNRLSGGFPQHILCLPNVKYVDLRFNNLCGPVPPAIFDKPLDALFLNDNHFDFELPENLGNSAGVGRRARQ

SEQ ID NO: 35543 - DNA, 702 bp, Panicum virgatum
  misc_feature: Ceres CLONE 1962037
  misc_feature: Encodes the peptide sequence at SEQ ID NO. 35544
gaaatgccacaattgtctcactctgctagcccgtgaatccttccttgccaaatggtcaaatcccctgaccaacaaatcgatcctcctcccctgacggcagccgggaactcgtgcctcctcctgccgccgccagagtcctcacccactcgacaggacttgccgtcggagtggggatccttccatacttcgattgatttttctcgcatcacagatggctgctgggaggggcatgggcatcagccagctcttgaagaaagcatttcgccaccatccatctggtccatttctgccttcttcaccccggataaatcatgaggagtccgttggattcattggattgagagcattgtctattcttggggttggtgcttctggccttttaagctttgctacgatagcatctgcatcatatgaagcagagcacggattggaagccccaagctatccctggccacatgctggcattcttagctcttatgatcatgcatcaataaggcgtggacatcaagtttatcaacaagtgtgtgcctcctgtcactcgatgtccttgatttcataccgggatctggttggtgttgcctatacggaagaggaaacaaaggcaatggctgctgagattgaggtggtcgatggtcctaatgatgaaggcgaaatgttcacacgcccgggtaagctaagtgaccgtttttcacaaccatatgc

SEQ ID NO: 35544 - protein, 163 aa, Panicum virgatum
  misc_feature: Ceres CLONE 1962037
  misc_feature (74)..(163): Pfam Name: Cytochrom_C1 Pfam Description: Cytochrome C1 family
  misc_feature: Functional homolog of the protein sequence given in SEQ ID NO 51401
  misc_feature: Useful for biocontainment applications
  misc_feature: Useful for making plants with modulated biomass
MAAGRGMGISQLLKKAFRHHPSGPFLPSSPRINHEESVGFIGLRALSILGVGASGLLSFATIASASYEAEHGLEAPSYPWPHAGILSSYDHASIRRGHQVYQQVCASCHSMSLISYRDLVGVAYTEEETKAMAAEIEVVDGPNDEGEMFTRPGKLSDRFSQPY

SEQ ID NO: 35545 - DNA, 686 bp, Panicum virgatum
  misc_feature: Ceres CLONE 1962038
  misc_feature: Encodes the peptide sequence at SEQ ID NO. 35546
acgcggccacgccggacagtcggaggccgcagatggagaacgcggtggtgctccgggagtggttcgaccgcgtggacgccagccgcaccgagcgaacatcaccgctcctcagctccagagcgctctcgccgtgggcgaccttgacttccctctctccgtcgtgcaccacatgataaggatgtatgactttgatcggaacggaaccatgagcttcgaagagtttctggctcttaacaagttccttcacaaggtgcagagtgtcttcttcaccctacaaaggtatttgtgtttcatgtgttatagaaatagtgtcatgtctagcacagaagatgttgatgtgcttacttaagcatgtgtcataatatacattttcatgagttttagtgtgcttcttaagaacctataactaatacttatgtatgtgatatgttgtagctaggctagaaagatgataattcaacatgttctttaagctagaaaacactactgtatttccttgtgaaatatgaagtttccttgggcatctcctcatgaccccatccataacaacctccataaagttgcatgtcagcaaaactccatccttccattgcacctaagtgctttgtttcagttgaaggtatttttattatcctcgatgctggctttttgtttaggagacaaatgacacatgctggacaagtctc

SEQ ID NO: 35546 - protein, 115 aa, Panicum virgatum
  misc_feature: Ceres CLONE 1962038
  misc_feature (53)..(81): Pfam Name: efhand Pfam Description: EF hand
RGHAGQSEAADGERGGAPGVVRPRGRQPHRANITAPQLQSALAVGDLDFPLSVVHHMIRMYDFDRNGTMSFEEFLALNKFLHKVQSVFFTLQRYLCFMCYRNSVMSSTEDVDVLT

SEQ ID NO: 35547 - DNA, 1234 bp, Panicum virgatum
  misc_feature: Ceres CLONE 1962044
  misc_feature: Encodes the peptide sequence at SEQ ID NO. 35548
atagaactcccgtcctccttcctccgtcaccgctccgccgccgccccttcctgctcgcggtccgcctcgtcgccgccatgggcaaggcctccaaggacaagagggacatctactaccggaaggccaaggaggaaggatggagagctcgcagcgccttcaagctcctccagatagaccaggagttcaacatcttccaaggagtgaaacgtgtggttgatctgtgtgctgctcctggaagctggagccaggttttgagccggaacctgtatgtaccagcaaaacagtcccctgatttcaaggaaggcgaccttcctctcattgttgcaatcgacttgcaaccgatggccccgatagaaggtgttatacaagtgcagggagacatcactaatgctcggacggctgaagtggttattagacattttgatggatgcaaagcagatttggttgtttgcgatggtgctcctgatgttactggccttcatgatatggacgaatttgttcagtcccaacttatacttgcggcacttacaatcgtgactcatgtactcaaagttggtggaaaatttgttgcgaagatcttccggggtaaagatacaagtctcttgtactgccagctaaaattgttcttctcacaagttacatttgcgaagccgaaaagtagccggaactcaagcattgaggcgtttgcagtttgtgagaattattcacctcctgaagggtttaaggaggaagatctttaccacctgctagaaaaagtggggactccttcaggagctgacgatttagattgcagaagcggatggctcgagggacctaacaaggtctacattccatttctggcctgcggggatctcagcggttacgactcagaccgatcatacccgctcccgagcacagaagggggctcctacaggagcttggatccggtccagcctcccatcgccccgccttacaaaaccgccctggagatgaagaaggcttccagccacggtgctagtgtagataccatcagaccatctgcggactcttgaattttgatatgcatgcaggaattgagataccatcagcccatttgttttcatgcaaccaccgtgttaaatgctgtaggaattgagacattatctggctatgatgtgttgcccaacactgctagtatagaaaatgatgaggtgaaacttgcgctggatcttggattttggatcctccgaacctcatgtgagaaaatttagaatcc

SEQ ID NO: 35548 - protein, 317 aa, Panicum virgatum
  misc_feature: Ceres CLONE 1962044
  misc_feature (21)..(211): Pfam Name: FtsJ Pfam Description: FtsJ-like methyltransferase
MGKASKDKRDIYYRKAKEEGWRARSAFKLLQIDQEFNIFQGVKRVVDLCAAPGSWSQVLSRNLYVPAKQSPDFKEGDLPLIVAIDLQPMAPIEGVIQVQGDITNARTAEVVIRHFDGCKADLVVCDGAPDVTGLHDMDEFVQSQLILAALTIVTHVLKVGGKFVAKIFRGKDTSLLYCQLKLFFSQVTFAKPKSSRNSSIEAFAVCENYSPPEGFKEEDLYHLLEKVGTPSGADDLDCRSGWLEGPNKVYIPFLACGDLSGYDSDRSYPLPSTEGGSYRSLDPVQPPIAPPYKTALEMKKASSHGASVDTIRPSADS

SEQ ID NO: 35549 - DNA, 623 bp, Panicum virgatum
  misc_feature: Ceres CLONE 1962050
  misc_feature: Encodes the peptide sequence at SEQ ID NO. 35550
aaggtcgaaactcgaaacacggtcagaagccggcgccgatttacggtttactcgcccgccgaccgaccaccgcgacgcgcctctcgctcctcgctttctcccctcctctctctgccccgccctgcgcccacttctccggcgagggaatcaacagcccgcgtgaagcacacgcgccgctccggggaggggcctccgatccgttccgtccccccgtgcccgcggcgcccatggagaaggtgaagaacctgctgaagccgcggccgacgccgcagcagcagctgcgcgagtggcaacgccgcctccgcaacgagtgccgcgtcctcgaccgccagatccgagatgtgcagcgggaggagaagaatgtggagaaagccatcagggaggctgccaagcgcaacgacatgggatccgcaaaggcacttgctaaggaacttgtacgatcaagacgtgctgttaatcgtctttatgaaaacaaggcccagctgaactcagtatcaatgcaccttggagaaattgttgcaactgcaagaacagtgggccatctgtccaagagtgctgaagtgatgaaaattgttaataatctaatgaaagctccagagttggctgccactatgcaagaattt

SEQ ID NO: 35550 - protein, 131 aa, Panicum virgatum
  misc_feature: Ceres CLONE 1962050
  misc_feature (20)..(131): Pfam Name: Snf7 Pfam Description: Snf7
MEKVKNLLKPRPTPQQQLREWQRRLRNECRVLDRQIRDVQREEKNVEKAIREAAKRNDMGSAKALAKELVRSRRAVNRLYENKAQLNSVSMHLGEIVATARTVGHLSKSAEVMKIVNNLMKAPELAATMQE

SEQ ID NO: 35551 - DNA, 615 bp, Panicum virgatum
  misc_feature: Ceres CLONE 1962060
  misc_feature: Encodes the peptide sequence at SEQ ID NO. 35552
cgcgcctccccttgtactcgaaggctgcgcgacagtagtacgccactagcgcagcagcggttggccaccacccgacgccggaggaggcagcggcggcgcggcgatggcggggaagcacggccgcaacggctacgacgacgacaacgtcaaccccttcgcgggaggaagtgttccaccagccaccaattctcggctctcacctctatcgcatgaaccagctgatttctacaatgtagatattcctcttgattcaacaaaggatatgaagaaaaaggagaaagagctccaggctatggaagctgagctaaacaaaagagagagggaattgaaaaggaaggaagaggcggcatcccgagctggcattgtgatagaagagaagaattggcctccctttttccctctcatccaccacaacatttccaatgagatacctaaccatctacaaaggatgcagtatcttgcattttcgtcgtttttgggattgatagcatgcctattttttaatatcattgcaactacaacagcatggatcaaaggggaaggtgtaatcatctggttgcttgccattatctacttcatatctggtgcacctggggcctatgtgttatggtatcg

SEQ ID NO: 35552 - protein, 170 aa, Panicum virgatum
  misc_feature: Ceres CLONE 1962060
  misc_feature (90)..(170): Pfam Name: SCAMP Pfam Description: SCAMP family
  misc_feature: Functional homolog of the protein sequence given in SEQ ID NO 50850
  misc_feature: Useful for biocontainment applications
MAGKHGRNGYDDDNVNPFAGGSVPPATNSRLSPLSHEPADFYNVDIPLDSTKDMKKKEKELQAMEAELNKRERELKRKEEAASRAGIVIEEKNWPPFFPLIHHNISNEIPNHLQRMQYLAFSSFLGLIACLFFNIIATTTAWIKGEGVIIWLLAIIYFISGAPGAYVLWY

SEQ ID NO: 35553 - DNA, 590 bp, Panicum virgatum
  misc_feature: Ceres CLONE 1962065
  misc_feature: Encodes the peptide sequence at SEQ ID NO. 35554
aaccgagtctacgtaccacccatcccttcgcctccgcttccccagcgccagcggttcttgtataaactccaccaccccaggcctcgaggacgagcacaccgccatccagatccagccgcccttcccaccgccggaactccgcctcccttcgccgtcggccccgcccctcggatcggtcggcgtctcctcttgctgaatcactaaccggatggctgacggcgaggacattctgccccttgtctgtgacgatggcaccgggatggtcaagggtggttttgctggggacgatgcaccaagggccgtcttcccgagtatcgttgggcgccctcgccacactggtgtgatggtggggatggggcagaaggacgactatgttggcgacgaggcccagtccaagaggggtatcctcaccctgaaatacccgatcgagcatggtatcgtcagcaactgggatgatatggagaagatttggcaccacaccttctacaatgagctccgagtcgctcccgaggagcaccctgtgctgctgactgaggcacccctgaaccccaaggctaacagggagaagatgacccggatcatgtttgaga

SEQ ID NO: 35554 - protein, 127 aa, Panicum virgatum
  misc_feature: Ceres CLONE 1962065
  misc_feature (4)..(127): Pfam Name: Actin Pfam Description: Actin
  misc_feature: SWISSPROT Homolog: EC 2.7.10.2 Non-specific protein-tyrosine kinase
  misc_feature: Functional homolog of the protein sequence given in SEQ ID NO 50712
  misc_feature: Useful for making plants with modulated biomass
  misc_feature: Functional homolog of the protein sequence given in SEQ ID NO 50711
  misc_feature: Useful for making plants with modulated flowering time
MADGEDILPLVCDDGTGMVKGGFAGDDAPRAVFPSIVGRPRHTGVMVGMGQKDDYVGDEAQSKRGILTLKYPIEHGIVSNWDDMEKIWHHTFYNELRVAPEEHPVLLTEAPLNPKANREKMTRIMFE

SEQ ID NO: 35555 - DNA, 243 bp, Panicum virgatum
  misc_feature: Ceres CLONE 1962080
  misc_feature: Encodes the peptide sequence at SEQ ID NO. 35556
tttctatcttccatcagttcattttcattatatgtataggttgtagtggaaagggacacaggccgctccaggggatttggatttgtcacattttcagaacctcgggctgtggatgctgccattcggggaatgcataatggagaactggatggtcgaaatatctctgtgaacaaagctcagcctaggaactcggatgatggctatggctatggtggtggtggtggtggtggtggtggtggtggt

SEQ ID NO: 35556 - protein, 37 aa, Panicum virgatum
  misc_feature: Ceres CLONE 1962080
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50210
  misc_feature: Useful for making plants with modulated biomass
MHNGELDGRNISVNKAQPRNSDDGYGYGGGGGGGGGG

SEQ ID NO: 35557 - DNA, 469 bp, Panicum virgatum
  misc_feature: Ceres CLONE 1962090
  misc_feature: Encodes the peptide sequence at SEQ ID NO. 35558
tctggttctattaacattaggacatcgattaacatatttacctatgttgtttattcacctcccccccccccccccagaggaccttatcaaaactactccttgctttcaggaagctttaaagtgggtgactgatcagcctgcttggcaacgctcagaaggcagagatcatgtcattcctgttcatcacccatggtcatttaaatcagtccggagatttgtcaagaaggcaatatggcttctacctgatatggactcaactggcaactggtataaaccaggacaggtatatctggaaaaggatgtcatccttccatatgttccaaatgttgatcattgtgattctaggtgtgtattagaaactcagtccaaaagaagtatattgctgttctttcgaggaagactgaagagaaatgctggagggaagatccgcagtaatcttgtggaggaactaaaaagtgcagaagacata

SEQ ID NO: 35558 - protein, 155 aa, Panicum virgatum
  misc_feature: Ceres CLONE 1962090
  misc_feature: Functional homolog of the protein sequence given in SEQ ID NO 51258
  misc_feature: Useful for making plants with altered carbohydrate content
  misc_feature: Functional homolog of the protein sequence given in SEQ ID NO 51496
  misc_feature: Useful for making plants with altered cell wall content and/or composition
LVLLTLGHRLTYLPMLFIHLPPPPPEDLIKTTPCFQEALKWVTDQPAWQRSEGRDHVIPVHHPWSFKSVRRFVKKAIWLLPDMDSTGNWYKPGQVYLEKDVILPYVPNVDHCDSRCVLETQSKRSILLFFRGRLKRNAGGKIRSNLVEELKSAED

SEQ ID NO: 35559 - DNA, 702 bp, Panicum virgatum
  misc_feature: Ceres CLONE 1962090-R
  misc_feature: Encodes the peptide sequence at SEQ ID NO. 35560
agtgcagaagacatagttatagaagaaggctctgctggtgctcagggaaaaactgcagctcaggatggcatgcgcaagtctctcttttgcctgagtccagccggagataccccatcttctgcgcgtctgtttgatgcaattgttagtggatgtatcccagttataataagtgatgaactggagcttccttttgaaggaatacttgactatagggagatagcattgtttgcttcatcaagtgatgctttgcaacctggttggcttgtggagtacctaagaagaatggatgccacaaggataagagaaatgcaatctaatcttgtgaagttttccagacattttttgtattcaagtcctgctcagcctcttggaccagaagaccttacatggagaatgattgccggtaagcttttaaacatcaagttgcacatccgacgctctcaacgcgtggtcagagagtcaaggagcatatgtacatgtgaatgcagagttgggaacagcacgaggatgctttgaaccaattttttccctttgtgttctcacaattttaaaacttgtgtagcatagccaatttttagttgccaatagtgcgagctttgagttagttagttagttagggtttttttccgatgtatgtaactggggaaggttgtgacactaccatttgtgaaatgtgaaatcctgtcacgtctgagattttag

SEQ ID NO: 35560 - protein, 171 aa, Panicum virgatum
  misc_feature: Ceres CLONE 1962090-R
  misc_feature (1)..(107): Pfam Name: Exostosin Pfam Description: Exostosin family
  misc_feature: SWISSPROT Homolog: EC 2.4.1.224 Glucuronosyl-N-acetylglucosaminyl-proteoglycan 4-alpha-N-acetylglucosaminyltransferase
  misc_feature: Functional homolog of the protein sequence given in SEQ ID NO 51258
  misc_feature: Useful for making plants with altered carbohydrate content
  misc_feature: Functional homolog of the protein sequence given in SEQ ID NO 51496
  misc_feature: Useful for making plants with altered cell wall content and/or composition
SAEDIVIEEGSAGAQGKTAAQDGMRKSLFCLSPAGDTPSSARLFDAIVSGCIPVIISDELELPFEGILDYREIALFASSSDALQPGWLVEYLRRMDATRIREMQSNLVKFSRHFLYSSPAQPLGPEDLTWRMIAGKLLNIKLHIRRSQRVVRESRSICTCECRVGNSTRML

SEQ ID NO: 35561 - DNA, 652 bp, Panicum virgatum
  misc_feature: Ceres CLONE 1962101
  misc_feature: Encodes the peptide sequence at SEQ ID NO. 35562
attccgtttcagctataccagaagcagcttctcctatctccaattctccactcttcttcatcttccttgttagctcctttcttccacacctccaccttcctctcacactctcatctcacccctgaactgcgcgtgcagtgaagtggtgatcaaccaagatccgacaaccgtttccctgttttcttgatcaatttttgctgatttgttccctgcgtcgtggatcagagcactaccacccgcgttctttctgtcagggggatggtggtcctcgcgaagctcggggcgccgagcatgccaggttttatgttggacagaaggagactgatgttgatacctgcaattaccattggcatcgcctcctgtcagtacacatttgagaaagcagcggcaaaagctgaatttgctgatatgcctgcacttcgtggtaaagattatggaaagacaaaaatgcggtatccagattacactgaaacagaatcaggtctccagtacaaggacttgcgggttggtgacggcccttccccaaaaaagggggagattgttgtggttgattgggatggctatacaattggatactatggtcgtatttttgaagctaggaacaagacgaaaggaggctcgtttgagggtggtgacaaagacttcttcaagt

SEQ ID NO: 35562 - protein, 131 aa, Panicum virgatum
  misc_feature: Ceres CLONE 1962101
  misc_feature: SWISSPROT Homolog: EC 5.2.1.8 Peptidylprolyl isomerase
MVVLAKLGAPSMPGFMLDRRRLMLIPAITIGIASCQYTFEKAAAKAEFADMPALRGKDYGKTKMRYPDYTETESGLQYKDLRVGDGPSPKKGEIVVVDWDGYTIGYYGRIFEARNKTKGGSFEGGDKDFFK

SEQ ID NO: 35563 - DNA, 728 bp, Panicum virgatum
  misc_feature: Ceres CLONE 1962103
  misc_feature: Encodes the peptide sequence at SEQ ID NO. 35564
acacagcacaagaagcaagctcgatcagtccaccaccaccacacgtctcaccacagtcagcaagctccgcttccgagccaccgcttcggccatggcccggcgggtgtcgtccctgctgctgctgggcgtgctggcggcggcggcggcggccagcttcgaccaggagttcgacatcacctggggcgacggccgcggcaagatccaggacggcggccgcctcctcacgctcacgctcgaccgcacctccggctccggcttccagtccaggcgcgagtatctcttcggcaagatcgacatgcagatcaagctcgtccccggcaactccgccggcaccgtcaccgcctactacctctcctcgcaggggagcacccacgacgagatcgacttcgagttcctgggcaacgtcaccggcgagccctacacgctgcacaccaacgtgttcacgcaggggcagggccagcgcgagcagcagttccgcctctggttcgaccccaccaccgacttccacacctactccatcctctggaaccccaagcacatcatcttcatggtggacgacctgcccatcagggacttccggaacctggagagcaaggggatcgcgttccccaagagccagcccatgcgcctctactccagcctctggaacgccgacgactgggccacgcagggcgggcgcgtcaagacggactggtcccacgcgcccttctccgcctctaccggggctt

SEQ ID NO: 35564 - protein, 212 aa, Panicum virgatum
  misc_feature: Ceres CLONE 1962103
  misc_feature (22)..(203): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Functional homolog of the protein sequence given in SEQ ID NO 50903
  misc_feature: Useful for making plants with altered carbohydrate content
  misc_feature: Functional homolog of the protein sequence given in SEQ ID NO 50904
  misc_feature: Useful for making plants with altered cell wall content and/or composition
  misc_feature: Functional homolog of the protein sequence given in SEQ ID NO 50905
  misc_feature: Useful for making plants with altered lignin content
MARRVSSLLLLGVLAAAAAASFDQEFDITWGDGRGKIQDGGRLLTLTLDRTSGSGFQSRREYLFGKIDMQIKLVPGNSAGTVTAYYLSSQGSTHDEIDFEFLGNVTGEPYTLHTNVFTQGQGQREQQFRLWFDPTTDFHTYSILWNPKHIIFMVDDLPIRDFRNLESKGIAFPKSQPMRLYSSLWNADDWATQGGRVKTDWSHAPFSASTGA

SEQ ID NO: 35565 - DNA, 592 bp, Panicum virgatum
  misc_feature: Ceres CLONE 1962116
  misc_feature: Encodes the peptide sequence at SEQ ID NO. 35566
agccgagttccgcagagaaaggcgtcttcgtactcgcctctctccgcgcttcaaagcttctcctcccatttcccaccgccgccgccgccgccgcccacccttccaacgacaccatgagggagtgcatctcgatccacatcggccaggccggtatccaggtcggaaacgcgtgctgggagctgtactgcctcgagcatggcattcagcctgatggtcaaatgcccagtgacaagacagttggaggaggtgatgatgcattcaacaccttcttcagtgagactggcgctgggaagcatgtcccccgtgctgtgtttgttgatcttgagcccactgtcattgatgaggtgaggactggcacttaccgccagcttttccaccctgagcagctcatcagtggcaaggaggatgctgccaacaactttgcccgtggtcactacaccattggcaaggagattgttgacctatgccttgaccgcatcaggaagcttgccgacaactgcactggtctccagggcttcctcgtgttcaacgctgttggtggaggaacgggctctggccctggttccctcctccttgagcgcctgtctgttgg

SEQ ID NO: 35566 - protein, 159 aa, Panicum virgatum
  misc_feature: Ceres CLONE 1962116
  misc_feature (49)..(159): Pfam Name: Tubulin Pfam Description: Tubulin/FtsZ family, GTPase domain
  misc_feature: Functional homolog of the protein sequence given in SEQ ID NO 50141
  misc_feature: Useful for making plants with altered cell wall content and/or composition
MRECISIHIGQAGIQVGNACWELYCLEHGIQPDGQMPSDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGPGSLLLERLSV

SEQ ID NO: 35567 - DNA, 637 bp, Panicum virgatum
  misc_feature: Ceres CLONE 1962118-R
  misc_feature: Encodes the peptide sequence at SEQ ID NO. 35568
tgaatgctgatgggtctctgttcgacgctgcactgatttcagcagtggcttccttcacacatttggagattcctttagtttctgttggtgatgatggtagagtattcactgttggaggcaatgaagggaaaaccaaatttgaattggtaaacagagaaaagaggaagcttacacttggcgacattccattttcccttacgtgtgcacttcacaaggatagtattctagtggacccaacttctgaagaagaatcgataatagagacttatgtgactgttgttatagattcttcagaccgcatagtgtcagtacaaaaacttggaggtgcagtgacttccatgacagctgttaaggagtgcattagcttggctaaggaaaggaggcggaagttaagagagattctgaaagactctgttgacgtcatggaagttgaccaaactgaataagtctgcaaatggattcagttagtccagccggttatttgttggtggttctttggatgcctcggttgacctggttgtaacagcagttctgttgttttagctttctgtttagctagacgagcccaagtaagtatgtaacgatttgtaccctgcataggattccgcacttgaaaaagctgcttgatcttataagc

SEQ ID NO: 35568 - protein, 147 aa, Panicum virgatum
  misc_feature: Ceres CLONE 1962118-R
  misc_feature (60)..(126): Pfam Name: RNase_PH_C Pfam Description: 3' exoribonuclease family, domain 2
NADGSLFDAALISAVASFTHLEIPLVSVGDDGRVFTVGGNEGKTKFELVNREKRKLTLGDIPFSLTCALHKDSILVDPTSEEESIIETYVTVVIDSSDRIVSVQKLGGAVTSMTAVKECISLAKERRRKLREILKDSVDVMEVDQTE

SEQ ID NO: 35569 - DNA, 527 bp, Panicum virgatum
  misc_feature: Ceres CLONE 1962118
aagcagctgccacaaccacagccgtgagatggcggagaagaccgaaccggcggcggccgcggccagcgggctcgccggggagatggaggtagaggcgtaccgccgcctctttccgctggccttcctggagcgccacctccgggagtccgtccgccccgatgcccgccgcctctccgaggcccgccccaccaccgtcgccctcggcgccgtctcctccgcgcatggatccgctctcgtccgccttggcgacaccgccatgctcgcgtcagtctagctggaggtgatgtcacccccggccgaatcctcggatgaaggatccgtcgttgttgagttccatatgccacccatctgctccccgttggtcagaccaggccggcctgctgacgtggcaccagtcatttccaaggcccttgaggacgttctcatgagttctggaatgttgaatttgaaggagctctgtttgatcagtgggaaggcttcttggctagcatacctggatatctattgtttgaatgctgatgggtctc

SEQ ID NO: 35570 - DNA, 673 bp, Panicum virgatum
  misc_feature: Ceres CLONE 1962120
  misc_feature: Encodes the peptide sequence at SEQ ID NO. 35571
aagcgaggctgcagactggaagaccctctcagagagagagagaggagaccttgcagaggagcgaagcgaggtgggaaagaggcagcagcaagggcggcgggctgccggaaggggaacatgctccctcctcatctcacagaaaatggcacaataatgatccaatttggtcatcaaatgcctgattacaactccccagctacccaatcaactagcgagagtcatcaagaagtgtctggaatgagcgaaggaagccttaacgatcataatgatcaatcaggtaatcatgatggttactcgaagagtgatgaaaataagatgatgtcagctttatctcttggcaatccagaaacagcttatgcacatccaaaaactgaccgtagtcagtcctttgctatatcatacccgtatgctgattcatactatggtggtgcagtggcagcttatgggcagcatgctattatgcacccccagcttgtgagcatggtgtcatcctctcgagtgccgttaccaatcgaaccagctgctgaagagcccatttatgtgaacgctaagcaataccatgcaattctccgacgcagacagctccgtgcaaagttagaggctgaaaacaagctggtgaaaagtcgcaagccataccttcacgagtctcggcacctgcatgccatgaagagag

SEQ ID NO: 35571 - protein, 185 aa, Panicum virgatum
  misc_feature: Ceres CLONE 1962120
  misc_feature (137)..(185): Pfam Name: CBFB_NFYA Pfam Description: CCAAT-binding transcription factor (CBF-B/NF-YA) subunit B
MLPPHLTENGTIMIQFGHQMPDYNSPATQSTSESHQEVSGMSEGSLNDHNDQSGNHDGYSKSDENKMMSALSLGNPETAYAHPKTDRSQSFAISYPYADSYYGGAVAAYGQHAIMHPQLVSMVSSSRVPLPIEPAAEEPIYVNAKQYHAILRRRQLRAKLEAENKLVKSRKPYLHESRHLHAMKR

SEQ ID NO: 35572 - DNA, 752 bp, Panicum virgatum
  misc_feature: Ceres CLONE 1962127
  misc_feature: Encodes the peptide sequence at SEQ ID NO. 35573
aagaaccaaatcgatcgagacagtacagacgacgaaagcggaggaaaagccgaggcgcttcgccttctccgtcagatgagatgacaagatccgcgcgaaatccaaatccaatcgcgcacccgcctcctctgctcctgctcctgctcctgctggccgcgctcgccggcgtggccgccgccggggacatcgtccaccaggacgacgaggccccgaagatccccggctgcgccaacgatttcgtcctggtaaaagtgcagacctgggtcaacaagaaagagaaagatgaatttgttggtgtaggtgctcggtttggccccaagatagagtcaaaggaaaagcatgccaaccgaacaagactgttgttagcacagccttctgattgctgcacccctcccacagagaaggtttctggagatattttgttagtggagaggggactctgtaagttcactaaaaaagcaaaggttgctgaatctgctggtgcttctgccattataatcatcaatgataagcatgagttatacaagatggtgtgtgaccacaatgaaacagaactagatattggtatacctgcggttcttctgccaaaagatgcaggctctaaattacgaaatcttctctcaagtggtgaagtcttattgcagctgtactctccagatcgtcctctggttgatactgcagaagtgtttctatggcttagggcagttggtaccattctttgtgcatcatactgggtcagcaggggagtgccc

SEQ ID NO: 35573 - protein, 223 aa, Panicum virgatum
  misc_feature: Ceres CLONE 1962127
  misc_feature (84)..(180): Pfam Name: PA Pfam Description: PA domain
MTRSARNPNPIAHPPPLLLLLLLLAALAGVAAAGDIVHQDDEAPKIPGCANDFVLVKVQTWVNKKEKDEFVGVGARFGPKIESKEKHANRTRLLLAQPSDCCTPPTEKVSGDILLVERGLCKFTKKAKVAESAGASAIIIINDKHELYKMVCDHNETELDIGIPAVLLPKDAGSKLRNLLSSGEVLLQLYSPDRPLVDTAEVFLWLRAVGTILCASYWVSRGV

SEQ ID NO: 35574 - DNA, 679 bp, Panicum virgatum
  misc_feature: Ceres CLONE 1962133
  misc_feature: Encodes the peptide sequence at SEQ ID NO. 35575
aggaggcgcagcagatcgtcaatgcggctagggctgctaagtcggcaaggcttaagcaagcgaaagaggaggctgagagggaaatagctgaataccgtaaacagatggaggctgaattccagaggaaggttgcagagagcagcggtgactctggtgcaaatgtcaagcgtctcgagctggagacggcggcgaagatcgaacagctcaaccaacaggctgcaagcatctccccagaagtcatccagatgcttctgaggcatgtcaccaccgtgaagaactgagccttgctgtgcctgaaaatatgattggaagcttgtatcatctgtccatttattatttcggagagcgtggtgagaaataatttgacttatggctgtaattccttgaccacggaacggaataagctgctgcagtagagcagcaaccgtactggtactgtcagatcttgccttgtttggtatattggtaaatattttcttcatgttcaaaaaaaaaaaaaaaaaaaggggaccccgatttgtttcgttccccatcctcgcggccgctccatcgccgccgccgccgccgccgccctccgctccggtcgccgaagtccccgattcagatccagggcccgagagatggacgcgagcaggcgccagagcgggatccagcagctgctggccgcggagcaggaggc

SEQ ID NO: 35575 - protein, 92 aa, Panicum virgatum
  misc_feature: Ceres CLONE 1962133
  misc_feature (1)..(91): Pfam Name: V-ATPase_G Pfam Description: Vacuolar (H+)-ATPase G subunit
  misc_feature: SWISSPROT Homolog: EC 3.6.3.14 H(+)-transporting two-sector ATPase
EAQQIVNAARAAKSARLKQAKEEAEREIAEYRKQMEAEFQRKVAESSGDSGANVKRLELETAAKIEQLNQQAASISPEVIQMLLRHVTTVKN

SEQ ID NO: 35576 - DNA, 592 bp, Panicum virgatum
  misc_feature: Ceres CLONE 1962166
  misc_feature: Encodes the peptide sequence at SEQ ID NO. 35577
ataaaggaattgcgattcttacaccaagaggacgttatagtgttgagcttcatctgtcatttctacgactccaagggcaggctaatgactttaaaatccaatacagcagcattgttcgcctctttctttggccaaagtcaaacaatcctcatacatttgtggttatcactcttgatccaccaatccgtaaagggcaaacattgtatcctcacattgttattcagtttgagacagaggcagtacttgaaagagacctggcattgagtaaagagcttctagctgaaaaatacaaagacaggcttgaggaatcttacaagggtctaatacatgaggtatttaccaaagtccttcgtgggttatccggtgctaaagtcacaagaccaggttcttttagaagttgccaagatggatatgcagttaaatcttcactcaaagctgaagatggacttttgtatccacttgagaagggtttcttctttctgccaaagcctcctacactcatcctgcatgaggagattgagttcattgaatttgaacggcatggtgctgggggtgccagtatgtcatctcactattttgacctcctttgtca

SEQ ID NO: 35577 - protein, 196 aa, Panicum virgatum
  misc_feature: Ceres CLONE 1962166
  misc_feature (7)..(196): Pfam Name: SSrecog Pfam Description: Structure-specific recognition protein (SSRP1)
KGIAILTPRGRYSVELHLSFLRLQGQANDFKIQYSSIVRLFLWPKSNNPHTFVVITLDPPIRKGQTLYPHIVIQFETEAVLERDLALSKELLAEKYKDRLEESYKGLIHEVFTKVLRGLSGAKVTRPGSFRSCQDGYAVKSSLKAEDGLLYPLEKGFFFLPKPPTLILHEEIEFIEFERHGAGGASMSSHYFDLLC

SEQ ID NO: 35578 - DNA, 1308 bp, Panicum virgatum
  misc_feature: Ceres CLONE 1962176
  misc_feature: Encodes the peptide sequence at SEQ ID NO. 35579
gtgtaaaccagccgtgaggtcaccaagcaagccttgctctttccaagtcttttgaagacgaacccatcatggtaaaactgacggtctttcatcatgtcaaaaatacccgatcctatcgcgttctcgtgacagcgcgtttggctggtctcaaggttgagcttggaaaggttactgaagaaagccttgctcaactttctactttgaacgcagctggtcaagtgaatgcatatgattcacgtcttcctgcgttggttgttgagcaagaaggacaagaaaagcttgttgtttatcaagtgaatgccattctccgaacacttgctcgtttgggagataaagaaaagcttctctacgggaaaaacgatgttgaaagagccaagatcgactcatggttggacttctctgtgaacgaagtagactttcctgcgttatcttggacataccaagcagatgaattcatcccgaaaaatgactcgctgactactcaagtcaaaaagtaccttgagggagttcttgatgtactgaaccgagcccttcaatcctcgacctatcttgttggcgaccgtctctctttggccgacattgcactttctctatctttgtttcgggttctcacccagttgtttggatatgaggggaaaaaacactatccacatgtttatagatggtttttgacgtgcatgaatcaagatcagtttgtctcgattgttggcattgtcaagtttgaggactctacagctcgatctttctcttggtcatcaatatctacaaaggggaatgtttctggccagcttccatcccaagttcttgaggaggccaattggtcatctcaagacatccctcatgaggccttgattgtctccaaatttaccacaacaacattcaaaaaaaccaaagccactaatgactcccattcttctattgaacttggaaatggccaatcactgcatggatcaattgctattgcaagatacatatctcgcttaaatcctgcttattctttgtatcccactgatgcaaaactggttgcagaggtggagcaatgggtttatttaactcaaggaatccattctcaaccccctaagcattttagtgaggtggcatccacactcaacactcaactccaatcttccacatttctcaatgggaacactctcctcttctccgatattgctgcttgggcatcattcaaaaggcgaggaggactgaatgaggaggaaaaacataaatatcctcatgtctctcgttggtttactttcctttctctgcttccagcttttcagtaatttataaagatgtttgttgatctcg

SEQ ID NO: 35579 - protein, 404 aa, Panicum virgatum
  misc_feature: Ceres CLONE 1962176
  misc_feature (112)..(207): Pfam Name: GST_C Pfam Description: Glutathione S-transferase, C-terminal domain
MVKLTVFHHVKNTRSYRVLVTARLAGLKVELGKVTEESLAQLSTLNAAGQVNAYDSRLPALVVEQEGQEKLVVYQVNAILRTLARLGDKEKLLYGKNDVERAKIDSWLDFSVNEVDFPALSWTYQADEFIPKNDSLTTQVKKYLEGVLDVLNRALQSSTYLVGDRLSLADIALSLSLFRVLTQLFGYEGKKHYPHVYRWFLTCMNQDQFVSIVGIVKFEDSTARSFSWSSISTKGNVSGQLPSQVLEEANWSSQDIPHEALIVSKFTTTTFKKTKATNDSHSSIELGNGQSLHGSIAIARYISRLNPAYSLYPTDAKLVAEVEQWVYLTQGIHSQPPKHFSEVASTLNTQLQSSTFLNGNTLLFSDIAAWASFKRRGGLNEEEKHKYPHVSRWFTFLSLLPAFQ

SEQ ID NO: 35580 - DNA, 698 bp, Panicum virgatum
  misc_feature: Ceres CLONE 1962178
  misc_feature: Encodes the peptide sequence at SEQ ID NO. 35581
taccacctcttcaatcagcttttgcaagtccaacaagaccaaatcctgcagcaggaggtgaaacatgcgcagagacaggaataggtgtgttcttcagcaagataacaaaacttgccgccattagaatcagaagtctctgtgaaagattgcaactttctcagcaagttctggagcgagtgtatttcctcattcagcaaatccttagccaacaaactgctcttttcttcaacaggcatattgaccagatcatactgtgcagcatatatggagttgctaagatatctcaattggagctttcattcaaggagattattttcggctacagaaaacaacctcaatgcaagccacaagttttccgaagtgtttatgttcattggcccccaagatgcaggaacgggaaaacaggagaagatcatgtcgatattatcactttctacaatgaagtatttattcctgctgccaagcctttgctggtggaggtagggcctggtgctagtccaaacaagaaagaagaggaaaaaggttctgtagatgtaggtccatttccagaatctccacggctagctcggtttccaaaccttcctgacatgtctccgaagaaggtttctgctactcacaatgtatacgtctctccgctacgatcgtcaaagatggatattttgctctccccaagctcaaagagctactatgcatgtgtt

SEQ ID NO: 35581 - protein, 231 aa, Panicum virgatum
  misc_feature: Ceres CLONE 1962178
  misc_feature (25)..(155): Pfam Name: RB_B Pfam Description: Retinoblastoma-associated protein B domain
PPLQSAFASPTRPNPAAGGETCAETGIGVFFSKITKLAAIRIRSLCERLQLSQQVLERVYFLIQQILSQQTALFFNRHIDQIILCSIYGVAKISQLELSFKEIIFGYRKQPQCKPQVFRSVYVHWPPRCRNGKTGEDHVDIITFYNEVFIPAAKPLLVEVGPGASPNKKEEEKGSVDVGPFPESPRLARFPNLPDMSPKKVSATHNVYVSPLRSSKMDILLSPSSKSYYAC

SEQ ID NO: 35582 - DNA, 692 bp, Panicum virgatum
  misc_feature: Ceres CLONE 1962181
  misc_feature: Encodes the peptide sequence at SEQ ID NO. 35583
acctttcacagttcagagtttcattcttcttcctaacttcatctccaccgccattgctggtggccatccaagaggagagactagagagataggcagaggcaacaacacacggagacagctcgagcgcataggacacaggagaatgaggcttcgaggagctcttgctctgcttctgctcctctgcatccatggcggccgtcagggagcagcggccgggcgggacgggttcgtgagggtccagggcacccgcttcgtgctgaacggcaacccgttcttcgccaacgggttcaacgcctactggctcatgtccttgggcgccgaccccgcccagaggggcaaggtcacctccgcgctgggccaggccgccgccgccgggctctccgtgggcaggacgtgggcgttcagcgacggcggcggcaatgccgccctgcagtactcccccggccgctacaacgagaacaccttccaggggttggatttcgtgctgtctgaggcaaggaagcatgggattaagatgatactgagcctcgtgaacagctacgacagctttggagggaggaagcagtacgtgcagtgggcgagagagcaggggcagagcattggatctgacgatgagttcttcactaaccctgttgtcaagggcttctacaagaaccatatcaagctacgacagctttggaggaaggaagcag

SEQ ID NO: 35583 - protein, 183 aa, Panicum virgatum
  misc_feature: Ceres CLONE 1962181
  misc_feature: SWISSPROT Homolog: EC 3.2.1.78 Mannan endo-1,4-beta-mannosidase
  misc_feature: The sequence is a functional homolog of SEQ ID NO 2 in US patent 7148399
MRLRGALALLLLLCIHGGRQGAAAGRDGFVRVQGTRFVLNGNPFFANGFNAYWLMSLGADPAQRGKVTSALGQAAAAGLSVGRTWAFSDGGGNAALQYSPGRYNENTFQGLDFVLSEARKHGIKMILSLVNSYDSFGGRKQYVQWAREQGQSIGSDDEFFTNPVVKGFYKNHIKLRQLWRKEA

SEQ ID NO: 35584 - DNA, 593 bp, Panicum virgatum
  misc_feature: Ceres CLONE 1962181-R
ggtatcgcacgcagtaatttgcaccgtttttttttttgtgccgaggttcatttctagcgtcgctacttattagtaggagagacttcccttgtttgctgaaacgattggctcaatcgctgtttctttttttgacaatatttggacgattaccgtgttcttctttttttggagttgggagtaaaagcgccctgcttatttggttgttggcttgttgctccatttaggccctaataaatgctacctactgatagtgccgataaaggtagaagattcagctccggatataggctattatttcatttctttttaattcgggaatatatcacgtgcaaaccaatttttttcgtgcaaaccattcaaacttcaataaaaaggcatgaggaattgaataattttacaattaaccgcccactcttagattaggtaatcacagttttgcaaatcccctcccacctccctacgcctctcttcttggatgttgattcgatggcccagattgaaatttgcatggtttatatggagagggttgtttgcccctaatatgttcccttttaattcagctctaatatattgctattatttcattccttgtt

SEQ ID NO: 35585 - DNA, 535 bp, Panicum virgatum
  misc_feature: Ceres CLONE 1962190
  misc_feature: Encodes the peptide sequence at SEQ ID NO. 35586
agagaaagggcagcagaaaccagagcactaggcatcgcatttggtacgctcgctgctggtcgcacgtacgaagcccacgcgtacccgcccggggcacgtgccagaactcgccacgcgggcgcgcgccggcggagatgacgcggcggtgctcgcactgtagcaacaacggccacaacgcgcgcacctgccccgctcgctccgctgccgccggcggcggcggggtgaggctgttcggcgtgcatcttacgtcggcgccggcgccggcggcgatgaagaagagcgctagcatgagctgcatcgcggcgtcgctagggggcggttccgggggctcctcgccgccggcggaaggagcaggcggtgacgggtacgtgtccgacgaccccacgcacgcatcctgctcgatgagtggccgcgccgagcgcaagaaaggtacaccttggactgaagaagaacatagaatgtttctgatgggtctgcacaggcttggaaagggacattggcgtgggatatctcgtaactttgttgtctctagaac

SEQ ID NO: 35586 - protein, 133 aa, Panicum virgatum
  misc_feature: Ceres CLONE 1962190
  misc_feature: The sequence is a functional homolog of SEQ ID NO 1045 in the 11/479,226 US patent application
  misc_feature: The sequence is a functional homolog of SEQ ID NO 452 in the 10/412,699 US patent application
  misc_feature: The sequence is a functional homolog of SEQ ID NO 317 in the 11/479,226 US patent application
  misc_feature: The sequence is a functional homolog of SEQ ID NO 1023 in the 11/479,226 US patent application
  misc_feature: The sequence is a functional homolog of SEQ ID NO 440 in the 10/412,699 US patent application
MTRRCSHCSNNGHNARTCPARSAAAGGGGVRLFGVHLTSAPAPAAMKKSASMSCIAASLGGGSGGSSPPAEGAGGDGYVSDDPTHASCSMSGRAERKKGTPWTEEEHRMFLMGLHRLGKGHWRGISRNFVVSR

SEQ ID NO: 35587 - DNA, 651 bp, Panicum virgatum
  misc_feature: Ceres CLONE 1962192
  misc_feature: Encodes the peptide sequence at SEQ ID NO. 35588
ctggcttcgcaacggcgccctgcggcggcggccgccactccttccttgctgcggagacgccctcgttgcggccactcctccatcaatctttcacatatatacatacttactcgactctcgccgcgacggcagtcctcgactccaggcggcaggctcgtgggggcccgattgctgcctccccagctagggctcgccgtcgcccaccctcactcagggacggtcgccctccgcccgctcctcctagtaactggggcggagccagcactagcaatcagaagcggggagatccccaggaactcggcggcggcgccgcaggccgcaaggcagagcagcaaaccggccgagtagcgggttccaaaatgagcgacggcgtgatatggcactgcatccggcacaaccactgcagcttcatggctaagattacgacagggatattttgccggaatccctacaacgctacgggcatatgcaaccggagctcctgccctcttgccaacagtcgttatgccaccatccgggatcatgacggtgtcttctatctgtacatgaaaactgctgaaagagctcatctgccaaacaaattatgggagagagtcaaactgccaaggaattatgagaaagcaatggatgtcattaacaagcatcttgaat

SEQ ID NO: 35588 - protein, 97 aa, Panicum virgatum
  misc_feature: Ceres CLONE 1962192
  misc_feature (1)..(97): Pfam Name: Mak16 Pfam Description: Mak16 protein
MSDGVIWHCIRHNHCSFMAKITTGIFCRNPYNATGICNRSSCPLANSRYATIRDHDGVFYLYMKTAERAHLPNKLWERVKLPRNYEKAMDVINKHLE

SEQ ID NO: 35589 - DNA, 1303 bp, Panicum virgatum
  misc_feature: Ceres CLONE 1962204
  misc_feature: Encodes the peptide sequence at SEQ ID NO. 35590
ctgctcagaaatctttccctttccttagccttccttgatgcctgcagattctttgacagaccgcaacgaagtgctagtgttcaacacacacatacacacgcacatctctccctcctctctctctctctcacagagaagagagagaagctgtcagctggtatcatatcatctctctaactgcacgaaagcaaaagttccaatgatgcattccatcacatagagagcctcgagccaagaacgccgtgtgcttgtgtgtgtgtgtgcgtctgtgactgtacgtggcagcacgcacggccatggcagccaccaagagatccttccacggcgccgtcgacggcattgcccgcgccgtggcggagcaccagctgcaggccgaccggcaggaggaaggcgccgctagcaggatgatcttcggcggccgagcagtgggcccggtcggcgtcgaggaagagccgccgcgggccgcggtcccggagctcgcagtaccgcggcgtcaccttctaccgccgcaccggccggtgggagtcccacatctgggactgtgggaagcaggtgtacttgggtggatttgacaccgcacatgctgctgcaagggcctatgaccaagctgcaatcaagttccgcggcgtgaacgcggacatcaacttcaccctgagcgactacaaggatgagataaagaagatgaagaacttcagcaaggaggagttcgtccaggtgctccggcgacagggcgccggcttcgtcagggggagctccaggttccggggagtcacccagcacaagtgcggcaagtgggaggccaggattggccagctcatgggcaagaagtatgtgtaccttggcctctatgacacggagatggaggctgcgcaggcttatgacaaggctgccatcaagtgctacggcaaggaggcagtgaccaactttgagccccagacgtacgacgaggagctccaagtgcagtcttgggacggtgagctcgacctcgagctcagcctcggctgcgccggcagcgacctttccaccgtcgccgtcgaggcgtgcagctccgcgccgagcaggcagaggacgatgaccctgacgctcgacctgccggaggacgacgaggagacgggcgccggctaccctcacgggagcatccgcaccatgccttccccgagtccgggcacgttccggctcctccccctggccgacgatcacgctcaccaccccggcgccggcggcagggatgacacggcgcacatgctccagatgggccaggtcggcagcagtggaggcgcggcagcggcacacatgcgctggc

SEQ ID NO: 35590 - protein, 207 aa, Panicum virgatum
  misc_feature: Ceres CLONE 1962204
  misc_feature (25)..(76): Pfam Name: AP2 Pfam Description: AP2 domain
  misc_feature: Functional homolog of the protein sequence given in SEQ ID NO 51168
  misc_feature: Useful for making plants with modulated biomass
MKNFSKEEFVQVLRRQGAGFVRGSSRFRGVTQHKCGKWEARIGQLMGKKYVYLGLYDTEMEAAQAYDKAAIKCYGKEAVTNFEPQTYDEELQVQSWDGELDLELSLGCAGSDLSTVAVEACSSAPSRQRTMTLTLDLPEDDEETGAGYPHGSIRTMPSPSPGTFRLLPLADDHAHHPGAGGRDDTAHMLQMGQVGSSGGAAAAHMRW

SEQ ID NO: 35591 - DNA, 601 bp, Panicum virgatum
  misc_feature: Ceres CLONE 1962204-R
gggcgccgccgtacgccaccgcccgggccgacgacgacgacgacgacgccgccgctgcagcatcatcaggattcccaccggggcagctgggccgccgctgcaggaggcagcagccgcccgcggcgtccaggcccagccgctgagcctgcccagcaccagcaacagtggcactgagcgccactggcggcctgaaagattctagcgagagccgccgtaagcctcggccgccgggtcgttcccttttccgggtcggcaagggtggcagcgaggtgagcagcatcatccctgcgcccgtggcaggcgcggcggcccaccgcccaccgcggccggccggccgggaggaacaattccgacgccgggatgtagctgtagggaggaaatgggggtcactgtggcgacaagaacgctgacgggtagtcaggctggaaagtttggagcagttttgagcaacgagggctcgaaattttctgacctgaaatagatcagacttgggtgaccgtagttcgttttgttgttgttgttgttggcaccagtgattctactaatctagtactattcttagagtatgcgtggtgctgctctagggctgttgaatggatgg

SEQ ID NO: 35592 - DNA, 1214 bp, Panicum virgatum
  misc_feature: Ceres CLONE 1962214
  misc_feature: Encodes the peptide sequence at SEQ ID NO. 35593
accgcatcattccttccggctgccgtcgctttcgccgccccagctcgtgcgctccccacccgggctcgctcgcctctcgcgacagcggccgaaccctccacccgattccttacccccctccgctgcttcgcccgcccgcccgcctccagccgagagctcccgtcccgagggtttcaggccgcttggcccctagcgccccgtcgtcttcccgggccgccgcttttaggtgcgacctccgcatctcgtccagacggaggcggggtggatcgctgggttttccttccctcggagatcgcatctctggcccgcgggatccgatgagatgcgggagcggcctcgcgctccgagctcctagcaggcatggctgaagcggcggcggcggcggcgtcctcgtccttgcccggatcctccgccccgcgccgcctccatggcgccggcgtcgtcagggacgcgctcccgtacggtggcctcgccgccccgcccccgccgccgccgccgttgcagcagcagctgccgccgccggtggcgcagcaggcgcaggccgcgggtggcggaggtggaggcgggggcggagggaagattagccccgcggtgctcttcatcatcgtgattctcgccgtggtgttcttcatctccggcctgctccacctcctcgtgcgcgtcctcacgaagaagcagcaccgccgcggcggcggccgaggcggccccgcgtcggcgtcggcggcggcgcggggggatgccggctgtgcggacgcggcgctgcagcggcagctgcagcagctgttccacctccacgactccggtctggaccaggccttcatcgacgcgctgcccgtcttcgcctaccaggagatcgtcgtgggcggcggcggcgacggcgacaaggagccgttcgactgcgcggtgtgcctgtgcgagttcgacgccgaggaccggctccgactgctgccgctgtgcgggcacgccttccacctcaactgcatcgacacctggctgctctccaactccacctgcccgctctgccgcggggtgctcttcgccccggggctcatgggcgacgacaaccccatgttcgatttcaaggagaggctcgaggaagggaggctgtcggaggaattgcgacgacgggtttggattgcctgggcagaaggcttcagggttagcacagacaccggcggctgagaagaggggtgttccccgtgaggctggggaat

SEQ ID NO: 35593 - protein, 273 aa, Panicum virgatum
  misc_feature: Ceres CLONE 1962214
  misc_feature (180)..(221): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MAEAAAAAASSSLPGSSAPRRLHGAGVVRDALPYGGLAAPPPPPPPLQQQLPPPVAQQAQAAGGGGGGGGGGKISPAVLFIIVILAVVFFISGLLHLLVRVLTKKQHRRGGGRGGPASASAAARGDAGCADAALQRQLQQLFHLHDSGLDQAFIDALPVFAYQEIVVGGGGDGDKEPFDCAVCLCEFDAEDRLRLLPLCGHAFHLNCIDTWLLSNSTCPLCRGVLFAPGLMGDDNPMFDFKERLEEGRLSEELRRRVWIAWAEGFRVSTDTGG

SEQ ID NO: 35594 - DNA, 734 bp, Panicum virgatum
  misc_feature: Ceres CLONE 1962215
  misc_feature: Encodes the peptide sequence at SEQ ID NO. 35595
aaatctgaaactccaaggcatagccagagcccagaggcaaccatggagcagcagcagcaaggggccgcggccaggcggatggccacgctcgcctcccacctgcgcccgcaacccgcatcctctcaccctcagatggaggaggtacccctcctaatgggatccaattgccgtgcaaaaggggcggcgccaggcttcaaggtcgcgatcttgggtgcagctggtggaatcgggcagccacttgcgctactgatgaagatgaaccctctcgtttcggtgctccatctatacgatgttgtcaacgcacctggtgtcacagctgacattagccacatgaatactggtgctgtggtgcgtggattcttgggccagccacagttggaaaatgctctaactgggatggatcttgtgataattcctgctggtgtccctcggaaacctgggatgacaagggatgatctatttaacatcaatgctggaatcgtacgtactctttgcgagggaattgcgaaatgctgccccaaggcgattgtgaatgtgattagtaatcctgtcaattctaccgttccaattgctgctgaagttttcaagaaagctgggacatatgatcccaagcgccttttgggggttactacacttgatgtagtgagagccaacacttttgtgggagaggttcttggacttgatccccaaaaagtcaattgttcctgtcattggtgggcatgcttggagttacg

SEQ ID NO: 35595 - protein, 230 aa, Panicum virgatum
  misc_feature: Ceres CLONE 1962215
  misc_feature (51)..(194): Pfam Name: Ldh_1_N Pfam Description: lactate/malate dehydrogenase, NAD binding domain
  misc_feature: SWISSPROT Homolog: EC 1.1.1.37 Malate dehydrogenase
MEQQQQGAAARRMATLASHLRPQPASSHPQMEEVPLLMGSNCRAKGAAPGFKVAILGAAGGIGQPLALLMKMNPLVSVLHLYDVVNAPGVTADISHMNTGAVVRGFLGQPQLENALTGMDLVIIPAGVPRKPGMTRDDLFNINAGIVRTLCEGIAKCCPKAIVNVISNPVNSTVPIAAEVFKKAGTYDPKRLLGVTTLDVVRANTFVGEVLGLDPQKVNCSCHWWACLEL

SEQ ID NO: 35596 - DNA, 1263 bp, Panicum virgatum
  misc_feature: Ceres CLONE 1962216
  misc_feature: Encodes the peptide sequence at SEQ ID NO. 35597
aaaaaacctagctcccttgttctcacgcgcacgcgccgccccgccccgccccgccctcccctcctcttcccctcccgcgctctactcaccggccgccacgcacgccgtcgccgttcgctccgtccccgtcccatcgccggcagccgccgtcccccctccccgtctcagtaaaaatgatgggacgttcaagtgaagaagcccaggctcatgatgaagtcatcatggatgatgttgattccgatgtggaagagtcagactcggaagatgattcaggggaagaagctcaggctaagccttcagacaaagctatatacaacaaggatgccattcttgaaaaacttgaagacatagcctggcccaagaatgtggactggatgcacaagctcaccattgagtatgaccagggggaaaaagttgatgtgaatgatgatcttgcccgtgaacttgcattttacacccaagctttggatggcacaaggcaggcctttgagaagctgcagtcaatgaaggttcggttcctcaggccaacagattactatgctgagatggtcaagactgatgcacatatgcacaagatcaaggggagattgttgtcagagaagaggaagatcgaggaggctgaggagaggaagaaggctagagaggccaaaaagatagcaaaggaggtgcaggcagagaagaacaagcagcgggctaaggagaagaaggagcagattgagtcagtcaagaagtggaggaagcagaggcagcaggggggattcgccaagggaaatgatgatgtgccagacctgaactttgagggagaggaaggatttaaacaatcaaagaaaaagaggcctggggtttctcctagtgataggtctggtggtcttgctaagagaggtagagaaggaaagaacaggaggtcaagagatgccaagtttgggcatggtgggcgtaaagggctgaagaagcaaaacactgctgagaccacgaatgatttcagaagctttaacaaggggggtgagtctcaaaacaagaagaggaagagggcttgatgcaatattgtaataattttgtgctcagtcccttttgccgttattgctattcttgttgcaactttgctatggtgcgttgttaccagaagcaaaaattagctgaaaagattattctagggaagcaatccaatcacaagacttatgttttactttttctggtgatggtcttcttttgttgtggaatgcagatgaatcttaccaacaatgaaattatcttaaatcgtgc

SEQ ID NO: 35597 - protein, 287 aa, Panicum virgatum
  misc_feature: Ceres CLONE 1962216
  misc_feature (6)..(287): Pfam Name: Ebp2 Pfam Description: Eukaryotic rRNA processing protein EBP2
MMGRSSEEAQAHDEVIMDDVDSDVEESDSEDDSGEEAQAKPSDKAIYNKDAILEKLEDIAWPKNVDWMHKLTIEYDQGEKVDVNDDLARELAFYTQALDGTRQAFEKLQSMKVRFLRPTDYYAEMVKTDAHMHKIKGRLLSEKRKIEEAEERKKAREAKKIAKEVQAEKNKQRAKEKKEQIESVKKWRKQRQQGGFAKGNDDVPDLNFEGEEGFKQSKKKRPGVSPSDRSGGLAKRGREGKNRRSRDAKFGHGGRKGLKKQNTAETTNDFRSFNKGGESQNKKRKRA

SEQ ID NO: 35598 - DNA, 474 bp, Panicum virgatum
  misc_feature: Ceres CLONE 1962217
  misc_feature: Encodes the peptide sequence at SEQ ID NO. 35599
acatctctccccccaccggatctgtcccccccccccccaaccatggagcagcagcagcaaggggccgcggccaggcggatggccacgctcgcctcccacctgcgcccgcaacccgcatcctctcaccctcagatggaggaggtacccctcctaatgggatccaattgccgtgcaaaaggggcggcgccaggcttcaaggtcgcgatcttgggtgcagctggtggaatccggcagccacttgcgctactgatgaagatgaaccctctcgtttcggtgctccatctatacgatgttgtcaacgcacctggtgtcacagctgacattagccacatgaatactggtgctgtggtgcgtggattcttgggccagccacaattggaaaatgctctaactgggacggatcttgtgataattcctgctggtgtccctcggaaacctgggatgacaagggatgatctatttaacatcaatgcc

SEQ ID NO: 35599 - protein, 143 aa, Panicum virgatum
  misc_feature: Ceres CLONE 1962217
  misc_feature (51)..(143): Pfam Name: Ldh_1_N Pfam Description: lactate/malate dehydrogenase, NAD binding domain
  misc_feature: SWISSPROT Homolog: EC 1.1.1.37 Malate dehydrogenase
MEQQQQGAAARRMATLASHLRPQPASSHPQMEEVPLLMGSNCRAKGAAPGFKVAILGAAGGIRQPLALLMKMNPLVSVLHLYDVVNAPGVTADISHMNTGAVVRGFLGQPQLENALTGTDLVIIPAGVPRKPGMTRDDLFNIN

SEQ ID NO: 35600 - DNA, 750 bp, Panicum virgatum
  misc_feature: Ceres CLONE 1962219
  misc_feature: Encodes the peptide sequence at SEQ ID NO. 35601
accccaaaggttgttgtctcgggggaattctttaacccctatcttcttccacggcttcttggagtcgctgctgttccttggggggatgggtagcttcgcgaagctggcgaggagggcggtggagacggacgcgccagtcatggtgaagatacaagatctgcttcgaggggccacgggcgtgatgtcgcttgcccagggagttgtttactggcaacctcctgagtcagctatgaataagattgaaaaaatcatcagggaaccagcagtcagtagatatggttctgatgatggacttcctgaacttcgtgaagcacttctcgaaaagctacgcagagagaataagcttaccaagtcatcagttatggtcactgctggtgcaaatcaggcttttgtgaacttggtcctcactctttgtgatgctggtgattccgttgtcatgtttgcaccatattatttcaatgcctacatgtcattccagatgacaggtgttactgacatattagttggtgcttgcgaccccaagacacttcatcctgatgttgattggttggagaaggttctgaaagaaaatggacctatccctaaacttgttactgttgtgaatccggggaatccctctggagcttttattcccaggcctatgcttgagagaatttcagatctttgcaaaaatgctggtgcatggcttggtgttgacattacctatgagtactttatgtatgatggaatggagcactattgcttagaaga

SEQ ID NO: 35601 - protein, 221 aa, Panicum virgatum
  misc_feature: Ceres CLONE 1962219
  misc_feature: SWISSPROT Homolog: EC 2.6.1.1 Aspartate transaminase
  misc_feature: Functional homolog of the protein sequence given in SEQ ID NO 50929
  misc_feature: Useful for making plants with modulated nitrogen use efficiency
MGSFAKLARRAVETDAPVMVKIQDLLRGATGVMSLAQGVVYWQPPESAMNKIEKIIREPAVSRYGSDDGLPELREALLEKLRRENKLTKSSVMVTAGANQAFVNLVLTLCDAGDSVVMFAPYYFNAYMSFQMTGVTDILVGACDPKTLHPDVDWLEKVLKENGPIPKLVTVVNPGNPSGAFIPRPMLERISDLCKNAGAWLGVDITYEYFMYDGMEHYCLE

SEQ ID NO: 35602 - DNA, 528 bp, Panicum virgatum
  misc_feature: Ceres CLONE 1962234
  misc_feature: Encodes the peptide sequence at SEQ ID NO. 35603
accagctagctctgctccattcccattccattcaaattcccccacactcacccccgctctcctgctcggtggtcgccctgacaactgcacccatggccgctgccaaccagctgactgctctcctcaccaacatgtatgccacgggtttgctggatgagcaattccagcagctacagatgctccaggacgccagctcccctgacttcatctccgaggtcgtcaccctcttctgccaggacggcgagaggatcatcggcgagctcgccaagctgctggagaagcccaacgtggattttgatagggtcgacgcatttatgcatcagctcaaggggagcagtgcaagtgttggtgcccagaaagtcaaaaacacctgcatccagcttcgagagttctgtcggtcaaagagcagggatgggttagtacctagtatcatatgcatgtcctactatttttattagcatttttaacatgcatatactaatgtcgtggtggcacctattattgatgtatatttgttctctggctgaa

SEQ ID NO: 35603 - protein, 121 aa, Panicum virgatum
  misc_feature: Ceres CLONE 1962234
  misc_feature (41)..(119): Pfam Name: Hpt Pfam Description: Hpt domain
MAAANQLTALLTNMYATGLLDEQFQQLQMLQDASSPDFISEVVTLFCQDGERIIGELAKLLEKPNVDFDRVDAFMHQLKGSSASVGAQKVKNTCIQLREFCRSKSRDGLVPSIICMSYYFY

SEQ ID NO: 35604 - DNA, 717 bp, Panicum virgatum
  misc_feature: Ceres CLONE 1962237
  misc_feature: Encodes the peptide sequence at SEQ ID NO. 35605
gagcgctggcatcactcggagccttgcctctgtaggtagagagtgtgttgtttgcagggggaagaagggaagagggcaatggcgacctccttccaggggacgaccaccaagtgcaccgcctgcgacaagacggtgtacctcgtcgacaagctcaccgctgacaaccgcgtctaccacaaggcctgcttccgctgccaccactgcaagggaaccctcaagcttgcgaactacaactccttcgagggggtgctctactgcaggcctcacttcgaccagctgttcaagaggacggggagtctggacaagagcttcgaaggtacgatgatgatcaccatgttcccttgattccttttgcgttacatacatagagatccggtggttcttgaggctgattagcctgtcctcaccacctgcaaatggttcaggaacccccaaggttgtcaagccagaaagaaagaatgaggtatgcaacaaactgtgattcatgctttgcagagtagaagcaggtcgagtaaatgttaaactgcactgtttttttttcagtaattaaggtacacaggaaaaaaaaacagtaggcatttgaatcattcatcataatatatgcagaggaactcaaatctgaagtgaccatagatctagtccatgcaaatgcacagtagtgagaagaagggtgagataaataggcactcagagcttgatgaatgacgcatggatctg

SEQ ID NO: 35605 - protein, 88 aa, Panicum virgatum
  misc_feature: Ceres CLONE 1962237
  misc_feature (12)..(68): Pfam Name: LIM Pfam Description: LIM domain
  misc_feature: Functional homolog of the protein sequence given in SEQ ID NO 50557
  misc_feature: Useful for making plants with altered carbohydrate content
  misc_feature: Functional homolog of the protein sequence given in SEQ ID NO 50127
  misc_feature: Useful for making plants with modulated heat sensitivity
  misc_feature: The sequence is a functional homolog of SEQ ID NO 1308 in the 11/479,226 US patent application
  misc_feature: The sequence is a functional homolog of SEQ ID NO 612 in the 10/412,699 US patent application
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
MATSFQGTTTKCTACDKTVYLVDKLTADNRVYHKACFRCHHCKGTLKLANYNSFEGVLYCRPHFDQLFKRTGSLDKSFEGTMMITMFP

SEQ ID NO: 35606 - DNA, 561 bp, Panicum virgatum
  misc_feature: Ceres CLONE 1962260
  misc_feature: Encodes the peptide sequence at SEQ ID NO. 35607
cgattttattgaacgaggtagcccctaggcctcacaacagcgggcatcacacgattgagtcatgttacacctcacaatatgagcagcacttacgtgccattcttggaattccacttggtgatccttcaatgaaagcacctgctgcaataatgtacaacatcctgggagaggatgagggtgaagcaggattctttttggctcatcagctaattgagagggcattaaatattccaggtgcatcagttcattggtacgcaaaaccagagatgcgaaagcaaagaaagatgggtcacattacaatcgtgggaccttcaaaggcgagtgtaaaatcacgcctagacaagttgctgcaaagcgacacgtatgaccccaagaaagttagccctcgtgtttctataataatggggtctgattctgatcttaatgtaatgaaagatgctgaggtgatattaaaaaaatttaacatacctgttgagactaccattgtttcagcacatcgtacaccagagcggatgtatgattttgctaagtctgcatatggcaggggtattgaggtcataa

SEQ ID NO: 35607 - protein, 186 aa, Panicum virgatum
  misc_feature: Ceres CLONE 1962260
  misc_feature (128)..(186): Pfam Name: AIRC Pfam Description: AIR carboxylase
  misc_feature: SWISSPROT Homolog: EC 4.1.1.21 Phosphoribosylaminoimidazole carboxylase
ILLNEVAPRPHNSGHHTIESCYTSQYEQHLRAILGIPLGDPSMKAPAAIMYNILGEDEGEAGFFLAHQLIERALNIPGASVHWYAKPEMRKQRKMGHITIVGPSKASVKSRLDKLLQSDTYDPKKVSPRVSIIMGSDSDLNVMKDAEVILKKFNIPVETTIVSAHRTPERMYDFAKSAYGRGIEVI

SEQ ID NO: 35608 - DNA, 578 bp, Panicum virgatum
  misc_feature: Ceres CLONE 1962268
  misc_feature: Encodes the peptide sequence at SEQ ID NO. 35609
atcatcaaattaaatctgcgggggcgcacaacctacctacgaccatgggcgccacgctacccggcttgctctctgcgcttctgctgctgctcctcccggcttccctccgagtccgagaccacctccccgcgtccaaccggcgagaggcggaggacggcgtcgtcggccgcggcctgcacccgatcgtgctgatccccggcttgtcctgccccgacctggaggcgcggctcaccgacgcctaccggccctcgacgccgcggtgcagccgggtgcaaggggaggaggggtggttcgggctgtggacgaaccgcacctgggagctggacgccgagcgcgccgagtgcttcgtcgaccagatgcgcctcgtctacgacgccgtcctcggggacttccggaacctgcccggcgtcgagtcgcgcgtccccggcttcggctccgcccgcggctccggctccaaggttccaacacacccggagttttgtttgggagcactgagggctacactggaaaggcttggctaccgtgagggacaaaccctcttcggagctccctacgacccgcggtacgctcccccgatg

SEQ ID NO: 35609 - protein, 177 aa, Panicum virgatum
  misc_feature: Ceres CLONE 1962268
  misc_feature: SWISSPROT Homolog: EC 2.3.1.43 Phosphatidylcholine--sterol O-acyltransferase
MGATLPGLLSALLLLLLPASLRVRDHLPASNRREAEDGVVGRGLHPIVLIPGLSCPDLEARLTDAYRPSTPRCSRVQGEEGWFGLWTNRTWELDAERAECFVDQMRLVYDAVLGDFRNLPGVESRVPGFGSARGSGSKVPTHPEFCLGALRATLERLGYREGQTLFGAPYDPRYAPP

SEQ ID NO: 35610 - DNA, 432 bp, Panicum virgatum
  misc_feature: Ceres CLONE 1962273
  misc_feature: Encodes the peptide sequence at SEQ ID NO. 35611
cccctcgctttctctctctcgttcaactctctctctctctctctctctctctctcactgtctctctctgctggcggcgacgactgggagagcgccgccgcccttggcagggtcgtcgcccggcggcgagaacgacgagttgatattctggctggaaaatcgcgttgaggggggcggagaaggtgttctaccatcggcagcttgatctcaaggagcagaattattacatgatccatttaaaccggagggaaagcctggctagggcagggatggagtacttcgatgcgaggcggaagcctggaaaagtagggaaaatcattggggccgtggtcctcacaggtctctgtagatttgttctgaagcaatctcctagttttggtggcaatagtgtgttttctcgacatgaggctggtgttacccacgtcttagtaac

SEQ ID NO: 35611 - protein, 68 aa, Panicum virgatum
  misc_feature: Ceres CLONE 1962273
  misc_feature: SWISSPROT Homolog: EC 5.1.3.5 UDP-arabinose 4-epimerase
  misc_feature: Functional homolog of the protein sequence given in SEQ ID NO 51011
  misc_feature: Useful for making plants with altered carbohydrate content
  misc_feature: Functional homolog of the protein sequence given in SEQ ID NO 50959
  misc_feature: Useful for making plants with altered cell wall content and/or composition
MIHLNRRESLARAGMEYFDARRKPGKVGKIIGAVVLTGLCRFVLKQSPSFGGNSVFSRHEAGVTHVLV

SEQ ID NO: 35612 - DNA, 1223 bp, Panicum virgatum
  misc_feature: Ceres CLONE 1962291
  misc_feature: Encodes the peptide sequence at SEQ ID NO. 35613
atcctgtgcccgccgtcgccgcggccttcgacctcctccccaccccaccgcatccgaatcccgcacgcctcccccgccatggccacctccagcgacggcggcggcgaccagcggcgcctactctcaatccccaaggagggcgagcgcatcatcgcgccgactcggcgccccgacggcacgctccgcaaggccatccgcatccgcgccggctacgtgccccaggaggaggtcgccatctaccagtccaagggcgccctaatgaggaaatcagggcccgacgtgccgccggggtacgacccggcgctagcggtcgatgcaaagcccaagacgaaggcggccaagcggaatgagcggcgcaaggagaaacggcagcaggctagttcgacaaatgataaaggaaagggcctggatatagaggacgctggagctgcagaaactgacaaggttctttcctccaaaactgataagcagagggattcagtggaaagtgtaacaaagcagataagaagcattgctatttctgaatcacctgcagcgccatccacaaatgccaatgatagctcacaaccagaatcatccgctccagacatagataagaaaattcgagcactgaagaagaagatacgtttagctgaagcacagctgcaaggtgactccgaaaaattgaaatctgagactcaggaaaagttgaaaaagattgaagggtggcgtgcggagctgaagcttttggaggacaagaaagctcccacgggttcctagacagagtcgggttcagctgtgatgtagagtggagccatggctaccaaacaatcaccatggtgttgtgcacttgtgctgatccaaggtccaatcaatcaccatggtgttcgcgcagaacgatggagagtttctcatcgcacacattttgctgtctcatgttcgccgagttcgaagatttgtaccacaagatgatccatttgtcagagaccacacaatgagatgattcgaccgattattgtgactggctgtagcttcggtgtactatgctgacactggggatttattggaactggatcagaatttccttccagctctaaacttagaatgcatctctctgcatttccactagtattcgtaacttttcaggccgggcagctgctttgtcagtgtccgtcaccttcagcttttacagacaccatcacgacttctcttgaaacaacccttcggaggttctttgtcgtccg

SEQ ID NO: 35613 - protein, 226 aa, Panicum virgatum
  misc_feature: Ceres CLONE 1962291
  misc_feature (21)..(47): Pfam Name: Mago-bind Pfam Description: Mago binding
MATSSDGGGDQRRLLSIPKEGERIIAPTRRPDGTLRKAIRIRAGYVPQEEVAIYQSKGALMRKSGPDVPPGYDPALAVDAKPKTKAAKRNERRKEKRQQASSTNDKGKGLDIEDAGAAETDKVLSSKTDKQRDSVESVTKQIRSIAISESPAAPSTNANDSSQPESSAPDIDKKIRALKKKIRLAEAQLQGDSEKLKSETQEKLKKIEGWRAELKLLEDKKAPTGS

SEQ ID NO: 35614 - DNA, 685 bp, Panicum virgatum
  misc_feature: Ceres CLONE 1962332
  misc_feature: Encodes the peptide sequence at SEQ ID NO. 35615
acccaacacagcagcgaacctagtgtgggaagctgaagcactgatccggtatgggtgcggcaggcgcgccgaagatcatggcggtcctggctctcgcgctagctctcctctgcgctgccgccgggccggccgccgcgcagaactgcggctgccagccgggctactgctgcagcaagtacggttactgcggcctgggcgacccctactgcggcgagggatgccggtcgggcccgtgctactcgggaggcggtggtggtggcggcggcggaagcggcgcgaacgtggctagcgtcgtcaccgacgcgttcttcaacggcatcaagaaccaggccgggggcgggtgcgagggaaagaacttctacacgcggagcgcgttcctgagcgccgccaacaagtactccggcttcgcccacggcggctccgaggtcgagggcaagcgcgagatcgccgccttcttcgcgcacgtcacgcacgagacagggcatttctgctacatcagcgagatcaacaagaacaacaactactgcgacgccagcaacacgcagtggccgtgcgcggcggggaagaagtactacgggcgcggcccgctgcagatctcgtggaactacaactacgggcccgccgggagggacaacggcttcgacgggctgcggaacccggacgcggtggagcaagacgccgtgat

SEQ ID NO: 35615 - protein, 202 aa, Panicum virgatum
  misc_feature: Ceres CLONE 1962332
  misc_feature (72)..(202): Pfam Name: Glyco_hydro_19 Pfam Description: Chitinase class I
  misc_feature (20)..(53): Pfam Name: Chitin_bind_1 Pfam Description: Chitin recognition protein
  misc_feature: SWISSPROT Homolog: EC 3.2.1.14 Chitinase
  misc_feature: The sequence is a functional homolog of SEQ ID NO 12 in US patent 7087810
MAVLALALALLCAAAGPAAAQNCGCQPGYCCSKYGYCGLGDPYCGEGCRSGPCYSGGGGGGGGGSGANVASVVTDAFFNGIKNQAGGGCEGKNFYTRSAFLSAANKYSGFAHGGSEVEGKREIAAFFAHVTHETGHFCYISEINKNNNYCDASNTQWPCAAGKKYYGRGPLQISWNYNYGPAGRDNGFDGLRNPDAVEQDAV

SEQ ID NO: 35616 - DNA, 1163 bp, Panicum virgatum
  misc_feature: Ceres CLONE 1962336
  misc_feature: Encodes the peptide sequence at SEQ ID NO. 35617
atccatccctcactctccccaaatcccaatctcccactgcgccccctcctcgactgccgccaatccgccatggtcatggacaagcccggcctcccgcagccgcagctgccgtcctcggcttcggcctccgccgccgcctcctcgctcaagtccctcaacaaggcctcctacaagatctccaagcagtcatcctccgcctcttccgcttcttcggcttcaaccatgagggcgccgtccccgccgcctccgccgccgcgcgcgtctcctccgctcccgccggcgccgccgtcctccgtccccgccgaccacccgcctccccagcccccggtctacaacatcgacaagtccgacttccgcgacgtcgtgcagaagctcaccggctcgccgtcccacctcctcccgccccaggcaccggccgcccccgcccccgccgccgccgcgctcatggcgccacctccgcccatcatggcgccgcctccgcctcccatcatggcgcctccgcccccgccgacggcgataccatcccgcctccaccgcatccggccgccgccgctggccccgccgcgcccgccgcccatcctgccgccggcaccgcccgcgctctccccgctcccgccgctcccggcggtctgcgtgaccgcggagtcgcccatctccgcctacatgcgccgcctccgcgggatgccctcgccgatccacgtgccgacgtcgccgctcgggttcgggtgcctgccctcgccgcggacgccgccctcgcccggcgtggcgatgccggccaccagcccccgcgtccgcgacccgtgacccaggaacccaccgatgcatccgccgccgcccgatgtgtagatacggctggtgtaggagagatctggcgacgcggcggcgaggaaaggaggaagcagcaatacaatcacattctgttagctccaactcaaacctttagctcaaaaaattcttttttttccccctagcgtgctcataccttccttgatattttgttggtgtatatgggagatgcggcgtttgggcagcaaatggattgctcatgtttggctaattttttgtaacaaagtttatgcaatatgtatggtagaatctcatatgcaaaatttgtttaggattatgatattatctcaataggactcatcaactcttgcctggct

SEQ ID NO: 35617 - protein, 244 aa, Panicum virgatum
  misc_feature: Ceres CLONE 1962336
  misc_feature (81)..(111): Pfam Name: VQ Pfam Description: VQ motif
MVMDKPGLPQPQLPSSASASAAASSLKSLNKASYKISKQSSSASSASSASTMRAPSPPPPPPRASPPLPPAPPSSVPADHPPPQPPVYNIDKSDFRDVVQKLTGSPSHLLPPQAPAAPAPAAAALMAPPPPIMAPPPPPIMAPPPPPTAIPSRLHRIRPPPLAPPRPPPILPPAPPALSPLPPLPAVCVTAESPISAYMRRLRGMPSPIHVPTSPLGFGCLPSPRTPPSPGVAMPATSPRVRDP

SEQ ID NO: 35618 - DNA, 673 bp, Panicum virgatum
  misc_feature: Ceres CLONE 1962346
  misc_feature: Encodes the peptide sequence at SEQ ID NO. 35619
acaccacaccagaggcatcggtttcctaggacgccatccagaggcggcggctggtgctgggatctccaatatattattctatccaagcgatagatagatagatagatagatagatagatagatagatagatagatagatgccggcagcgatggcttctggttccagcaggctcgtcgtgatgagaacaacgctgctggtgctcggcgccgtgtgctcggcggcactgctcgccggcgtcgcgagcgccgccggcagcttctaccaggacgtggacatcacctggggcgacggccgcggcaagatcctcaacggcggccagctcctgacgctgtccatggaccggtcctcggggtcggggttccagtccaggagccagtacctctacggccgcttcgacatgcagctcaagctcatccccggcgactccgccggcacggtcaccaccttctacctgtcgtcgcaggggtcgcagcacgacgagatcgacttcgagttcctggggaacgcgagcggcgagccgtacacggtgcacaccaacgtgtacagccagggcaagggcggccgcgagcagcagttccgggtgtggttcgaccccacggcggacttccacacctactccgtggtctggaaccccagccacatcgtcttctacgtggacggcgtgcccatccg

SEQ ID NO: 35619 - protein, 174 aa, Panicum virgatum
  misc_feature: Ceres CLONE 1962346
  misc_feature (37)..(174): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Functional homolog of the protein sequence given in SEQ ID NO 50903
  misc_feature: Useful for making plants with altered carbohydrate content
  misc_feature: Functional homolog of the protein sequence given in SEQ ID NO 51497
  misc_feature: Useful for making plants with altered cell wall content and/or composition
  misc_feature: Functional homolog of the protein sequence given in SEQ ID NO 50905
  misc_feature: Useful for making plants with altered lignin content
MASGSSRLVVMRTTLLVLGAVCSAALLAGVASAAGSFYQDVDITWGDGRGKILNGGQLLTLSMDRSSGSGFQSRSQYLYGRFDMQLKLIPGDSAGTVTTFYLSSQGSQHDEIDFEFLGNASGEPYTVHTNVYSQGKGGREQQFRVWFDPTADFHTYSVVWNPSHIVFYVDGVPI

SEQ ID NO: 35620 - DNA, 605 bp, Panicum virgatum
  misc_feature: Ceres CLONE 1962349
  misc_feature: Encodes the peptide sequence at SEQ ID NO. 35621
atcgagtcgataagatcgagctcggggaggttggggcgcagaaaaaaaaaaatcatctccaatctccaaccaaactaaccctagcagcagccggcggttagggtttcgagcgagatggcggcggcggcgaggcagcgggggacggtcaagtggttcaacgacaccaagggcttcggcttcatctcccccgaggacggcagcgaggacctcttcgtccaccagtcgtccatcaagtcggagggcttccgctccctcgccgagggcgaggaggtcgagttctccgtctcggagggcgacgacggccgcaccaaggccgtcgacgtcaccggccccgacggatccttcgtcaagggcggctccggcggcggcgggggcggcttcggatctcgcggcggggccggatctggcggcggcggccgcagctacggcggcagctggggcggcgggaggagatccggccccggcggcggtggcggcggcggcggcgcgtgctacaagtgcggggagcccggccacatggctagggactgccccaccgcccacggaggcggcggttacggcgggggaggctacggtggcggcggcggcggctgcttttagtgcgg

SEQ ID NO: 35621 - protein, 161 aa, Panicum virgatum
  misc_feature: Ceres CLONE 1962349
  misc_feature (6)..(73): Pfam Name: CSD Pfam Description: 'Cold-shock' DNA-binding domain
  misc_feature (124)..(141): Pfam Name: zf-CCHC Pfam Description: Zinc knuckle
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 468 in the 11/479,226 US patent application
  misc_feature: The sequence is a functional homolog of SEQ ID NO 1126 in the 11/479,226 US patent application
  misc_feature: The sequence is a functional homolog of SEQ ID NO 2410 in the 10/374,780 US patent application
  misc_feature: The sequence is a functional homolog of SEQ ID NO 492 in the 10/412,699 US patent application
  misc_feature: The sequence is a functional homolog of SEQ ID NO 552 in the 10/225,066 US patent application
MAAAARQRGTVKWFNDTKGFGFISPEDGSEDLFVHQSSIKSEGFRSLAEGEEVEFSVSEGDDGRTKAVDVTGPDGSFVKGGSGGGGGGFGSRGGAGSGGGGRSYGGSWGGGRRSGPGGGGGGGGACYKCGEPGHMARDCPTAHGGGGYGGGGYGGGGGGCF

SEQ ID NO: 35622 - DNA, 553 bp, Panicum virgatum
  misc_feature: Ceres CLONE 1962360
  misc_feature: Encodes the peptide sequence at SEQ ID NO. 35623
ctctctctcctctacccccttttcctctaacctttagctttcctccctccctccttcggtccttccctctcctctcctctccactcctctcctcttccattcctctaactagtcctagccattcagatcctaagttgctggccttgctgcttcttgttggagaaagatttgttggttccaagttggaagtatcatgagtccaccgagtgtgatggggcaatttggagacacaacctataccaaggttttcgttgggggactcgcatgggaaacccagaaggagaccatgaggaagtacttcgagcagtttggggagatcctggaggccgttgtcatcacagacaagaataccggcagatccaagggctacggatttgttaccttccgggacccggatgcggcgatgagagcttgtgttgatcctgcgccggtgatagacgggaggagggctaactgtaatctggcttcacttggggttcaaagatctaggcctccaacaccccagcatggaggagctaggagcttcagggtgatgaaatccttcagccagcag

SEQ ID NO: 35623 - protein, 113 aa, Panicum virgatum
  misc_feature: Ceres CLONE 1962360
  misc_feature (12)..(82): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50671
  misc_feature: Useful for making plants with modulated biomass
MGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGARSFRVMKSFSQ

SEQ ID NO: 35624 - DNA, 1447 bp, Panicum virgatum
  misc_feature: Ceres CLONE 1962363
  misc_feature: Encodes the peptide sequence at SEQ ID NO. 35625
tatggctagtgggtagtggggggaaccgagaatcccgaagcataccaatccaacaagaaaggaatccccaatggctcatcgcgtcctcctcctcctctccctcgccgcggcggccgcagtcgccgccgccgccgccgacgccgaggaccccctgatccgccaggtggtgcccggcggcgacgacaacgacctggagctgaacgcggagtcccacttcctgagcttcgtgcagcggttcggcaagtcctacaaggacgccgacgagcacgcgtaccggctgtccgtgttcaagtccaacctgcgccgcgcgcgccgccaccagctgctggacccgtcggcggagcacggcgtcaccaagttctccgacctgacgccggccgagttccgccggacctacctcggcctccgcaagtcccggcgcgctctcctcagggagctcgggggctcggcgcacgaggcgcccgtgctccccaccgacggcctccccgaggacttcgactggagggaccacggcgccgtcggccccgtcaagaaccagggctcatgcgggtcgtgctggtcgttcagcgcgtcgggagcgctggagggtgcgcactacctcgccaccggcaagctggaggtgctctccgagcagcagtttgtcgactgcgaccatgagtgtgattcatcagaacctgattcttgtgattcgggatgcaatggtgggctgatgaccacggccttcagttatctccagaaagctggtggccttgagagcgagaaggaatacccttacactgggagagatggcaaatgcaaatttgacaagtcgaagattgttgcttccgttcaaaacttcagtgttgtctctgtggatgaagaccaaattgctgccaaccttatcaaacatggtccactggcaattggtatcaatgctgcctacatgcagacatacatcggtggtgtgtcatgcccatacatctgcggcaggcacctcgaccatggtgttctccttgtcggctatggtgcagctggtttcgcccccatccgcctgaaggagaagccctactggatcatcaagaactcgtggggtgagaactggggcgagaatggatactacaagatctgcaggggctccaacgtccgcaacaagtgtggcgtcgactccatggtctccacggtctccgccatccatgcttctaaggagtagactgatcggtagtcctccctgacaatttcatatatgctagaactacaataccctgctagtatttatgctccatctgtatgctgttacatataaggcagcagagatgtgaagctgcaatgggatgcttgctggaaggttatgtttgctacgcatgctacacggtatttggatgtagcaaagttatcacaagatctgtatacgctttttaatctgcagaacttttgaataattgtgtacataaatatatggtgtgctccc

SEQ ID NO: 35625 - protein, 372 aa, Panicum virgatum
  misc_feature: Ceres CLONE 1962363
  misc_feature (138)..(365): Pfam Name: Peptidase_C1 Pfam Description: Papain family cysteine protease
  misc_feature (49)..(105): Pfam Name: Inhibitor_I29 Pfam Description: Cathepsin propeptide inhibitor domain (I29)
  misc_feature: SWISSPROT Homolog: EC 3.4.22.41 Cathepsin F
MAHRVLLLLSLAAAAAVAAAAADAEDPLIRQVVPGGDDNDLELNAESHFLSFVQRFGKSYKDADEHAYRLSVFKSNLRRARRHQLLDPSAEHGVTKFSDLTPAEFRRTYLGLRKSRRALLRELGGSAHEAPVLPTDGLPEDFDWRDHGAVGPVKNQGSCGSCWSFSASGALEGAHYLATGKLEVLSEQQFVDCDHECDSSEPDSCDSGCNGGLMTTAFSYLQKAGGLESEKEYPYTGRDGKCKFDKSKIVASVQNFSVVSVDEDQIAANLIKHGPLAIGINAAYMQTYIGGVSCPYICGRHLDHGVLLVGYGAAGFAPIRLKEKPYWIIKNSWGENWGENGYYKICRGSNVRNKCGVDSMVSTVSAIHASKE

SEQ ID NO: 35626 - DNA, 715 bp, Panicum virgatum
  misc_feature: Ceres CLONE 1962392
  misc_feature: Encodes the peptide sequence at SEQ ID NO. 35627
gtgctgtggcgtcctgcccacctccggtccgccattcccctgcgcatctggagctgttgtttctaaacccacaaaccctagccgccgcgccgccggcgccgcagccatgaacgccttcaggctcctcggggacatgacccacctcttctcggtcctcgtcctcctcctcaagatctacgccaccaagtcctgctcaggggtgtcgaggaagacgcaggagctgtacatgctggtgttcgtcgcgaggtacctggacctcttcacggactacatctcgctctacaactcggtgatgaaggtggtgttcatcaccagctcggcggcgatcgtatggtgcatgcgccgccacccgcaggtgcgccgaacgtacgacaaagagcaggacaccttccgccatgtggtgctcgtcgccgccgcattcctgctcgcgctgatattcaatgagcggttcaccttccgggagatatgctgggcattttcaatctatttggaagcagtggcaattctcccgcagttagtgttactccagagaagcagaaatgttgataacttgactggacaatatgttttcttccttggggcctaccgtgcactctacattctaaactggatttatcgttatttcacggagagtcatcacagcagatggatcccttggcttgctggtttggtgcaaacagctctgtatgcagatttcttttactactatttctta

SEQ ID NO: 35627 - protein, 202 aa, Panicum virgatum
  misc_feature: Ceres CLONE 1962392
  misc_feature (1)..(202): Pfam Name: ER_lumen_recept Pfam Description: ER lumen protein retaining receptor
MNAFRLLGDMTHLFSVLVLLLKIYATKSCSGVSRKTQELYMLVFVARYLDLFTDYISLYNSVMKVVFITSSAAIVWCMRRHPQVRRTYDKEQDTFRHVVLVAAAFLLALIFNERFTFREICWAFSIYLEAVAILPQLVLLQRSRNVDNLTGQYVFFLGAYRALYILNWIYRYFTESHHSRWIPWLAGLVQTALYADFFYYYF

SEQ ID NO: 35628 - DNA, 398 bp, Panicum virgatum
  misc_feature: Ceres CLONE 1962401
  misc_feature: Encodes the peptide sequence at SEQ ID NO. 35629
attgatgtgtgcaaatcaagtgctacatgcggaagctgctggaggggctagcgcactgccacgcgcggggggtgatgcaccaggacatcaagtgcgccaacctgctggagagcagcggcggcgagctcaaggtggcggacttcggcctgcccaacctcttcgcgccgtcggcggagccactgaccacccgcctcgtcacgctctggtaacgaccgccggagctcctcctgggcgccaccgcttaccagccctccgtcgacctctggagcgccggctgcgtcttcaccgagatgcacccccgcctccccatcctgcatggcctcaccgaggtcgagcagatccacaagatcttcaagctctgcagctcgccgcccgacaacttctggcgcccctccggc

SEQ ID NO: 35629 - protein, 60 aa, Panicum virgatum
  misc_feature: Ceres CLONE 1962401
  misc_feature: SWISSPROT Homolog: EC 2.7.11.22 Cyclin-dependent kinase
  misc_feature: Functional homolog of the protein sequence given in SEQ ID NO 50317
  misc_feature: Useful for making plants with modulated biomass
MRKLLEGLAHCHARGVMHQDIKCANLLESSGGELKVADFGLPNLFAPSAEPLTTRLVTLW

SEQ ID NO: 35630 - DNA, 702 bp, Panicum virgatum
  misc_feature: Ceres CLONE 1962453
  misc_feature: Encodes the peptide sequence at SEQ ID NO. 35631
tgagtttgctccccttccgcgtccgcttcccatcttggcctgggcacctgggctgccccccctccgtttccgctctccccggacgcgcaccgatctcgcgccgcgcgcccaagtcgccgccagaatccgccccgcctccgcgctgctgccagcgtcgcgcgacaaggtaggacgagagaggtccagttcttgctggtttcattcttgggagccgccgacttcacatgccaacgaccccgaggagcagaagccaggctagaaccactaggccttggatcttgccagggatggacttcgcggattcgagacggaagcctaatttcacggggaagattgctgtggctgctgccctcacggtcatgtgcataattgtattgaaacagtcgcctggtttcagcggtaccaatgtgttctctcgccatgaagttggggtgacccatgtcttagtgacaggaggggctgggtatattggctcgcatgctactcttcgtctccttaaggacaactaccgtgttaccattgtggataacctttccagaggtaacatgggagctgtaagagttcttcaacggctgtttccacagcctggaaggcttcaatttatttatgctgatttaggcgatgccaaagctgtgaacaaactattttcagaaaatgcatttgatgctgttatgcactttgctgctgttgcttatgttgggg

SEQ ID NO: 35631 - protein, 138 aa, Panicum virgatum
  misc_feature: Ceres CLONE 1962453
  misc_feature: SWISSPROT Homolog: EC 5.1.3.5 UDP-arabinose 4-epimerase
  misc_feature: Functional homolog of the protein sequence given in SEQ ID NO 51011
  misc_feature: Useful for making plants with altered carbohydrate content
  misc_feature: Functional homolog of the protein sequence given in SEQ ID NO 50959
  misc_feature: Useful for making plants with altered cell wall content and/or composition
MDFADSRRKPNFTGKIAVAAALTVMCIIVLKQSPGFSGTNVFSRHEVGVTHVLVTGGAGYIGSHATLRLLKDNYRVTIVDNLSRGNMGAVRVLQRLFPQPGRLQFIYADLGDAKAVNKLFSENAFDAVMHFAAVAYVG

SEQ ID NO: 35632 - DNA, 717 bp, Panicum virgatum
  misc_feature: Ceres CLONE 1962459
  misc_feature: Encodes the peptide sequence at SEQ ID NO. 35633
gagacatgggaggtggccacttctcgttcttatctccttgctacagggcaaaagggcgaaaaggggcggactcgcgtttccggcggtgattccgccggtcccttctgtctccggtggccggatcggcactggagatggaggtggaccaaggaatcggcgtgcggctgtgaataggctagatagtatagtatctaggtcttcgtttttcctcgccgacgttgctgcgggtggatgaacgagctccgggagtggctatgcgtccactttgccggcgaataaggttgcctgctgctgttcttgttggcgggctgatgtttctgcttctccaagatggatatgccgccgccatggccgctcagaccttcctcctcgcgccgcccgccgccctcttcgccgccccctcttcctccgcacgccctttccactcgctacgcctcgtcgccgggcccgggggtcccgccgccgccgccagggcgctcgtcctcgccgatgccaccaagaaggccgtcgccgtcctcaagggcacatccgaggtcgagggcgtcgtcacgctcacgcaggaggacgacggaccaaccactgtcaacgtccgtgtcactggacttactcctggacttcatggcttccaccttcacgagtttggcgataccaccaatggatgcatatcgacaggaccacatttcaacccaaacaatctgacacacggtgcgccggaag

SEQ ID NO: 35633 - protein, 123 aa, Panicum virgatum
  misc_feature: Ceres CLONE 1962459
  misc_feature (50)..(122): Pfam Name: Sod_Cu Pfam Description: Copper/zinc superoxide dismutase (SODC)
  misc_feature: SWISSPROT Homolog: EC 1.15.1.1 Superoxide dismutase
MAAQTFLLAPPAALFAAPSSSARPFHSLRLVAGPGGPAAAARALVLADATKKAVAVLKGTSEVEGVVTLTQEDDGPTTVNVRVTGLTPGLHGFHLHEFGDTTNGCISTGPHFNPNNLTHGAPE

SEQ ID NO: 35634 - DNA, 734 bp, Panicum virgatum
  misc_feature: Ceres CLONE 1962464
  misc_feature: Encodes the peptide sequence at SEQ ID NO. 35635
tcctcccctctccccggtctgcgttgctccctcggtccctcctcccgcccgcccgcccgcccgcccccgcctctgctccgcccatccaccgcacctaggcagcccctcgtcacatggaagccgatgtccccattgccacggctacccccagggctttggagattgccaagatgaggagtagatttatcattctttgtgtgatggcctgtctaatggctcagctaggagctgccaatgtcgtgctaatgggaaataatctgaccttgtcgtttgatgacatcgaggcaagctttgctccaagggtgaaagcatcaggagttaatggcatagtttatactgctgaacctttaaatgcctgcagcccattgacaatcaaagcagttgagggacccccatctcccttcgccttgattataagaggtggatgcacatttgatgagaaagtaaaaaatgcacaggatgctggattcaaagctgcaatcatatatgacaatgaaaatagtggggttctggtttcaatggctggaagctcaagtggtattcatatatatgctgtattcatatcgaaggcctctggagaggtgttgaagaagttttcaggccatgctgatgtagaagtgtggatactacctacattcgagaactcagcctggtcgattatggcaatctcattcatatcgctacttgccatgtctgccgtattggctacatgttatctttgtgagagggcatcg

SEQ ID NO: 35635 - protein, 206 aa, Panicum virgatum
  misc_feature: Ceres CLONE 1962464
  misc_feature (63)..(162): Pfam Name: PA Pfam Description: PA domain
MEADVPIATATPRALEIAKMRSRFIILCVMACLMAQLGAANVVLMGNNLTLSFDDIEASFAPRVKASGVNGIVYTAEPLNACSPLTIKAVEGPPSPFALIIRGGCTFDEKVKNAQDAGFKAAIIYDNENSGVLVSMAGSSSGIHIYAVFISKASGEVLKKFSGHADVEVWILPTFENSAWSIMAISFISLLAMSAVLATCYLCERA

SEQ ID NO: 35636 - DNA, 1278 bp, Panicum virgatum
  misc_feature: Ceres CLONE 1962465
  misc_feature: Encodes the peptide sequence at SEQ ID NO. 35637
accatcacctctacgggaatcccctccgccccgagacctgcatctcgcgaacgcaaatcgtgctgaatcctcgcgggcttctcgcgcgaatcgatggcgacggcgccagcgatggctgcggcctctttctccgtcgcccaggcggcggctgctgcagtagcgatggagtccgctttgtcggagcaggagggatcgcaggtgacgctcgcggggagcgggggcccgaagtcccgccaccatgcgtacagccgcaagcagaagtcgctcggcctcctctgctccaactttgtggctttgtacaaccgcgacaatgtggagactatcgggctggacgaagcggcccggagcctaggcgtggagaggcgccggatctacgacattgtcaatgtgctcgagagcatcgggatcctcatgaggaaggccaagaatcgctacatctggataggctttgacggaatcccgattgctttgcgagaactcaaggacagggcgttaagagaaaagtctggcttggctccttcgcaaatgaagcagcaatctgcggctaatgtgtctgatgacgaagatgataagttggatgacccagatggtgatacccacggcgagaaactgagtcagacaatggacaatccttctgacaaacctagtgcaccgcaatgccagctcagatctgatcataggaaggagaagtcacttgggttgctcacacagaatttcgtgaagcttttcctcaccatggaggttgacacgatctcacttgatgaagcttcaaagctgctccttgtagaaggccacgaggagaccaatatgagaactaaaattcgaagactgtatgacatcgctaatgtgctgtcttccttgaatctaatcgagaagatacatcaagcgaacacaaaaaagcctgcattccgttggttggccaaggccgggaaaccaaaaacagaaactggtatcacagttgctctaccgccatccgcaaagtctgttacaaataaaagaacatttgggactgatctcactaacaccgacacgaatagaagcaatatgggctcaacaatccagaagaaagccaaattgtcacgtagtggcagtgagatcttgaacagttgcaaattatctgtacagagtcgcctcaggcagggtaggaatggcttcgtttatggacctttccaccctgctggtgctaggaaacaggggcttgatggtgctaataaaccagggcagagggagagggctgaggactgggagaacttttctgcttcatttcggctgcagtac

SEQ ID NO: 35637 - protein, 388 aa, Panicum virgatum
  misc_feature: Ceres CLONE 1962465
  misc_feature (190)..(270): Pfam Name: E2F_TDP Pfam Description: E2F/DP family winged-helix DNA-binding domain
  misc_feature (47)..(112): Pfam Name: E2F_TDP Pfam Description: E2F/DP family winged-helix DNA-binding domain
MAAASFSVAQAAAAAVAMESALSEQEGSQVTLAGSGGPKSRHHAYSRKQKSLGLLCSNFVALYNRDNVETIGLDEAARSLGVERRRIYDIVNVLESIGILMRKAKNRYIWIGFDGIPIALRELKDRALREKSGLAPSQMKQQSAANVSDDEDDKLDDPDGDTHGEKLSQTMDNPSDKPSAPQCQLRSDHRKEKSLGLLTQNFVKLFLTMEVDTISLDEASKLLLVEGHEETNMRTKIRRLYDIANVLSSLNLIEKIHQANTKKPAFRWLAKAGKPKTETGITVALPPSAKSVTNKRTFGTDLTNTDTNRSNMGSTIQKKAKLSRSGSEILNSCKLSVQSRLRQGRNGFVYGPFHPAGARKQGLDGANKPGQRERAEDWENFSASFRLQ

SEQ ID NO: 35638 - DNA, 650 bp, Panicum virgatum
  misc_feature: Ceres CLONE 1962475
  misc_feature: Encodes the peptide sequence at SEQ ID NO. 35639
gagacggagacgagacggcgagcgccagagctctctctctctctctctcttcgtcctccctccggcctccctctcctccgcgtcctctctctcctcccaaacggcagtgagaaccgaagcgcgcgccgagagggaggggagcctcgccgcctctcgcggcagatctcgcgccagccccggattctgacgcgagatccgcgctcgccgcccgccggccggtgtgccgccgccgccgccgctcgctcgcccgccgccgtgcgccgccccgatctcgaagaatccaccttgaagatgatgatgggtttgctagcgtttgagagtcaccaggggctctggaatagcggatactattcccagttctttggaattggcggagttatgatcactgttgccattcttatactatccacaggctactttggtggaatcggtgctccatttgctccgtatttctggccatatctaggacaagttccgaagaagagggaacgcaaaaggcctgtgagagtgtacatggatggatgctttgacctcatgcactatggtcacgcaaatgcattgcgacaggccaaattgttgggagatcagctggtagttggggttgtcagtgatgaggagatcgttgcaaataaggggcccacctgtccttt

SEQ ID NO: 35639 - protein, 119 aa, Panicum virgatum
  misc_feature: Ceres CLONE 1962475
  misc_feature: SWISSPROT Homolog: EC 2.7.7.14 Ethanolamine-phosphate cytidylyltransferase
MMMGLLAFESHQGLWNSGYYSQFFGIGGVMITVAILILSTGYFGGIGAPFAPYFWPYLGQVPKKRERKRPVRVYMDGCFDLMHYGHANALRQAKLLGDQLVVGVVSDEEIVANKGPTCP

SEQ ID NO: 35640 - DNA, 636 bp, Panicum virgatum
  misc_feature: Ceres CLONE 1962477
  misc_feature: Encodes the peptide sequence at SEQ ID NO. 35641
atcttcttctctccctagccccttctctctctctttgttcttggcctctagctccaccagattcgacgagctccttggcttcgaactcgattcgacggttcagacgccctagcctagctcgattcggcaacaagatatgcctcgctatgatgatcgttatgggaacacacgcttgtatgttggcagactgtcctcccgcactcgttcccgtgacctggagtatcttttcagcaaatatggaagaatacgagaagtggagttgaagcgcgactatgcatttattgaattcagcgatcctcgtgatgctgatgatgcacaatacaacctagatggcagggaagttgatgggagccacatcatcgttgagtttgctaaaggggttcctcgtggttctggtggctcacgtgagtacatgggaagagggcctccgccagggacgggtcgttgttttaactgtggaattgatggtcactgggcaagggactgcaaggctggtgactggaagaacaaatgctaccgttgtggagaaaggggccacatagaaagaaattgccagaacagtccacagaatcttaggcgtgagagaagtatttcacggtcaccatctccccgccgtggacggggggcgcagccgga

SEQ ID NO: 35641 - protein, 166 aa, Panicum virgatum
  misc_feature: Ceres CLONE 1962477
  misc_feature (13)..(76): Pfam Name: RRM_1 Pfam Description: RNA recognition motif. (a.k.a. RRM, RBD, or RNP domain)
  misc_feature (102)..(119): Pfam Name: zf-CCHC Pfam Description: Zinc knuckle
  misc_feature (124)..(141): Pfam Name: zf-CCHC Pfam Description: Zinc knuckle
  misc_feature: SWISSPROT Homolog: EC 5.2.1.8 Peptidylprolyl isomerase
MPRYDDRYGNTRLYVGRLSSRTRSRDLEYLFSKYGRIREVELKRDYAFIEFSDPRDADDAQYNLDGREVDGSHIIVEFAKGVPRGSGGSREYMGRGPPPGTGRCFNCGIDGHWARDCKAGDWKNKCYRCGERGHIERNCQNSPQNLRRERSISRSPSPRRGRGAQP

SEQ ID NO: 35642 - DNA, 576 bp, Panicum virgatum
  misc_feature: Ceres CLONE 1962485
  misc_feature: Encodes the peptide sequence at SEQ ID NO. 35643
ccaagagatatgagaaggctgcaaagtacatcgagtacgacagctccttcagtgaggaggagaagaagcaatctaaagctctgaagatcagttgcaagctcaacaacgccgcatgtaagctgaagctgaaagaatacagagaagcagagaaactctgcactaaggttctggaacttgagagcacgaatgttaaagccctgtacagaaggtcgcaagcctacatcgaactcgtcgacctggatctggcagagatggatatcaagaaggccctcgaaattgaccctgacaacagggatgtgaagctggtgtccaagaccctgaaggagaagatgagggagtacaacaggcgggatgccaagttctacggcaacatgttcgcgaagtggaggaagctggagcacatggacatcaagaaggtgcccgggaagcagcagccccagccgatggccatcgacagcgctgcgtagagcttcagagtccgtgtgtactcatcagctgcctgcgtgagccaatttgatcgtttgctgctggatattaataataccgggggcgtggtgttaccaactgtggtagagc

SEQ ID NO: 35643 - protein, 154 aa, Panicum virgatum
  misc_feature: Ceres CLONE 1962485
  misc_feature (63)..(96): Pfam Name: TPR_1 Pfam Description: Tetratricopeptide repeat
  misc_feature: SWISSPROT Homolog: EC 5.2.1.8 Peptidylprolyl isomerase
KRYEKAAKYIEYDSSFSEEEKKQSKALKISCKLNNAACKLKLKEYREAEKLCTKVLELESTNVKALYRRSQAYIELVDLDLAEMDIKKALEIDPDNRDVKLVSKTLKEKMREYNRRDAKFYGNMFAKWRKLEHMDIKKVPGKQQPQPMAIDSAA

SEQ ID NO: 35644 - DNA, 343 bp, Panicum virgatum
  misc_feature: Ceres CLONE 1962486
  misc_feature: Encodes the peptide sequence at SEQ ID NO. 35645
atcattcgtctgctgatttccgaatcacgatcgttagcacatcccagacaccctcccgtcgcgcgttgctcctccgtctcttcagcttctgtgggggtaggaccctactgcactctgcaggacatgacgggaggctgcgagctcacgctgctggggatgtgggcaagcccgttcgtcaccagagcgaagctcgcgctgcacatgacgggcctgagctacgagtacctctaggaggatctcggcgacaacagcgagctcctgctcacctccaaccccgtgcacaacgcggtgcccgtgctcttccactactggaagcccgtctgccagtcgacggtcgtcgtcc

SEQ ID NO: 35645 - protein, 35 aa, Panicum virgatum
  misc_feature: Ceres CLONE 1962486
  misc_feature: SWISSPROT Homolog: EC 2.5.1.18 Glutathione transferase
MTGGCELTLLGMWASPFVTRAKLALHMTGLSYEYL

SEQ ID NO: 35646 - DNA, 680 bp, Panicum virgatum
  misc_feature: Ceres CLONE 1962487
  misc_feature: Encodes the peptide sequence at SEQ ID NO. 35647
atctccaaggtccgtccccccccccccccccctcaaaatccgctgccagaaactcctcgttgattgccggcgttcccgcggccggatttgcgcggcgagactgatggcggtttttccttaattatttttttcacttgtgtttcggtttcttccaggccttccacagcaagaacgggaaggcctacctcttccataaggttgtcaatgtgactcctggagtaaaagaagaccgcatgatgataacaggaatgcatactgtttctgatatcttctgtgtttgctgtggatccattgttggatggaaatatgaagccgcacatgagaagaaccagaggtacaaggaaggaaagtatattctggagaggttcaaggtggcaggcccagacggaagccagtactggattgcacatgatgctcatttggtcggaagtgatgccgacgatatatgaagagggattgggcaagctcaagcatgttggtcatcccctgtaaataacttgggtggtgttggtctttagccagccggggattgctcccattgaaaaaaatccccggcgtaaatgttgctgtaggtgacctggtcatatccctctcgatttgcctggaacttagttgactgtttccgtctgtatatgcttgtaatctctgttgcttaatggcccaataaaaatctgattatc

SEQ ID NO: 35647 - protein, 71 aa, Panicum virgatum
  misc_feature: Ceres CLONE 1962487
  misc_feature (2)..(50): Pfam Name: Yippee Pfam Description: Yippee putative zinc-binding protein
MMITGMHTVSDIFCVCCGSIVGWKYEAAHEKNQRYKEGKYILERFKVAGPDGSQYWIAHDAHLVGSDADDI

SEQ ID NO: 35648 - DNA, 401 bp, Panicum virgatum
  misc_feature: Ceres CLONE 1962496
  misc_feature: Encodes the peptide sequence at SEQ ID NO. 35649
acacactcgcagctgatccaccgctgaagtaatttgcagatcgagagagaagcgaaaccatggcgtccaaggcgctcctagtgctcgcgctcctgctcgctgctgctttccttgtcgcctcagctaacaacgagcacacccagccgaaggaggaggagagcaagcaggccggcgtgcaggactaccaccgcggcggcggctaccccggcggcggctggcgcggaggaggcggctaccccggcggcggccggcgcgggggcggtggctaccctggccacggcggcggcggcgggtactgccggtgggggcgctgcaaccgcggctactactgcggctgccgcagctgctcaccccccgacaacatcccggagccattgtcccgctcggatttcgcccaggtc

SEQ ID NO: 35649 - protein, 113 aa, Panicum virgatum
  misc_feature: Ceres CLONE 1962496
  misc_feature (1)..(93): Pfam Name: GRP Pfam Description: Glycine rich protein family
MASKALLVLALLLAAAFLVASANNEHTQPKEEESKQAGVQDYHRGGGYPGGGWRGGGGYPGGGRRGGGGYPGHGGGGGYCRWGRCNRGYYCGCRSCSPPDNIPEPLSRSDFAQ

SEQ ID NO: 35650 - DNA, 640 bp, Panicum virgatum
  misc_feature: Ceres CLONE 1962508
  misc_feature: Encodes the peptide sequence at SEQ ID NO. 35651
gcacccgcttccacacttcttgtcaccatggtaaagacagttcaaacaacatccttccttgctattccagaaggagtcaaagtcgcaaccgcagcaagagaagtcaaagtcactggaaccagaggagtcctcacccgttcattcaaacccctcccagtcgacatccaagttgtcggaaaaagattaaaaatcgaagtttggtttggaaacagagcacatgttgcagcagtcaaaactgtgacaacccacattaaaaatatgttcttaggagtaacaaagggattccaatacaatatgcgtatagtttatgcccactttccaatcaatgctgctatcgttgatgatggtaaaggaatcgaaatcagaaattttttgggacaaaaagtcgtccgaagagtcaaaatgcacccaggagtcacaattacaagatctgagaaaatcaaggatcaacttgaactccgtggaaatgatattgaaaacgtcggtctcaccgctgctgttattcaccaaaaatgtactgtcaaagagaaggatatcagaaaatttttggatggtatctatgtttcccaacgtggactcatcggagactttgataacatgtaaagagtttgaatatgaaaaaataaaccaagtgagctcg

SEQ ID NO: 35651 - protein, 191 aa, Panicum virgatum
  misc_feature: Ceres CLONE 1962508
  misc_feature (13)..(85): Pfam Name: Ribosomal_L6 Pfam Description: Ribosomal protein L6
  misc_feature (97)..(176): Pfam Name: Ribosomal_L6 Pfam Description: Ribosomal protein L6
MVKTVQTTSFLAIPEGVKVATAAREVKVTGTRGVLTRSFKPLPVDIQVVGKRLKIEVWFGNRAHVAAVKTVTTHIKNMFLGVTKGFQYNMRIVYAHFPINAAIVDDGKGIEIRNFLGQKVVRRVKMHPGVTITRSEKIKDQLELRGNDIENVGLTAAVIHQKCTVKEKDIRKFLDGIYVSQRGLIGDFDNM

SEQ ID NO: 35652 - DNA, 597 bp, Panicum virgatum
  misc_feature: Ceres CLONE 1962517
  misc_feature: Encodes the peptide sequence at SEQ ID NO. 35653
agagagagatcagccttgatggattcagaaaccggcggttcaatgttcttgtggctactgatgttgcagggcgtggtattgatattcctgatgttgcacatgtgattaactatgagatgcctagttcaattgacacgtacacacatcgcattggaagaacaggacgtgctggaaagaagggagtagcaacttcatttttaacgctggacaatactgacattttctttgatctgaaacagatgctcattcagagcaacagtcccgtgccacctgaacttgcaagacacgaggcatcaaaatttaagccaggctcaattcctgatagacctccaaggcgaaatgacacagtcttcgcaaatcattgaagcaaacctaccccagtaggggttgaagatcctttggactattatgagcacaatttctactggaaagaaagggatctagattagtatttaagaggtacaaagaccatgatgattagagtcgttttaatttgtgttcggaaactggctttatattgtcataacttcagtatatcttggtgatgatgacatgtgtatcctatcatgatctttgtgctattacgcaaattttgac

SEQ ID NO: 35653 - protein, 120 aa, Panicum virgatum
  misc_feature: Ceres CLONE 1962517
  misc_feature (1)..(57): Pfam Name: Helicase_C Pfam Description: Helicase conserved C-terminal domain
REISLDGFRNRRFNVLVATDVAGRGIDIPDVAHVINYEMPSSIDTYTHRIGRTGRAGKKGVATSFLTLDNTDIFFDLKQMLIQSNSPVPPELARHEASKFKPGSIPDRPPRRNDTVFANH

SEQ ID NO: 35654 - DNA, 579 bp, Panicum virgatum
  misc_feature: Ceres CLONE 1962528
  misc_feature: Encodes the peptide sequence at SEQ ID NO. 35655
gcatccccttcctcgaccgaaatgccaaagcaatactctaaaaagccagaaaacgcaactaaggccgttcatgccaagggatctaacttacgtgttcacttcaaaaacaccagagaaactgccatggctatcaaaggaatgcaccttagaaaggctcaaagatatttacaagatgttgttgaccacaaacaaattgttcctttccgtcgatttcgtggtggtattggtagaaaagcacaagccaaggcacataaaaacaccgatcatcaagctcgttggccagaaaagtccgccaagtttctcttaaacttgttgaagaatgctgaatcaaacgctgaatttcgccaacttaaaccagaagcacttgaagttgttcacgtacaagtaaatcaagcaccaaaaatgagaagaagaacctacagagctcatggtcgtattaatgcatacatgagaagcccatgtcacattgaattaattttgactgaaaaagaaaaagctgtcaagaaaccaaagaaggaaaagaaggcaaaagcaccagctgctgaagttaaagccttggcatcttagtttactgactgg

SEQ ID NO: 35655 - protein, 181 aa, Panicum virgatum
  misc_feature: Ceres CLONE 1962528
  misc_feature (18)..(155): Pfam Name: Ribosomal_L22 Pfam Description: Ribosomal protein L22p/L17e
MPKQYSKKPENATKAVHAKGSNLRVHFKNTRETAMAIKGMHLRKAQRYLQDVVDHKQIVPFRRFRGGIGRKAQAKAHKNTDHQARWPEKSAKFLLNLLKNAESNAEFRQLKPEALEVVHVQVNQAPKMRRRTYRAHGRINAYMRSPCHIELILTEKEKAVKKPKKEKKAKAPAAEVKALAS

SEQ ID NO: 35656 - DNA, 536 bp, Panicum virgatum
  misc_feature: Ceres CLONE 1962541
  misc_feature: Encodes the peptide sequence at SEQ ID NO. 35657
atcgtgctgagctttgaggataggaagctgcccatccaccacatccctggtccagagggtgtccgcgggcgcaactctgacaacacccttatcaaggagaagctcgggtgggctccgacaatgaggctcaaggacgggcttcggttcacctacttctggatcaaggagcagatcgagaaggagaagacccagggcatcgacgtcgcggcgtacgggtcctccaaggtggtgtcgacccaggcgcccgtgcagctgggctccctccgtgccgctgatggcaaggagggcctctgagtcccgatcccataactgcatacggaagctgtcggagagttgttgggacgtacagtagagagtgagtaaaacagcaaacatacggtttagcccctttgagtggggttagagacgatcggtcgtgttctattcggtattcaccactccattagttttggtgtcatcttggtaattgcctgtgtattttgacattaagtgtgctcctatgcccgtgatgaacaataaaattccctgtttctatc

SEQ ID NO: 35657 - protein, 97 aa, Panicum virgatum
  misc_feature: Ceres CLONE 1962541
  misc_feature: SWISSPROT Homolog: EC 5.1.3.18 GDP-mannose 3,5-epimerase
IVLSFEDRKLPIHHIPGPEGVRGRNSDNTLIKEKLGWAPTMRLKDGLRFTYFWIKEQIEKEKTQGIDVAAYGSSKVVSTQAPVQLGSLRAADGKEGL

SEQ ID NO: 35658 - DNA, 475 bp, Panicum virgatum
  misc_feature: Ceres CLONE 1962543
  misc_feature: Encodes the peptide sequence at SEQ ID NO. 35659
agcccaaaccccctcagcctcgatctcgagtctttgctctcgctttcctcgctgcgctccaggaaacgcctattccttagttcaagatgcagatctttgtcaagaccctcaccggcaagaccatcacactcgacgtcgagagctcagacaccattgacaatgtgaaggcgaagatccaggacaaggagggcatcccgccggaccagcagcgcctcatcttcgccggcaagcagctggaggatggccgcaccttggctgactacaacatccagaaggagtccacccttcacctcgtcctccgcctccgcggtggccagtgagccatgagtgccgttgttcatcgtttcagaatgtgtgctctggctttaataattgtgtaaacactctttagcagtactcagtttggttttcagtgttattaatctgttttcctgtgttacgtcaaaaaaaaaaaaaaaacaatctgttttcctgt

SEQ ID NO: 35659 - protein, 77 aa, Panicum virgatum
  misc_feature: Ceres CLONE 1962543
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLDVESSDTIDNVKAKIQDKEGIPPDQQRLIFAGKQLEDGRTLADYNIQKESTLHLVLRLRGGQ

SEQ ID NO: 35660 - DNA, 663 bp, Panicum virgatum
  misc_feature: Ceres CLONE 1962554
  misc_feature: Encodes the peptide sequence at SEQ ID NO. 35661
ctacagcgagttcgtcccctcctcctccctgctgcttccgccgatcgacttgcccgctcgattccgcgaacccctcggcccgatcggctcctccggtcgcctccctcggcgcgcgcttcgatcggttgctggcgtttgcggatggccaagacttgcttcaagatggagcatgacctatgtgattgttgagaaagctggcaagactgatgtcccagagatcgataaaaagaagtaccttgtacctgctgatctcaccgttggccaatttatctatgtggtgaggaagaggatcaagctgagcccggagaaggccatcttcgtctttgttaaggacactttgccacccactgcctctttgatgtctgcgatctacgaggagaacaaagatgaggacggcttcctctacatgacttacagtggcgagaacaccttcggctctgcctaagcaatcgcacccgtcactgtaaataaacaagcgtgatcaggctgctgctgccgtcgcaaacatggtgtacatacacgttgactatgctgccggatcgcttcatggcttaatgcgtccttaggtagtcagatactatttgcttctggattgaaacatttgctattccactatttctgcacttgcctttgggctcgtctgtgattggctttgtctgtgtt

SEQ ID NO: 35661 - protein, 91 aa, Panicum virgatum
  misc_feature: Ceres CLONE 1962554
  misc_feature (4)..(89): Pfam Name: MAP1_LC3 Pfam Description: Microtubule associated protein 1A/1B, light chain 3
  misc_feature: Functional homolog of the protein sequence given in SEQ ID NO 50573
  misc_feature: Useful for making plants with modulated nitrogen use efficiency
MTYVIVEKAGKTDVPEIDKKKYLVPADLTVGQFIYVVRKRIKLSPEKAIFVFVKDTLPPTASLMSAIYEENKDEDGFLYMTYSGENTFGSA

SEQ ID NO: 35662 - DNA, 744 bp, Panicum virgatum
  misc_feature: Ceres CLONE 1962562
  misc_feature: Encodes the peptide sequence at SEQ ID NO. 35663
agcttctttccgctgtgtgcaaccgacccattggaccaaatgctcgcccgttcgctcctccatctttccagagccgcttctgcccgaagcttcggctcctcggcttccttgcttggtgccgaaactctgccaaactctcagagcccagccttccaagatggttcgaatgcgatcgcttctcctaactttggtgaggtcttccgctccaaggagaccggcaaccctgctaagctcgccttctcctactttgtgatcggcgctgctggttccctgtacgcaaccgctatcaaggcaggcgcagtagacttcctgtcgacgatgaaccctggtaaggacacaatggccatggccaacatcgaggtggacttgaacgaggttgccgaaggaacgaccgtgacattgaagtggcgtggtaagcctctgttcgttcgtcacaggtccgctgcggaaatcgcttctgctcgtgccgacgacacagcctccctcaaggaccccatgccagaccacctccgcgtcaagaaccccaagtatctcattgtccttggtatctgcacgcacttgggctgcgttcccttgaagaacgtgggtaactatggtggcttcttctgcccttgccatggatcgcattacgacacctcaggccgaattcgccaaggtcctgccccgctcaatctcgaaatccccaagtacaagttcttgtcagagagtaccatccttgttggcgaggaataaaaaataaccaac

SEQ ID NO: 35663 - protein, 243 aa, Panicum virgatum
  misc_feature: Ceres CLONE 1962562
  misc_feature (141)..(233): Pfam Name: Rieske Pfam Description: Rieske [2Fe-2S] domain
  misc_feature (54)..(112): Pfam Name: UCR_TM Pfam Description: Ubiquinol cytochrome reductase transmembrane region
  misc_feature: SWISSPROT Homolog: EC 1.10.2.2 Ubiquinol--cytochrome-c reductase
SFFPLCATDPLDQMLARSLLHLSRAASARSFGSSASLLGAETLPNSQSPAFQDGSNAIASPNFGEVFRSKETGNPAKLAFSYFVIGAAGSLYATAIKAGAVDFLSTMNPGKDTMAMANIEVDLNEVAEGTTVTLKWRGKPLFVRHRSAAEIASARADDTASLKDPMPDHLRVKNPKYLIVLGICTHLGCVPLKNVGNYGGFFCPCHGSHYDTSGRIRQGPAPLNLEIPKYKFLSESTILVGEE

SEQ ID NO: 35664 - DNA, 521 bp, Panicum virgatum
  misc_feature: Ceres CLONE 1962567
  misc_feature: Encodes the peptide sequence at SEQ ID NO. 35665
aacaaacgctaaaaaagtaacagtttctgtactttattgtgggatacaatggtggctgttcgcaggaaggttggcgcgcgcggtcagctccgcatgccggcgctgccgaagggcaagaaggtcttcaagatcgactgctcgacgcccgctcaggacgagatcatggacgctgacatgctcaacgccttcacgcagtacctcaccgagaacgtgaagctgcacggccgcaagggcaagctcggcgacaaggtcaaggtgacgtcggagaacaacgtcatcaccgtcgcgacgacgatggcgtaccgcaagaagtacttcaagtacctcacgaagaagttcctgaagaagaagaacctccgcgactggctccgcatcctcgccacgaagaagggcgagtacacgctccgctactacaacatccaggacaacgaggaggaggagcaggagtaaccactctctgaattcccttcgcccctggtgtcacgcctggcatcccacggtgttttcgaacctctctcatt

SEQ ID NO: 35665 - protein, 133 aa, Panicum virgatum
  misc_feature: Ceres CLONE 1962567
  misc_feature (22)..(132): Pfam Name: Ribosomal_L22e Pfam Description: Ribosomal L22e protein family
MVAVRRKVGARGQLRMPALPKGKKVFKIDCSTPAQDEIMDADMLNAFTQYLTENVKLHGRKGKLGDKVKVTSENNVITVATTMAYRKKYFKYLTKKFLKKKNLRDWLRILATKKGEYTLRYYNIQDNEEEEQE

SEQ ID NO: 35666 - DNA, 424 bp, Panicum virgatum
  misc_feature: Ceres CLONE 1962588
  misc_feature: Encodes the peptide sequence at SEQ ID NO. 35667
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacgactcgctccacaacgccttcagccccttcggcgaggtcctcgagtccaagatcatcctcgatcgtgagacccagaggtcccgcggcttcggcttcgtcaccttctcgagcgatcaggcgatgcgcgatgccatcgaggggatgaacggccaggagctggacggccgcagcatcaccgtcaatgacgcccgctcccgcggtggcccactctccggcggctgcggagggagcaacgggcgccgtgaggggggctgtggatccgctgt

SEQ ID NO: 35667 - protein, 109 aa, Panicum virgatum
  misc_feature: Ceres CLONE 1962588
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAASDVEYRCFVGGLAWATDDDSLHNAFSPFGEVLESKIILDRETQRSRGFGFVTFSSDQAMRDAIEGMNGQELDGRSITVNDARSRGGPLSGGCGGSNGRREGGCGSA

SEQ ID NO: 35668 - DNA, 690 bp, Panicum virgatum
  misc_feature: Ceres CLONE 1962603
  misc_feature: Encodes the peptide sequence at SEQ ID NO. 35669
gaaagcgaaaaagtgaactggcttcccctcccctgccgcaagcgccgcagcgccatggacgccggcgcgaaggagcagagggacccggcgtggtggggccgccgagcgtggtcgctcctctcggccgtccgcgcgcgggcgccgctggtgcagtgcatcaccaacctggtctccatggacatcgccgccaacgcgctcctcgcggcgggggcgtccccggccatggtccactccctccgcgaggtgcccgacttcaccccgcgctgcgacgccgtgtacgtcaacgtcggcacgctctccgaggactggctcccctctatgcgcgccgcggcctcggccggccggccatgggtgctcgaccccgtggccgccaccgcttccgggttccgaatggaggcctgccttgagctgctcgcgctccgccccgccgtcgtcaggggtaacgcctccgagatcctcgcgctcgccgaccgctcggtacccgccgcgtccaactttaagggtgccgacagttcacatgagtctgtggacgcccttgaagctgcaaaagcgttagcactgtccagcggctctgtcgttgcggtatccggagctgttgatttcatcaccaatggggagcaggttgtcggcgcaagcaacggtgtgcccatgatgcaaaagatcacagcgacagggtgcgctgtgaccgcc

SEQ ID NO: 35669 - protein, 211 aa, Panicum virgatum
  misc_feature: Ceres CLONE 1962603
  misc_feature (22)..(211): Pfam Name: HK Pfam Description: Hydroxyethylthiazole kinase family
  misc_feature: SWISSPROT Homolog: EC 2.7.1.50 Hydroxyethylthiazole kinase
MDAGAKEQRDPAWWGRRAWSLLSAVRARAPLVQCITNLVSMDIAANALLAAGASPAMVHSLREVPDFTPRCDAVYVNVGTLSEDWLPSMRAAASAGRPWVLDPVAATASGFRMEACLELLALRPAVVRGNASEILALADRSVPAASNFKGADSSHESVDALEAAKALALSSGSVVAVSGAVDFITNGEQVVGASNGVPMMQKITATGCAVT

SEQ ID NO: 35670 - DNA, 730 bp, Panicum virgatum
  misc_feature: Ceres CLONE 1962612
  misc_feature: Encodes the peptide sequence at SEQ ID NO. 35671
aacaaacgctaaaaaagtaacagtttctgtactttattgcgtcccagcagcaatgggcgtttacacgtacgtgaacgagctgtggaagaagaaggcgtccgacgtgatgcgcttcgtgcagcgtgtccgctcgtgggagtaccgccaccagcacgccatcgtgcgtctgcgccgccccacccgcccggagaaggcccgcgccctcggcttcaagtcgaagcagggcttctccgtcttccgcgtgcgcatccgccgtggtggccgcaagcgcccgttccacaagggtatcacgtacggcaagccgaagacggctggtgtgaccggcatcaagctgcagaagaacaagcgcgctgtcgcggagcagaagctcggcaaggagttcggcaacctgcgcgtgctcaactcgtactgggtgaacaacgactcgaccttctgctggtacgaggtggtcgccgtggacccgatgcacaaggtgatccgccgtgacccgaagatcaactggatcgtcgacgccgtccacaagcaccgcgagcagcgcggcctcacgtccgcgggccgcaagcaccgtggtctgcgcaacaagggccacttggcgaacaagatccgcccgtccgtgcgcgccacgtggcgccgcaacaaccgcgtcatcttctggcgcaagcgttaatgcccttcccggcatgcatgtgggacgcaaccccttacggattctcctctcaccgtttcatgg

SEQ ID NO: 35671 - protein, 204 aa, Panicum virgatum
  misc_feature: Ceres CLONE 1962612
  misc_feature (2)..(193): Pfam Name: Ribosomal_L15e Pfam Description: Ribosomal L15
MGVYTYVNELWKKKASDVMRFVQRVRSWEYRHQHAIVRLRRPTRPEKARALGFKSKQGFSVFRVRIRRGGRKRPFHKGITYGKPKTAGVTGIKLQKNKRAVAEQKLGKEFGNLRVLNSYWVNNDSTFCWYEVVAVDPMHKVIRRDPKINWIVDAVHKHREQRGLTSAGRKHRGLRNKGHLANKIRPSVRATWRRNNRVIFWRKR

SEQ ID NO: 35672 - DNA, 361 bp, Panicum virgatum
  misc_feature: Ceres CLONE 1962643
  misc_feature: Encodes the peptide sequence at SEQ ID NO. 35673
acagaccactcgaccttctcagctttgcttctctcctagctatctttaggctccggttgctgctagaagcaaggcaggcatggaggggaaggaggaggacctccccctgggcgccaccaagtcctccgagcgccaccccatcggcacggcggcgcatggcaccgatgacacggactacaacgagcccccgccggcgccgctcttccagcccggggagctcaagtcctggtccttctaccgcgccggcatcgccaagtttcctccccaccttcctcttcctcctacatatacttcctcaccgtcttgggcgtcaacaagtccctatcctcagtgcgccccctccggcctcccgggcatcgcc

SEQ ID NO: 35673 - protein, 93 aa, Panicum virgatum
  misc_feature: Ceres CLONE 1962643
  misc_feature: Functional homolog of the protein sequence given in SEQ ID NO 50195
  misc_feature: Useful for making plants with modulated water use efficiency
MEGKEEDLPLGATKSSERHPIGTAAHGTDDTDYNEPPPAPLFQPGELKSWSFYRAGIAKFPPHLPLPPTYTSSPSWASTSPYPQCAPSGLPGI

SEQ ID NO: 35674 - DNA, 694 bp, Panicum virgatum
  misc_feature: Ceres CLONE 1962645
  misc_feature: Encodes the peptide sequence at SEQ ID NO. 35675
ggaagtcagagctcgcaaagacccttgctgcctattactttggctctgaggaggctatgatccggcttgatatgagtgaatttatggagaggcacacagtgtccaagctgatcggttcacctccaggatatgttggatacactgagggtggccaactgacagaggcagttcgacggcggccatacacagttgtgctctttgatgagattgagaaggcacaccctgatgtcttcaacatgatgctccagattttggaagatgggaggttgcccgacagcaagggaagaacggtggacttcaagaacaccctcctgatcatgacctcaaatgttgggagcagtgtcatcgagaagggtgggcgcaagattggttttgacctcgactctgacgagaaggacagcagctacggcaggatcaagagcctcgtcattgaggagatgaagcagtacttccgccctgagttcctcaaccgtcttgatgagatgatcgtcttcaggcagctcaccaagctcgaagtcaaggagattgcggacatcatgctccaggaggtctttgaccgactcaaggccaaggacatcaacctgcaggtcactgagaagttcaaggagcgggtggtggacgaaggctacaaccccagctacggtgcgcggccgttgaggcgggctatcatgaggctgctggaggacagccttgc

SEQ ID NO: 35675 - protein, 230 aa, Panicum virgatum
  misc_feature: Ceres CLONE 1962645
  misc_feature (1)..(161): Pfam Name: AAA_2 Pfam Description: ATPase family associated with various cellular activities (AAA)
KSELAKTLAAYYFGSEEAMIRLDMSEFMERHTVSKLIGSPPGYVGYTEGGQLTEAVRRRPYTVVLFDEIEKAHPDVFNMMLQILEDGRLPDSKGRTVDFKNTLLIMTSNVGSSVIEKGGRKIGFDLDSDEKDSSYGRIKSLVIEEMKQYFRPEFLNRLDEMIVFRQLTKLEVKEIADIMLQEVFDRLKAKDINLQVTEKFKERVVDEGYNPSYGARPLRRAIMRLLEDSL

SEQ ID NO: 35676 - DNA, 1128 bp, Panicum virgatum
  misc_feature: Ceres CLONE 1962657
  misc_feature: Encodes the peptide sequence at SEQ ID NO. 35677
gaggccatcgatcacggagtcccccggaggccagaccagtctcagattcagacgccggccggccggccgggctaatcagctctagcaacacgctaggcgataggttagtgatacagtagtgagtggtcgctggtgctagaggaatcgatcggagtttcgatcggcagccatccatcgatcgaggagggacttgccacgatcgagcaggcggggccatggcggcacggatggtcgtcggagtggccgcggccctgctcgccgtgctcctggcggcggcggcgaccggcgctgacggccgcgacttccacgtcggcggccgcgccgggtgggcgcccaaccccgccgagcccttcaacacctgggccgagcgcaaccgcttccaggtcaacgacaccctcgtgttcaggtacaacaaggacgcggacgccgtgctggtggtgaccccgagccactacgacgcctgcaacaccacggagcccgccctccggctcgccggcggcgactcccgcttcgtgttcaacgcctccgggccctacttcttcatcagcgccgacgaggggcgctgcagggccggcgagcgcctcatcgtcgtcgtcctcgccgtccgcaacaacggcgccgccaacacgccatcgcctgcgctcccgcccaagtcgtcatcgtcgccccctacaccgccgcctcctgccgcaacacctgctccgcgcgcgttgcccccgccgccctcgccaccgaagtcgtcatcgccaccgcccaagtcgtcgtcgtcgccgccgccgacatccccgcctgctgccactaacgtgacgtcgtcgccaccgtcaccatcgtcgtccgcgggcgccttgaggggtggcgtccttgcgtgccttatcgtcggtggagcagcgattctggtctgatatggtcgatcggtctcgtgccccggacctgcaatccggccatgttgctgatgaaacctcattgtctttcctttagttggtgatttagaatttctagcttctgagttttagggctcgcgtcaaaatatctttttttcttcgtttggtgggtcgattatcgagatttttcagtcgttggaagtgggatattcaatctttagaaccaatgaaacacatttattaagac

SEQ ID NO: 35677 - protein, 228 aa, Panicum virgatum
  misc_feature: Ceres CLONE 1962657
  misc_feature (38)..(121): Pfam Name: Cu_bind_like Pfam Description: Plastocyanin-like domain
MAARMVVGVAAALLAVLLAAAATGADGRDFHVGGRAGWAPNPAEPFNTWAERNRFQVNDTLVFRYNKDADAVLVVTPSHYDACNTTEPALRLAGGDSRFVFNASGPYFFISADEGRCRAGERLIVVVLAVRNNGAANTPSPALPPKSSSSPPTPPPPAATPAPRALPPPPSPPKSSSPPPKSSSSPPPTSPPAATNVTSSPPSPSSSAGALRGGVLACLIVGGAAILV

SEQ ID NO: 35678 - DNA, 438 bp, Panicum virgatum
  misc_feature: Ceres CLONE 1962668
  misc_feature: Encodes the peptide sequence at SEQ ID NO. 35679
gccacctggtctatgtttctctgagcctgagggaatgaaaacaataaaatgtgtcatcgttggcgacggcggtgtaggaaaaacatccatgctcatcacttatacaacgagatccttcccaactgaattcataccacaagtattccatcattattcaacatcagatggactgccatgcactttggggctctgggacaccgcaggccaagccgaatacgaccgtttaaggccactgacttatccacaaactgaaatttttttgattgtattttctattgacagcccttcttcctatgaggcctcacaaaccaaatgggctggacaacttagtcaccattgtcctgatatccccgccatctctggttggagcaaaatttgatttaacagataaaccctcccccgatttcgttacatttgagcaaggacaggggcagtgct

SEQ ID NO: 35679 - protein, 125 aa, Panicum virgatum
  misc_feature: Ceres CLONE 1962668
  misc_feature (16)..(124): Pfam Name: Ras Pfam Description: Ras family
  misc_feature: Functional homolog of the protein sequence given in SEQ ID NO 50617
  misc_feature: Useful for making plants with modulated nitrogen use efficiency
PPGLCFSEPEGMKTIKCVIVGDGGVGKTSMLITYTTRSFPTEFIPQVFHHYSTSDGLPCTLGLWDTAGQAEYDRLRPLTYPQTEIFLIVFSIDSPSSYEASQTKWAGQLSHHCPDIPAISGWSKI

SEQ ID NO: 35680 - DNA, 709 bp, Panicum virgatum
  misc_feature: Ceres CLONE 1962687
  misc_feature: Encodes the peptide sequence at SEQ ID NO. 35681
atttataaggaaggcaaagcggcggccatgtcgtcatccgacgcggcggcggcggcggccaggaagggtcggctcaagcagcgctacgacaacgagttccgcctcgtcgcggggtgcgtgccgtaccgggtgaagaaggacgacgagggcaacccgtgcagcagcctcggcggcgacccggcggaggtggaggtgctcatgatctccacgcctaaccgggcagacatggtcttccccaagggcgggtgggaggacgacgaggacgtgtaccaggccgcgtcccgcgaggtcatggaggaggccggcgtcaagggcgtcatcaacagagctgcactgggacactgggtgttcaagagcaagagcagccagaacagcaccagccccagggtagcctgcaagggctgcatcttcgccatggaggtcaccgaggagctcgagtcatggccggagcaggaaacccacaaccggcgatgggtctcccccgccgaagcctaccagctttgccggtacgactggatgcgggaggcgctcaccgcgctgctggagcggctatcggtgatggagccggtggccgcggcggcggcggcggccacgcaggagctgaccgaccagccaggaatgtacatgatgctgcaggcgagctcggacggcgcggtggcgctgtgctgatggacgagagacgctgctgctgctgctgtggataactgat

SEQ ID NO: 35681 - protein, 213 aa, Panicum virgatum
  misc_feature: Ceres CLONE 1962687
  misc_feature (24)..(174): Pfam Name: NUDIX Pfam Description: NUDIX domain
  misc_feature: SWISSPROT Homolog: EC 3.6.1.52 Diphosphoinositol-polyphosphate diphosphatase
MSSSDAAAAAARKGRLKQRYDNEFRLVAGCVPYRVKKDDEGNPCSSLGGDPAEVEVLMISTPNRADMVFPKGGWEDDEDVYQAASREVMEEAGVKGVINRAALGHWVFKSKSSQNSTSPRVACKGCIFAMEVTEELESWPEQETHNRRWVSPAEAYQLCRYDWMREALTALLERLSVMEPVAAAAAAATQELTDQPGMYMMLQASSDGAVALC

SEQ ID NO: 35682 - DNA, 750 bp, Panicum virgatum
  misc_feature: Ceres CLONE 1962697
  misc_feature: Encodes the peptide sequence at SEQ ID NO. 35683
gagttgggcacagcgcgcttcggctaggtcctcatcctccgcccattcctccttccccgcagggggctgacaagattctcatgctgttttcttgaagctgttgtgcggtttgtcagtgcacaatgaaagctaaagaacccaagaagacaaggtgctgtgtcaaatgggatgaagagaacttgaatgacattgagtcaaacaaaccagaacgagaaaagatcaacgagcccaagacaccgtaccacccaatgattgatgaagacgaagggcctgtttcaccattacaactaagtgaagagtcggtggataaatctgctcatgctgatgccatcaaaactgctttagctgaagctgtttccagtggaaagattttcgacagaagtagttgggaatcatgtgacaatgaagaagccataaaacaaggcaaagcttttgaggagcagcggaaggttcactatgatgaataccataagatgaaggagctgcttcagaagggaaccatgaatgatgatgcagatgaagatgagagcgtaccagacaagaggaaggagtgatgattctgtcacggtctgaactttgatcagaaaatcttctgcatctgactgttggaatcttggaaaagtttgttgtttggggtacttcaggactacataactgtttcagtatttcctgcacagaacttgggtgttctcttccttacactagtctggaactgtatgccatgattcaggcatctttgcagctgaaaac

SEQ ID NO: 35683 - protein, 143 aa, Panicum virgatum
  misc_feature: Ceres CLONE 1962697
  misc_feature (10)..(135): Pfam Name: IPP-2 Pfam Description: Protein phosphatase inhibitor 2 (IPP-2)
MKAKEPKKTRCCVKWDEENLNDIESNKPEREKINEPKTPYHPMIDEDEGPVSPLQLSEESVDKSAHADAIKTALAEAVSSGKIFDRSSWESCDNEEAIKQGKAFEEQRKVHYDEYHKMKELLQKGTMNDDADEDESVPDKRKE

SEQ ID NO: 35684 - DNA, 582 bp, Panicum virgatum
  misc_feature: Ceres CLONE 1962700
  misc_feature: Encodes the peptide sequence at SEQ ID NO. 35685
aaattaaataaatcatgtctgaacaaagaaaggaccgttctcacaagaagtacaccttcagaggcctctccctcgaagatcttgttgccctcaacactgatcaacttaagagccacctcagagccagaatcagaagaagattcaacagaggtcttaagcataaatacaccagactcgtccaaaagctcagaaaggccaagatcggtgttcaacctggtgaaaagcccgtcgctgtcaagactcacctcagaaacgccatcgtccttcccgaaatggtcggatccgttgttggtgtccacaccggtaaagaattcgccaatgtcgaaatcaagttcgatatgatcggcagatacctcggtgaattcggtctttcctacaagcccacttcccatggtaagcccggtattggtgctaccaagggttccaccgccacttcccttaagtaatccttgctacgctggagaagaacctcaagaagacaacgacttgcttggagagattatcaacagaagtttcgttgtttggctgggtgtatatttgtggtgatttaatttgttctaagttctatgctgcatgcacaaa

SEQ ID NO: 35685 - protein, 143 aa, Panicum virgatum
  misc_feature: Ceres CLONE 1962700
  misc_feature (45)..(126): Pfam Name: Ribosomal_S19 Pfam Description: Ribosomal protein S19
MSEQRKDRSHKKYTFRGLSLEDLVALNTDQLKSHLRARIRRRFNRGLKHKYTRLVQKLRKAKIGVQPGEKPVAVKTHLRNAIVLPEMVGSVVGVHTGKEFANVEIKFDMIGRYLGEFGLSYKPTSHGKPGIGATKGSTATSLK

SEQ ID NO: 35686 - DNA, 625 bp, Panicum virgatum
  misc_feature: Ceres CLONE 1962708
  misc_feature: Encodes the peptide sequence at SEQ ID NO. 35687
atctgcaagtcaagtctcactagtcactcctaatcctaaaccacaagacaccttggtgttggaagtgcaatggcgaccagcaccatggccctctcctctacggccttcgccggcaaggccgtcaacgtgccatcgtctctctttggcgaggcccgcgtgaccatgcgcaagaccgcggcgaagcccaagccggctgcctccggcagcccgtggtacggcccagaccgcgtgctctacctcggcccgctctccggcgagcccccgagctacctgaccggcgagttccccggcgactacggctgggacaccgccgggctctcggccgaccccgagaccttcgccaagaaccgggagctggaggtgatccactcccgctgggccatgctcggcgcgctcggctgcgtcttccccgagctgctcgcccgcaacggcgtcaagttcggcgaggccgtctggttcaaggcgggttcccagatcttcagcgagggcgggcttgactacctcggcaacccaagcctgatccacgcgcagagcatcctcgccatagtcaccggcaagggcccgcttgagaacctcgccgaccatctcgccgaccccgtcaacgacaacgcctgggcctacgcca

SEQ ID NO: 35687 - protein, 180 aa, Panicum virgatum
  misc_feature: Ceres CLONE 1962708
  misc_feature (58)..(180): Pfam Name: Chloroa_b-bind Pfam Description: Chlorophyll A-B binding protein
MALSSTAFAGKAVNVPSSLFGEARVTMRKTAAKPKPAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIVTGKGPLENLADHLADPVNDNAWAYA

SEQ ID NO: 35688 - DNA, 788 bp, Panicum virgatum
  misc_feature: Ceres CLONE 1962718
  misc_feature: Encodes the peptide sequence at SEQ ID NO. 35689
ccgggtgcgagggcggcgtccccagccgtccgtccccgtcccaccatctggagttctggtcctgcccccagtcccccacccggccacccccaccggcgcagcgcgaggggagcttcgcaatctgccgcggctcgtctagcctcgtctttcgcctcgaatccccggcgccggcggcggaatttcgcgggcggagcagagggcacgctcgtgaagaaaatggcctcattcgcgccgccgtccacggcgtcgtgcgctcgcatcaatggtaggtacaggacttctgagttgccttgtgatacttcgcttctgcccaatgctgcatcaaacagtttaaggataatcagatccattcgcttggaaaatacccaccgattcagaaacctccatgtatcttatgctgggggtgattcatcagagaatattattataaatgggaaaaccaatccatctaatttagttcaagcagatgctgttgcacttgggaccattgcagctgatatggctcctgttgttgatgggttttctgctaatgacgatgagcttgacttagacagcccgacaaagggtttctcatctatacctgaagctattgaggacattcgtcaaggaaaatacgtcattgttgtggatgatgaagacagagagaatgaaggtgatcttataatggcagcatcaaaggtcacacctgaagctatggcttttattgtgaggcatggcactgggattgtttgtgtcagcatgaaagaagaggatctggaaaggctacaacttcctctcatggtgacgac

SEQ ID NO: 35689 - protein, 190 aa, Panicum virgatum
  misc_feature: Ceres CLONE 1962718
  misc_feature (121)..(190): Pfam Name: DHBP_synthase Pfam Description: 3,4-dihydroxy-2-butanone 4-phosphate synthase
  misc_feature: SWISSPROT Homolog: EC 4.1.99.12
MASFAPPSTASCARINGRYRTSELPCDTSLLPNAASNSLRIIRSIRLENTHRFRNLHVSYAGGDSSENIIINGKTNPSNLVQADAVALGTIAADMAPVVDGFSANDDELDLDSPTKGFSSIPEAIEDIRQGKYVIVVDDEDRENEGDLIMAASKVTPEAMAFIVRHGTGIVCVSMKEEDLERLQLPLMVT

SEQ ID NO: 35690 - DNA, 606 bp, Panicum virgatum
  misc_feature: Ceres CLONE 1962722
  misc_feature: Encodes the peptide sequence at SEQ ID NO. 35691
gtgctctctcagaggtgggttggcttttccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaggccatgaacggcaaggagctcgacggccgcaacatcaccgtcaaccaggcccaatcccgcggcggtggcggcggcggcggcggttacggcggcggtcgccagggaggctactgcggccgcggcggcggctacggcggcggtcgccgtgagggcggctacagtggcggcggctacgacggtggcggtggcggatacggcggcggtcgccgcgagggcggctacggcggtggtggctacggcagccgcggtgactccggtggcacctggaggaactaatggggtgcccctcccgtgctgccagccatcctatcctagatagctatagggat

SEQ ID NO: 35691 - protein, 158 aa, Panicum virgatum
  misc_feature: Ceres CLONE 1962722
  misc_feature (10)..(81): Pfam Name: RRM_1 Pfam Description: RNA recognition motif. (a.k.a. RRM, RBD, or RNP domain)
  misc_feature (48)..(150): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
MAAADVEYRCFVGGLAWATDNASLQQAFASYGDVLDSKVITDRETGRSRGFGFVTFSTEQSMLDAIEAMNGKELDGRNITVNQAQSRGGGGGGGGYGGGRQGGYCGRGGGYGGGRREGGYSGGGYDGGGGGYGGGRREGGYGGGGYGSRGDSGGTWRN

SEQ ID NO: 35692 - DNA, 525 bp, Panicum virgatum
  misc_feature: Ceres CLONE 1962732
  misc_feature: Encodes the peptide sequence at SEQ ID NO. 35693
atcaccagcctcgtttcgctttcgcatcaagcaatcagccgaagcaagcaatctagcaactccagccgcctcaactcccaagggaagaggaagcgacggagagaaccaatcggcagagatccaatggcaatggcgatggcgacggaaccgtcctcatgcggcgtgtccctcccggaccacccggtggcggctgcccggcggcggggcgcgggaggggggggatgcctccacttcagagacggggaagggcggtcgtgcgaaatgccgcttcgcggtcatggacagtttcaatggagagaagcttgaggatattgtgccatcttcgcatgactgtgatgagccccatgtcaaccgtactgactatcagctgattgacatatctgaagatggatttgtaagccttctgactgaaaatggaggcaccaaggatgatctgaggctccctactgatgaaactctgctttcccagattaaagctggattcgatgatgggaaggacctgattgttagtgtgatgtctgacat

SEQ ID NO: 35693 - protein, 174 aa, Panicum virgatum
  misc_feature: Ceres CLONE 1962732
  misc_feature (115)..(173): Pfam Name: eIF-5a Pfam Description: Eukaryotic initiation factor 5A hypusine, DNA-binding OB fold
SPASFRFRIKQSAEASNLATPAASTPKGRGSDGENQSAEIQWQWRWRRNRPHAACPSRTTRWRLPGGGAREGGDASTSETGKGGRAKCRFAVMDSFNGEKLEDIVPSSHDCDEPHVNRTDYQLIDISEDGFVSLLTENGGTKDDLRLPTDETLLSQIKAGFDDGKDLIVSVMSD

SEQ ID NO: 35694 - DNA, 548 bp, Panicum virgatum
  misc_feature: Ceres CLONE 1962733
  misc_feature: Encodes the peptide sequence at SEQ ID NO. 35695
gaagcaaattgcacggcctgtgatgaagacctacacagagacgacggacgggtcaacaattgaggagaaggagactgcaattgtttggagctatgaggatgctgatccagatttcggctcttgccaggccaaggagctccacgaccatctggagagtgtcctctcaaacgagcccgtctcggtgaaagctggcctgaaccatgtcgaggtgaagccacagggcgtgagcaagggtctggtggcgaagcggatcctgtcgacgatgcaggagcgcggcgacctgccggacttcatcctgtgcgtaggcgacgaccggtccgacgaggacatgttcgaggtgatcaccgcggcggtggcgcggggccccgcctccctgcacccggaggcggaggtgttcgcgtgcacggtggggcgcaagcccagcatggccaagtactacctgcactaccccgcggacatcgtgcgcctcgtccagggcctctccaacgtctccgacgaccatgcctcgttgcacggcagcagcggcggcgccaccctgcccgacgacg

SEQ ID NO: 35695 - protein, 182 aa, Panicum virgatum
  misc_feature: Ceres CLONE 1962733
  misc_feature (1)..(151): Pfam Name: Trehalose_PPase Pfam Description: Trehalose-phosphatase
  misc_feature: SWISSPROT Homolog: EC 3.1.3.12 Trehalose-phosphatase
  misc_feature: Functional homolog of the protein sequence given in SEQ ID NO 50801
  misc_feature: Useful for making plants with altered carbohydrate content
KQIARPVMKTYTETTDGSTIEEKETAIVWSYEDADPDFGSCQAKELHDHLESVLSNEPVSVKAGLNHVEVKPQGVSKGLVAKRILSTMQERGDLPDFILCVGDDRSDEDMFEVITAAVARGPASLHPEAEVFACTVGRKPSMAKYYLHYPADIVRLVQGLSNVSDDHASLHGSSGGATLPDD

SEQ ID NO: 35696 - DNA, 577 bp, Panicum virgatum
  misc_feature: Ceres CLONE 1962739
  misc_feature: Encodes the peptide sequence at SEQ ID NO. 35697
attcggcctacctagtcaccaacccgcagcgagtgcagctcccctcctcactagaaagccaggatcgccctcgcctagtacctctgcttcccccccccccgcttcccctggtggctcgcgagtgcatgggcggggactgggtgcggtacggatgaggccgcggcggtcgccggcaggggccggagggggagggggcacgccggcgctgccctacctgaacgcgccgtacggggacacccccttcaccaagggcttcttggggggcctcacgtggtacacgcgcaacgaggggatgcccgcgtacttcgaggtctacggggacatcctcgaggtcgtcgtcatcaccgaccgcaccacgggccgctccaagggttaccgattcctaaccttccgggatccacaatccgcgaggatggcctgcatggacccgtacccggttattgatgggcggcgcgctaattgcaatctcgccatcttagggaggcctggtccagctgtgcctttcgtaggacctgtaaggccggtcatcccatacaatggaggtgtggcgcttccagggggtttgtatgtgcaaagc

SEQ ID NO: 35697 - protein, 141 aa, Panicum virgatum
  misc_feature: Ceres CLONE 1962739
  misc_feature (35)..(104): Pfam Name: RRM_1 Pfam Description: RNA recognition motif. (a.k.a. RRM, RBD, or RNP domain)
MRPRRSPAGAGGGGGTPALPYLNAPYGDTPFTKGFLGGLTWYTRNEGMPAYFEVYGDILEVVVITDRTTGRSKGYRFLTFRDPQSARMACMDPYPVIDGRRANCNLAILGRPGPAVPFVGPVRPVIPYNGGVALPGGLYVQ

SEQ ID NO: 35698 - DNA, 466 bp, Panicum virgatum
  misc_feature: Ceres CLONE 1962743
  misc_feature: Encodes the peptide sequence at SEQ ID NO. 35699
agcacaaaacatcgccgcaacctcaatccgctgggtcatggggcccactggaacagttgtgtcattcccacatgcagtaggcctccccagcatcttcgactccaagcctcacaactaccctcctccgagggagaaatgcgctgggccggagtgcacgaacgcgtacaagtacaggcactccaagctgaacctccccctctgcagcctcaagtgctacaaggctgtgcaaggaaacgcttgacaggactctggaaacaggatggcaaagagtgtgtgtgtttttaccgttgcccatgtacgctggtatttgtgcatttgcccttgagttggaaacgatgcaataagcatctgcttgcgcatacatagtaatatagaaatgtataatctacatgtagcattgtgggtagagctgtagaagattttgtactgagattatgattagatcagtaccagatgtcatctcatc

SEQ ID NO: 35699 - protein, 79 aa, Panicum virgatum
  misc_feature: Ceres CLONE 1962743
  misc_feature (42)..(73): Pfam Name: zf-HIT Pfam Description: HIT zinc finger
AQNIAATSIRWVMGPTGTVVSFPHAVGLPSIFDSKPHNYPPPREKCAGPECTNAYKYRHSKLNLPLCSLKCYKAVQGNA

SEQ ID NO: 35700 - DNA, 1206 bp, Panicum virgatum
  misc_feature: Ceres CLONE 1962763
  misc_feature: Encodes the peptide sequence at SEQ ID NO. 35701
agacacctccaaagatgtgttttcggccctctaaagctgcggatccccgcgatgaagcgtcgaacaaggagattgaaagacaaatcagaacagatgccagagaagtgaaacatcaaatgaaactgttgttactggggactggcgattctggtaaatccacattcgcaaagcaaatgggcttagtccacaacaacggtttcaacgatccctttttaaactccttcgtttcaattctaagggagaattgtctgactggtataaccggacttctcgccttctctcgcgaacaaggtcgtgttcttcctaacgaaaaatcgatagaactggcaaaatcgattgaatccgcaacatccttaagcccagaagtagcaaaagaaattatagctctttggaaaacagaaaaggttcaagaaatccttctagaaaaagcagatgcagcacaaattcaaggtcgaaaaagtggtgccatctattatattgaaaacgcagaaagattcgctcaatctgattatgtcccaaccacccctgatgtcctcgccgcaagaagaaaaacaattggaattgttgaaacatcgttcgtcgtagaaagaattaaattcactcttgttgatgttggtggacaaagatcagaaagaaaaaaatggttaaattgtttcggctccgtaacatctgttatttttctaacagcaattaatgaatacgatatgttcctagaagaagacacaaaaacgaatcgattggtcgaatcattaaaactttggaaagcattaacttcttctcaattctttaaaacaactccatttattctctttcttaacaaatctgatctctttgaagaaaaaatcaaaactgttcctctggttaatgtttttgctgattttccagcatatgctgaaacatgtaaaaatataactgattttgaaaaatcttggagatacattgcaaaacagtatacaagtcattttgctggatctgttttttatactcatcttacttgtgctgttgatactcaagcctgttcaaagatatttaattctgtacgtgatacgttaactagggatgttattaatcgtgctggtttcgtttaagaagattggcggatttttagaatattctctagcctctagctcaaaatttatatggttggtcttcaaacaaagaacaatttctcttggtttcgttttcccaataaaatccaactagatc

SEQ ID NO: 35701 - protein, 357 aa, Panicum virgatum
  misc_feature: Ceres CLONE 1962763
  misc_feature (8)..(356): Pfam Name: G-alpha Pfam Description: G-protein alpha subunit
MCFRPSKAADPRDEASNKEIERQIRTDAREVKHQMKLLLLGTGDSGKSTFAKQMGLVHNNGFNDPFLNSFVSILRENCLTGITGLLAFSREQGRVLPNEKSIELAKSIESATSLSPEVAKEIIALWKTEKVQEILLEKADAAQIQGRKSGAIYYIENAERFAQSDYVPTTPDVLAARRKTIGIVETSFVVERIKFTLVDVGGQRSERKKWLNCFGSVTSVIFLTAINEYDMFLEEDTKTNRLVESLKLWKALTSSQFFKTTPFILFLNKSDLFEEKIKTVPLVNVFADFPAYAETCKNITDFEKSWRYIAKQYTSHFAGSVFYTHLTCAVDTQACSKIFNSVRDTLTRDVINRAGFV

SEQ ID NO: 35702 - DNA, 705 bp, Panicum virgatum
  misc_feature: Ceres CLONE 1962785
  misc_feature: Encodes the peptide sequence at SEQ ID NO. 35703
atcagccctagcttaagctaacccggccgcctctgctgctcgcctcctcactcgcgcgcgagtcgtggtcgtgtctagtcagctgctagctagggttagggttcgctgctgcgctcgcgcgtgcatgcgcgcgggctgggcgcggcagggatgacgccgcagcggtcgccggcgggggccggagggggagggggcacgccggcgctgcactacctgaacgcgccgtacggggacaccaccttcaccaaggtcttcgtggggggcctcgcgtgggagacgcgcaacgaggggctgcgcgcgcacttcgaggtctacggggacatcctcgaggccgtcgtcatcaccgaccgcaccacgggccgctccaagggctacggattcgtaaccttccgggacccagaatccgcgaggatggcctgcatggacccgtacccggttattgatgggcggcgcgctaattgcaatctcgccatcttagggaggcctggtccagctgtgcctttcgtagcacctgtaaggccggtcatcccatacaatggaggtgtggcggttccagggggcatgtatgtgcaaagcccaacatatcagcaacccccttacaactactcacaggcctttgtatatccttcttatgggccagcaacatatggacctgaatacttatatcagcagaatgcatatggtccatatgttggacaacagttt

SEQ ID NO: 35703 - protein, 184 aa, Panicum virgatum
  misc_feature: Ceres CLONE 1962785
  misc_feature (34)..(104): Pfam Name: RRM_1 Pfam Description: RNA recognition motif. (a.k.a. RRM, RBD, or RNP domain)
  misc_feature: Functional homolog of the protein sequence given in SEQ ID NO 50671
  misc_feature: Useful for making plants with modulated biomass
MTPQRSPAGAGGGGGTPALHYLNAPYGDTTFTKVFVGGLAWETRNEGLRAHFEVYGDILEAVVITDRTTGRSKGYGFVTFRDPESARMACMDPYPVIDGRRANCNLAILGRPGPAVPFVAPVRPVIPYNGGVAVPGGMYVQSPTYQQPPYNYSQAFVYPSYGPATYGPEYLYQQNAYGPYVGQQ

SEQ ID NO: 35704 - DNA, 628 bp, Panicum virgatum
  misc_feature: Ceres CLONE 1962795
  misc_feature: Encodes the peptide sequence at SEQ ID NO. 35705
atttctctctggacgagaaccccatcccacgctcgcgagcccacaatggcgaccacaccaattccgcgtcctgcggccgtggccgtggccctgtgcgcggcggcgctgctggcggcgtgcgccggcgcgtcccgggcggcgtgcccgaagcccgtgccgaagatcacggattacggggccgtcggggaccggaagacgctcatctcggcggcgttcgccaaggcggtggcggacctgtcggcgcgcgcgccgcgcggcggcgcggcgctggtggcgcccccgacgaaatggctcacggggcccttcaacctcaccagccacttcaccctctacctcgacgagggcgccgagatcctcgcgtcccaggacatgaacgattgccccctcatagctcccctgccgtcttacgggacaggaagggacgatcctggcccaagatacagcaatttcattgcaggatcctatcttactgacgtcataatcactggtaataatgggactatctccgggcaggggcaaggctggtgggaccagtaccatgccaaagagctcctgttcacccgtggctacctcctctagctcctctactctgacaacatcatcatctccaatgtccccttcgtcgact

SEQ ID NO: 35705 - protein, 177 aa, Panicum virgatum
  misc_feature: Ceres CLONE 1962795
  misc_feature: Functional homolog of the protein sequence given in SEQ ID NO 51432
  misc_feature: Useful for making plants with altered carbohydrate content
  misc_feature: Functional homolog of the protein sequence given in SEQ ID NO 51433
  misc_feature: Useful for making plants with altered cell wall content and/or composition
MATTPIPRPAAVAVALCAAALLAACAGASRAACPKPVPKITDYGAVGDRKTLISAAFAKAVADLSARAPRGGAALVAPPTKWLTGPFNLTSHFTLYLDEGAEILASQDMNDCPLIAPLPSYGTGRDDPGPRYSNFIAGSYLTDVIITGNNGTISGQGQGWWDQYHAKELLFTRGYLL

SEQ ID NO: 35706 - DNA, 1185 bp, Panicum virgatum
  misc_feature: Ceres CLONE 1962809
  misc_feature: Encodes the peptide sequence at SEQ ID NO. 35707
gttgggacagaaaataaccggagtgataaggcagtttgttttttgtgttagtctagtcttttgggatgcaacttctcctctccctcgcacttattgtcttagcttcagcaactgtcttctttgaggaagatttctctgattcaaactgggaaaaccgatgggtcgtgtcaacagctcgaccagctgccaaacgaggagcattagcattggcaaccggaaaatgggttactgacgctgaagctgaacgtggtctccaagcaactgaagatgcaagattctacactttatccactaaattccctgaattcaccaatgccaacagcgtcttggtcctccaatattcccttaaacaaactcaacacgttgactgtggaggagcttacatcaaattacaccctaaaggattagaccaagcttcctatgatggagcatctcaatacaacattatgtttggaccagatcaatgcggaggaaccaagagagttcatgctattttgaccagagatggaactaaccacctcattaacaagcaaatctacccagaatctgatctcttcacccactcctacaccttcatcctccgacctgataacacttatgaaatcctcattgatggagactcaaaagcaaaaggaaacattgaagatgactggtctattctcccaccaaagaaaatccaagatccagctcaatcaaaaccagctgactggcaagataacaaatacattgatgatccagaagacaaaaaaccagaaggatatgatgatattccaaaagaaattgttgatcctgaagcaaccaaaccagaagattgggatgatgaactcgatggagattgggaagcaccagttgtccctaacccagaatttaaaggaccatggagaccaaaacaaattgaaaatccaaaataccaaggagaatgggttcatccattaattgataacccagagtacaaaccagttgatgatctctacagttttccatcatttgaagctcttggaattgaagtctggcaagttaaatctggatcaatcttcgataactttttggttactgatgatgaagaactcgctgcaactgctagaaaagctattaatgctagacgtgaaagtgagactaaacttgaagctgaagaaaaagcagctgaagctgctgctgctccagctgaagaagctgctgaaccag

SEQ ID NO: 35707 - protein, 373 aa, Panicum virgatum
  misc_feature: Ceres CLONE 1962809
  misc_feature (17)..(329): Pfam Name: Calreticulin Pfam Description: Calreticulin family
MQLLLSLALIVLASATVFFEEDFSDSNWENRWVVSTARPAAKRGALALATGKWVTDAEAERGLQATEDARFYTLSTKFPEFTNANSVLVLQYSLKQTQHVDCGGAYIKLHPKGLDQASYDGASQYNIMFGPDQCGGTKRVHAILTRDGTNHLINKQIYPESDLFTHSYTFILRPDNTYEILIDGDSKAKGNIEDDWSILPPKKIQDPAQSKPADWQDNKYIDDPEDKKPEGYDDIPKEIVDPEATKPEDWDDELDGDWEAPVVPNPEFKGPWRPKQIENPKYQGEWVHPLIDNPEYKPVDDLYSFPSFEALGIEVWQVKSGSIFDNFLVTDDEELAATARKAINARRESETKLEAEEKAAEAAAAPAEEAAEP

SEQ ID NO: 35708 - DNA, 593 bp, Panicum virgatum
  misc_feature: Ceres CLONE 1962815
  misc_feature: Encodes the peptide sequence at SEQ ID NO. 35709
acacagacatggcttgctcatcgtcccgttccacggccgccgccggtgtggtactcacaatggtgggggccgcgctgtgcctccgtggcgcggcggcgcagctctgcgaggactactactacgactcgtgccctgacgcttactccatcgtaaagaaagtgctcgtcgactcccacaggtcctacgtccggatctttgccaccctcatccgcctccatttccacaactgcttcggccaaggctgctactggtcgctgctgctggacggattgccgggagtgatcaactcctagaagggggcgcggccctgcaactgatctgcccgtggttacgaggtggtggacaaagtcaaagaggcgctggaggacgcctgccccggcgtcatctcctgcaccgacatcctcgccatcaccgacgacatctctctcgagctgtccggaggcccgaagtggggcttcctgctggtaatactggacggtcgtactgccatcttcttcagcgcatccttcctgccatctcccttcaagaacctcacgttactcaagaacaatttcctggatttccgccttgacactgtcgacctcatcgccctc

SEQ ID NO: 35709 - protein, 94 aa, Panicum virgatum
  misc_feature: Ceres CLONE 1962815
  misc_feature: SWISSPROT Homolog: EC 1.11.1.7 Peroxidase
  misc_feature: Functional homolog of the protein sequence given in SEQ ID NO 51034
  misc_feature: Useful for making plants with modulated nitrogen use efficiency
MACSSSRSTAAAGVVLTMVGAALCLRGAAAQLCEDYYYDSCPDAYSIVKKVLVDSHRSYVRIFATLIRLHFHNCFGQGCYWSLLLDGLPGVINS

SEQ ID NO: 35710 - DNA, 520 bp, Panicum virgatum
  misc_feature: Ceres CLONE 1962832
  misc_feature: Encodes the peptide sequence at SEQ ID NO. 35711
acgcaccccgagccatccacgtccgctccgtcccagctcctagcagcgccggccgaggacgactcactaccgatggcgtcgcttcccatgatggcgccctccttcccggccgtggcgggggccgagccctcgcgcccccgttcccgcacggggggaagcgcagcgaccgcaaagattgctggctcatcatcgccggcagggtggacgacgtcacgccgttcatggaggagcaccccggcggcgacgaggtcctgctggcgtgcacaggcgaggacgcgacggccgactacctggacatcggccacagcgagtccgccaaggagctcatggcgcagtactgcgtcggcgaggtcgacgcggccaccgtcccggccaagctcacctacacctgccccagcgacgcgagcctcgagaagccgtcgacgggctcgggcgcctgggccactacgctcctgcatgtcgccgcgcccctcctgctgctggcgctggccttgggggtgcagacctacggctaggtcaa

SEQ ID NO: 35711 - protein, 170 aa, Panicum virgatum
  misc_feature: Ceres CLONE 1962832
  misc_feature (20)..(118): Pfam Name: Cyt-b5 Pfam Description: Cytochrome b5-like Heme/Steroid binding domain
APRAIHVRSVPAPSSAGRGRLTTDGVASHDGALLPGRGGGRALAPPFPHGGKRSDRKDCWLIIAGRVDDVTPFMEEHPGGDEVLLACTGEDATADYLDIGHSESAKELMAQYCVGEVDAATVPAKLTYTCPSDASLEKPSTGSGAWATTLLHVAAPLLLLALALGVQTYG

SEQ ID NO: 35712 - DNA, 671 bp, Panicum virgatum
  misc_feature: Ceres CLONE 1962834
  misc_feature: Encodes the peptide sequence at SEQ ID NO. 35713
gtcccagttaagcaaagcaagcaagctactgatcgagctagcagctggctagtctgctagtggtcctggatcagttacctattaattagctgctataaatctggccatggcgacttcgttccggacatggcattgcttgatgctcgccttgctcctgctcgctccggcggcgaacgggcagctctcgccgtcgttctacgcgaggagctgccccacgctggggctcatcgtgcgcgccaccatgatcagggccctcctcgccgagcgccgcatgggcgcctccctcataaggctcttcttccacgactgcttcgtccagggctgcgacggctcgattcttcttgacgacgtgggcagcttcgtcggcgagaagggcgccggccccaacgtcaactccgtccgcggctacgaggtcatcgaccagatcaaggccagcgtcgaggccgtctgccccggcgtcgtctcctgcgccgacatcgtcgccctcgccgcgcgggacagcaccttcctggtacgtcacactgcacacacttgcgtatataagtacgtacgtggctgtggatgaatctataggcgcactatagctaagtcgcgaccactccctgcatgtagctcggagggccgacttgggcggtgccgctcggccggcgcgactcgacgacggcgagcca

SEQ ID NO: 35713 - protein, 152 aa, Panicum virgatum
  misc_feature: Ceres CLONE 1962834
  misc_feature (42)..(150): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51327
  misc_feature: Useful for making plants with altered cell wall content and/or composition
  misc_feature: Functional homolog of the protein sequence given in SEQ ID NO 50996
  misc_feature: Useful for making plants with altered carbohydrate content
  misc_feature: Functional homolog of the protein sequence given in SEQ ID NO 50230
  misc_feature: Useful for making plants with modulated nitrogen use efficiency
MATSFRTWHCLMLALLLLAPAANGQLSPSFYARSCPTLGLIVRATMIRALLAERRMGASLIRLFFHDCFVQGCDGSILLDDVGSFVGEKGAGPNVNSVRGYEVIDQIKASVEAVCPGVVSCADIVALAARDSTFLVRHTAHTCVYKYVRGCG

SEQ ID NO: 35714 - DNA, 1395 bp, Panicum virgatum
  misc_feature: Ceres CLONE 1962860
  misc_feature: Encodes the peptide sequence at SEQ ID NO. 35715
acgcgccacgccgctcagagcgctcgctcccggctcgctatcccctaaccctagccgctgccgctgccgctgccgccgccggcgcctaaaccctcgccgcactaactcgcatcgacctcccggcggcgatggcgaaggagaagaagcggaagcagcctgcctccgattcgacggcgcctccgggcgacgagggcgaggggaggagggagcgcaagggcaagaaggcgaagaaggataaggcggaggcgatacggccgtcgcagatcaagaacaaggacaagcgcagcgagctgcatgccaagctcaagcgcgagaagaaggcagagaagcgaaagctcgcccgcgagcgcagccaagccatccgccgcgccgaagagcttggagaacagccgccggagaggcaggtgccccggactatcgagaacaccagggagcctgatgagaccgtgtgccggcctgatgaccaggagctatttgcaggaaatgatgcagatgaattcaatgctgttctaaaacagcacataattccaaaagtactgattaccacatgccgcttcaattcagggaggggacctgcctttattgaggagctattgcaagtgataccgaattcgcattatgttaaaaggggaacatatgaactcaagaaaattgtggaatatgcgaagaatagggatttcacctcacttattgttgttcacacaaatcggagggaacctgatgctctacttatcattggattacctgatggccccactgcacatttcaaactatccaaacttgttctacggaatgacataaagaaccatggcaaccctaccagtcataagccagagctagtgttgaacaatttcactacacgccttggtcatcgtgttggaaggatgatacaatccctctttcctcaagaccccaatttccgtgggcgccgcgttgtgacctttcataatcagcgagactacatatttttccgtcatcacaggtacatctttgagacaaaagaaagcaaggttgcttcgaaggacaagaaagctaagacatctgaaagcaaaaggcaacctgagaagcaagtgatttgtcgcctgcaggaatgtggtcctcgcttcactctgaagctgctcactttgcaacatgggaccttcgacacgaaaagcggggagtacgagtgggttcacaaggcggacatggatacaagtaggaggagattcttcttgtgatggagcatggggactctgatgcccaaacgggcggaattgttccgttgagtctttcaaatttgtgtagagaggatgctacttagaatcgataaatggatgtaacagactttgatgcctgtccaatcaattttgtggatccaaccaagaagatgagctaatagaactttgttcccgtctt

SEQ ID NO: 35715 - protein, 362 aa, Panicum virgatum
  misc_feature: Ceres CLONE 1962860
  misc_feature (137)..(333): Pfam Name: Brix Pfam Description: Brix domain
MAKEKKRKQPASDSTAPPGDEGEGRRERKGKKAKKDKAEAIRPSQIKNKDKRSELHAKLKREKKAEKRKLARERSQAIRRAEELGEQPPERQVPRTIENTREPDETVCRPDDQELFAGNDADEFNAVLKQHIIPKVLITTCRFNSGRGPAFIEELLQVIPNSHYVKRGTYELKKIVEYAKNRDFTSLIVVHTNRREPDALLIIGLPDGPTAHFKLSKLVLRNDIKNHGNPTSHKPELVLNNFTTRLGHRVGRMIQSLFPQDPNFRGRRVVTFHNQRDYIFFRHHRYIFETKESKVASKDKKAKTSESKRQPEKQVICRLQECGPRFTLKLLTLQHGTFDTKSGEYEWVHKADMDTSRRRFFL

SEQ ID NO: 35716 - DNA, 841 bp, Panicum virgatum
  misc_feature: Ceres CLONE 1962865
  misc_feature: Encodes the peptide sequence at SEQ ID NO. 35717
gccctagggctccgctccattaccaacttgccctctcgcctcgccgccgttcttgtacggatcggaattgaaaatgcccgagcatctcttccaggacaccttcaaagtcatcgggctcgatcgtgatggtaaaaagttcgacaaagtctctcgcgtggtagctgagagcgaggattctagtatatacatgcagttagatgttgccatagaggtttatccaatgtgcaaaggcgagaaatttaaaatggtcctagctagtactctgaatttggatggcactccagatactggctacttcacacaggctgcccgagaaacactggctgaccagtttgactatgtcatgcacgggaagctttacagaatctcagattacacaccagccccacccccacccccaccccccaaaaaagatgaagaagacacctccatggaagatgcagacgacgactcctccaaaaaagatgaagacacctccgccaaaaatgatgaagacacccccaaacaagatcctaaagtggagatttttggatcatttggtggtctcctgatggtgctcaggggtgagccttccattgctggaagctttgagctggaccagaggattttcckacttatacgcaagcttaaggggtagaagaaggaggtcaggaacggggaaactccgttattagtatcgtcttgcatgctggtatagttcatttcaaggctttttgtttggccgtatactagtagggatgacgtgttaaattttaatccatgcaatgcaatgcatggttcctgcccgggatgtgtgaattgtttgtcatatggtaatgaatattttttacttcatcatgat

SEQ ID NO: 35717 - protein, 187 aa, Panicum virgatum
  misc_feature: Ceres CLONE 1962865
  misc_feature (7)..(184): Pfam Name: RNA_pol_Rpb8 Pfam Description: RNA polymerase Rpb8
  misc_feature (180)..(180): Xaa is any aa, unknown, or other
MPEHLFQDTFKVIGLDRDGKKFDKVSRVVAESEDSSIYMQLDVAIEVYPMCKGEKFKMVLASTLNLDGTPDTGYFTQAARETLADQFDYVMHGKLYRISDYTPAPPPPPPPKKDEEDTSMEDADDDSSKKDEDTSAKNDEDTPKQDPKVEIFGSFGGLLMVLRGEPSIAGSFELDQRIFXLIRKLKG

SEQ ID NO: 35718 - DNA, 513 bp, Panicum virgatum
  misc_feature: Ceres CLONE 1962869
  misc_feature: Encodes the peptide sequence at SEQ ID NO. 35719
ccagatccacccatccttccggaggcgagcagaaaaatctccccacccaaaaaaatccccaaaaccctaggcctcggatctcccgatctgcgatggcgaacccccgcgtgttcttcgacatgaccgtcggcggcgccccggccggccgcatcgtcatggagctctacgccaacgaggtcccccgcaccgccgagaacttccgcgccctctgcacgggcgagaagggcgtgggcaagaggggcaagccgctccactacaagggctccaccttccaccgcgtcatccccgacttcatgtgccagggcggcgacttcaccaacggcaacggcaccggcggcgagtccatctacggcgagaagttcgccgacgagaagttcgtccgcaagcacacgggccctggggtgctctccatggcgaacgccgggcccaacaccaactggaacttccctttagtgtttcggaattgttctacttgagtgatgcgccttcgtgaaattttaatttactttgatc

SEQ ID NO: 35719 - protein, 127 aa, Panicum virgatum
  misc_feature: Ceres CLONE 1962869
  misc_feature (5)..(126): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MANPRVFFDMTVGGAPAGRIVMELYANEVPRTAENFRALCTGEKGVGKRGKPLHYKGSTFHRVIPDFMCQGGDFTNGNGTGGESIYGEKFADEKFVRKHTGPGVLSMANAGPNTNWNFPLVFRNCST

SEQ ID NO: 35720 - DNA, 589 bp, Panicum virgatum
  misc_feature: Ceres CLONE 1962879
  misc_feature: Encodes the peptide sequence at SEQ ID NO. 35721
ttctgtctcctctctccacacgacttgctcgggccgccgccgccgctgccgccgtcgtcgcagcaatcaccgtgacctgcaaccagagaaagcatggatactcatgttaagcttgccgtcgtggtcaaggtgatgggccgcaccggttccaggggtcaggtgacccaggtcagagtgaagttcctggacgaccagaaccgtctcatcatgaggaacgtcaagggccatgtccgtgagggtgacatcctcaccttgctcgagtctgagagggaggccaggaggctgcactgaatcaactggttgttgtgtcagttgttcgctgttcttgtcttaaacaagttaatgatggattgatttccccttgcctagtgtactgctttcgcataaagttcttgaagaatgctactttgtcttttgcataggctatggagaatgagttaagagcaatggaaatgtaatttgtgcacatgtcctgttgcaagttttggtctgttaccctgaatgaaattaagtgcacttatgttgagttacatggttgtgttgcaatcttgggtaacattataatgaatggtctgtatgagttctgtat

SEQ ID NO: 35721 - protein, 65 aa, Panicum virgatum
  misc_feature: Ceres CLONE 1962879
  misc_feature (1)..(65): Pfam Name: Ribosomal_S28e Pfam Description: Ribosomal protein S28e
MDTHVKLAVVVKVMGRTGSRGQVTQVRVKFLDDQNRLIMRNVKGHVREGDILTLLESEREARRLH

SEQ ID NO: 35722 - DNA, 1323 bp, Panicum virgatum
  misc_feature: Ceres CLONE 1962886
  misc_feature: Encodes the peptide sequence at SEQ ID NO. 35723
ctcttttgaaagtagtaaattctctacaaggcttgtgttcatccagtagaagcacacagatttctgaacagctgcaaaagtcgcttgatgatttaagctccatgatcaatgatatggaggagatagtcgcgtccttgatgagctatccacgcatataccgccaaccttatagcatgcatctcctggtggaaaattgcatgtttgggcgccagatggaaactgaacttgtcatcagcttcctattgcacacacaacctcatgctcctaaagaactagaggtcctgccaatcgttggtcccggtaaagttggcaagaccacccttgttgctcatgtttgtgaagatgcaagggtccgtgaccatttctcagaaatacttttcttgcacgggcatgacctcacaggtgttgaccttgctgcgctcaaagaaggatatgtaacggaacatcaaaatcatggatcaaattcaaacggaagaagattacttattgttgttgagttagttggcactctcaccgaagatgtatggaataggttgtattctgcttctatacagcatgtaccaagcggtagtaaaatcattgtcacaagccggtccgacgaaatcataaagtttggaacaacccggccactaagtctgaagtatctgtcccatgaagcatattggtatttctttaagatgctcaattttggaagcatggatcttgagatgcatccaaggcttgcccgcatggccatggagatagccgggatgatgaatgggtgcttcattggtgcacatgtggtcggttgtttgctgaggggcaacattgatttccacttttggtgcaaggttttggccttcttgagaggaaatatcaaaaagcatgtctctaaatttggtttgcatccacttgatcttataaatgagaagaagcctgcacatcttgggagaatgtttataccttctgaagattttgtggttcatcatgagtaccaacgctcttcacaagaggatgttcccaagataagaatgcaagatgtgatttatggaggtgtcaaggctcatgggaaatttgaggccctaggatggaggtctcgaataccgccctaccatagctatgtaactgtatgtgagattcgagggctaaaaactgcgggtacaaagaggaagcgtcctatgaaaaacagagtcacgctttattaatttttctgttactatggttatgtatgtggtaggcatgtagtgactatgttttaatggggtgtcagaagtcataacattgtcatgacttgatcttgcagattacaaaattgccttactgtactactaccttgtcgtgtat

SEQ ID NO: 35723 - protein, 393 aa, Panicum virgatum
  misc_feature: Ceres CLONE 1962886
  misc_feature (52)..(318): Pfam Name: NB-ARC Pfam Description: NB-ARC domain
LLKVVNSLQGLCSSSRSTQISEQLQKSLDDLSSMINDMEEIVASLMSYPRIYRQPYSMHLLVENCMFGRQMETELVISFLLHTQPHAPKELEVLPIVGPGKVGKTTLVAHVCEDARVRDHFSEILFLHGHDLTGVDLAALKEGYVTEHQNHGSNSNGRRLLIVVELVGTLTEDVWNRLYSASIQHVPSGSKIIVTSRSDEIIKFGTTRPLSLKYLSHEAYWYFFKMLNFGSMDLEMHPRLARMAMEIAGMMNGCFIGAHVVGCLLRGNIDFHFWCKVLAFLRGNIKKHVSKFGLHPLDLINEKKPAHLGRMFIPSEDFVVHHEYQRSSQEDVPKIRMQDVIYGGVKAHGKFEALGWRSRIPPYHSYVTVCEIRGLKTAGTKRKRPMKNRVTLY

SEQ ID NO: 35724 - DNA, 603 bp, Panicum virgatum
  misc_feature: Ceres CLONE 1962887
  misc_feature: Encodes the peptide sequence at SEQ ID NO. 35725
agggtacggtgagggaggtggaagtggggctgctgctggtgggtacggacgtggtggcggcggcggaggtggtggcggcgaaggcggtggtgctggtggctcagggtatgggtctggccaaggctctggctatggagccgacagtggtggtgctggtgggtatggaagtggtggaggcggcggaggtggtggcgggcaaggtggtggttccggctatggccatggaggtggcgaaggctatggctccggctccggctatggaggtggtgctagtggtggtggtggcggcggtgggcatggtggcggtggtggtggtggccaaggtgggtcgggttatggctccggctccgggtacggatcaggtgaagggtatgggcagggtggagctcatggaggaggctatggcagcggcggcggtggtggcggcggccaaggtggtggctctggctatggctccggatccggctctgggtatggctctggtggtggacacaactaagctcagattcagaggcaactacagagtatatagctacaaatgtatcatcagtggtgcgtttgtctcatgttatacagaaaactgcttatttgagtgtgtaacac

SEQ ID NO: 35725 - protein, 165 aa, Panicum virgatum
  misc_feature: Ceres CLONE 1962887
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
GYGEGGGSGAAAGGYGRGGGGGGGGGEGGGAGGSGYGSGQGSGYGADSGGAGGYGSGGGGGGGGGQGGGSGYGHGGGEGYGSGSGYGGGASGGGGGGGHGGGGGGGQGGSGYGSGSGYGSGEGYGQGGAHGGGYGSGGGGGGGQGGGSGYGSGSGSGYGSGGGHN

SEQ ID NO: 35726 - DNA, 731 bp, Panicum virgatum
  misc_feature: Ceres CLONE 1962892
  misc_feature: Encodes the peptide sequence at SEQ ID NO. 35727
acatctcatactattaagctcacgcaaaatggcaggcactaaactggcagccctaggtttcattgtcctcttgagtatggggttagctaatgcgacaagggtggctaggtactctagtgcaggaggaactggtactggcgagggtggtggtggtggatatgtgagtggcgctggctctgggtccggtagtggtgctggggccggtgagagtagttctagtggagtgtccgcaactgcaggaggtggaggcggaggtggcggtattagcaacaatggcctcgcgggtgtccatgctcgcgcacgtgctgttcctgaccaccgccgtgctcatgctcgtctggctgctgcactaccggggcggcatcaacatacagtccgaggaccccgagcaggtcttcaatgttcatccgtttgtaatgtcctgggggttcattcttcttattggagaagccatcctggcgtactcgtcgatcccgatggtggaccaccggacgcagaagatggcgcacatgatgatccacctggtgggtctcatcctgggcatcttcggcgtgtacgcggcgttcaagttccacgacgcggccgtggtgccggacctgatgagcctccactcgtggctgggcatcaccgccatcgcgctcttcggcctgcagtggctcttcggcttcgtcaccttctggctgcccgcggcgcacgagcacacccgcgacgcggcggcccccgcgcacgtc

SEQ ID NO: 35727 - protein, 152 aa, Panicum virgatum
  misc_feature: Ceres CLONE 1962892
  misc_feature (6)..(148): Pfam Name: Cytochrom_B561 Pfam Description: Cytochrome b561
MASRVSMLAHVLFLTTAVLMLVWLLHYRGGINIQSEDPEQVFNVHPFVMSWGFILLIGEAILAYSSIPMVDHRTQKMAHMMIHLVGLILGIFGVYAAFKFHDAAVVPDLMSLHSWLGITAIALFGLQWLFGFVTFWLPAAHEHTRDAAAPAH

SEQ ID NO: 35728 - DNA, 762 bp, Panicum virgatum
  misc_feature: Ceres CLONE 1962901
  misc_feature: Encodes the peptide sequence at SEQ ID NO. 35729
tcacgcacgcacaccaactccaaacccaactccactatccccatcgcggcatcgccgctgctccgcctcgcgcgcgacgagccatggctgccaggaagttcttcgtcggcggcaactggaaatgcaacggcaccggcgaggacgtgaagaagatcgtgaccgtgctcaacgaggctgaggtgccctccgaggacgtcgtcgaggtggtggtgagcccgccgttcgtcttcctgccccaggtcaaggggctgctgcgcctggactttgccgtcgccgcgcagaactgctgggtgcgcaagggcggtgccttcaccggcgagatcagtgctgagatgctggtgaacctgcaggtgccgtgggtcatcttgggacactcggagcgcagagctctgatgggcgaatccagtgatttcgttgccgaaaaagttgcatatgcactctcccaaggtctcaaggtaattgcttgcataggcgagacccttgagcagagggaagcaggaacaacaatggatgttgttgctgcgcaaacaaaggctattgctgagaaggtatcagattggacaaacattgtattggcctatgagccagtttgggctattgggaccggcaaggttgcaacccctgcccaggctcaggaggttcacgatggtctgagaaagtggctccactctaatgttagtcctgcagttgctgaatcgaccaggataatttatggagggtctgtgaatggagctaactggcaaagagcttgcggctcaaccc

SEQ ID NO: 35729 - protein, 226 aa, Panicum virgatum
  misc_feature: Ceres CLONE 1962901
  misc_feature (6)..(223): Pfam Name: TIM Pfam Description: Triosephosphate isomerase
  misc_feature: SWISSPROT Homolog: EC 5.3.1.1 Triose-phosphate isomerase
  misc_feature: Functional homolog of the protein sequence given in SEQ ID NO 50215
  misc_feature: Useful for making plants with modulated biomass
MAARKFFVGGNWKCNGTGEDVKKIVTVLNEAEVPSEDVVEVVVSPPFVFLPQVKGLLRLDFAVAAQNCWVRKGGAFTGEISAEMLVNLQVPWVILGHSERRALMGESSDFVAEKVAYALSQGLKVIACIGETLEQREAGTTMDVVAAQTKAIAEKVSDWTNIVLAYEPVWAIGTGKVATPAQAQEVHDGLRKWLHSNVSPAVAESTRIIYGGSVNGANWQRACGST

SEQ ID NO: 35730 - DNA, 556 bp, Panicum virgatum
  misc_feature: Ceres CLONE 1962905
  misc_feature: Encodes the peptide sequence at SEQ ID NO. 35731
actcagcaatcagcaatcttcccgagcaatcccctcgtcgaatccaccagcgaagcagctggcgacgaaggcggcgcgcaagtcggccccggccaccggcggagtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagactgacctccgcttccagagctccgccgtcgccgcgctgcaggaggcggccgaggcctacctcgtcgggctcttcgaggacaccaacctctgcgccatccacgccaagcgcgtcaccatcatgcccaaggacatccagcttgcccgccgcatccgtggcgagagggcctaggtgtcgtcgccgtggaggggaagtagtagaaatagtagtttgccttctgtgtccaatcagaaggtgtggagatgtgctgggttccttagctttggttgttggttcgtctactgctgtaatttatcccatcgtatcttctgttccttg

SEQ ID NO: 35731 - protein, 135 aa, Panicum virgatum
  misc_feature: Ceres CLONE 1962905
  misc_feature (57)..(131): Pfam Name: Histone Pfam Description: Core histone H2A/H2B/H3/H4
LSNQQSSRAIPSSNPPAKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 35732 - DNA, 651 bp, Panicum virgatum
  misc_feature: Ceres CLONE 1962910
  misc_feature: Encodes the peptide sequence at SEQ ID NO. 35733
aagtccacacccataatcgtgacatcacagtaaatcagtcacaatggcgcgccgacccgctcgttgctatcggtactgcaagaacaaggtaagcgtcccgcaaattttgcttcccaagtgcggtccgagaggcattcgcgcacattcccgtcggggaggaaatgggcaagggctgggcgaagaaacaggcgaacggatggaccggaaagcctggattatatcgggaagagccgtaccctaagtcgcggttcagccgtggtgtgccggaccccaagattcgcattttcgatctcggccgcaagcgtgccaccgtcgatgacttcccgctctgcatccaccttgtgtccaacaagtatgagcagctgagctccgaggccctcgaggccgcccgtatttgcgccaacaagtacctcgtcaagacggccggtaaggaaggtttccacctccgcgtccgcgcccatccgtaccacgtcgtccgtatcaacaagatgttgtcttgcgccggtgccgatagactgcaaactggtatgcgtggtgcttggggtaagcccaacggcactgtcgcccgcgtcaacattggccagattctcatgagcgtccgcactcgtgacactaaccgcgcctttgccctcgaggccctccgccgctccc

SEQ ID NO: 35733 - protein, 163 aa, Panicum virgatum
  misc_feature: Ceres CLONE 1962910
  misc_feature (14)..(163): Pfam Name: Ribosomal_L16 Pfam Description: Ribosomal protein L16
MGKGWAKKQANGWTGKPGLYREEPYPKSRFSRGVPDPKIRIFDLGRKRATVDDFPLCIHLVSNKYEQLSSEALEAARICANKYLVKTAGKEGFHLRVRAHPYHVVRINKMLSCAGADRLQTGMRGAWGKPNGTVARVNIGQILMSVRTRDTNRAFALEALRRS

SEQ ID NO: 35734 - DNA, 679 bp, Panicum virgatum
  misc_feature: Ceres CLONE 1962914
  misc_feature: Encodes the peptide sequence at SEQ ID NO. 35735
actcaaagtatgttggagaaggtgaagctctgttacgaagaacatttcagaaggcacgtcttgcttctccaagcattatattttttgatgaggctgatacaattgcccccaaaagaactggccctggtgggaactctagtggcaatgtcacagttggagaaaaacttttgtcaactttgttgactgaaatggatggtttagaattggctacgggaattatcgtattggctgctactaatcgcccaaatgcaatcgatcctgcgcttatgcgtccagggcgttttgacaaggtgttgtatgttccaccgccagatgtggaagggcggtatgagatactacgcatacatacacggaaaatgaaattgggggaggatgttgacctttggaagatcgcggagtgtaccgagctgttcactggtgctgatcttgaaggcctttgcagggaagctggaatggcagcattgagggaagatatctctgcaagtttcattcgtaacacacacttccagactgcccgacattcattgagaccttcccttacaaaagcagtagttgatgagtactcaaatgcagctatcaatgatccatcaactaggaaacattagaattttcttcatcttccactttgttgtgcaagaatattctagatgatccacatcagcataaagtgcatttgatg

SEQ ID NO: 35735 - protein, 200 aa, Panicum virgatum
  misc_feature: Ceres CLONE 1962914
  misc_feature (1)..(155): Pfam Name: AAA Pfam Description: ATPase family associated with various cellular activities (AAA)
  misc_feature: SWISSPROT Homolog: EC 3.6.4.3 Microtubule-severing ATPase
SKYVGEGEALLRRTFQKARLASPSIIFFDEADTIAPKRTGPGGNSSGNVTVGEKLLSTLLTEMDGLELATGIIVLAATNRPNAIDPALMRPGRFDKVLYVPPPDVEGRYEILRIHTRKMKLGEDVDLWKIAECTELFTGADLEGLCREAGMAALREDISASFIRNTHFQTARHSLRPSLTKAVVDEYSNAAINDPSTRKH

SEQ ID NO: 35736 - DNA, 614 bp, Panicum virgatum
  misc_feature: Ceres CLONE 1962923
  misc_feature: Encodes the peptide sequence at SEQ ID NO. 35737
gacatcctgtcgaggttcctgctcgagcgggagcgagaccccggctgcttcgacaacaagtacctgcgggacatcatcctcaacttcgtgatcgccggccgcgacaccacggcggggaccctggcctggttcctctacgagctctgcaggaaccagcgcgtccaggaaaagatcgcggaagaggggcgcgccgccaccgccacgggcgaccgcgacgtcggcgcgcaggaactcgtggcgtgcctgaccgaggacgccatcggcaagatgcagtacctgcacgccgcgctggcggaaacgctgcggctctacccggccgtgcccatcgatgtgaagtactgcttctcggacgacacgttgccggacggctacgcagtgaaccaaggggacatggtgaactaccagccgtaccccatgggcaggatgaagttcctgtggggcgcggacgccgaagaattcaggccggagaggtggctcaacgacgacggcgtgttcctccccgagagccccttcaagttcacggctttccaggcggggcctcccatctgcttggggaaggagttcgcgtacaggcagaagaagatcttcgcggccgtgctgctccacctcttcag

SEQ ID NO: 35737 - protein, 204 aa, Panicum virgatum
  misc_feature: Ceres CLONE 1962923
  misc_feature: SWISSPROT Homolog: EC 1.14.14.1 Unspecific monooxygenase
DILSRFLLERERDPGCFDNKYLRDIILNFVIAGRDTTAGTLAWFLYELCRNQRVQEKIAEEGRAATATGDRDVGAQELVACLTEDAIGKMQYLHAALAETLRLYPAVPIDVKYCFSDDTLPDGYAVNQGDMVNYQPYPMGRMKFLWGADAEEFRPERWLNDDGVFLPESPFKFTAFQAGPPICLGKEFAYRQKKIFAAVLLHLF

SEQ ID NO: 35738 - DNA, 578 bp, Panicum virgatum
  misc_feature: Ceres CLONE 1962926
  misc_feature: Encodes the peptide sequence at SEQ ID NO. 35739
accagtccacccagaagctttctctcccgtccgccgagtgtgcccgcaccagctgatccgcccgcggtcgatcaccgcgagcggaccggccgccggagatggggtcccgctacgaggtggaggtgaccgtgggctcggcccgggacctcaagaatgtcaactggcgccacggcgacctccggtcctacgccgtggcctgggtcgactccggcacgcggtgcagcacccgcgtcgacctcgacggcggcgagaaccccgcctgggacgagaaagtcctcgtgccgctcccgccggcctcccgcctcgacgacgccgtgctccacgtcgacgtcgtccacgccaacgccgacgagggcgtcaagccgctcgtcggctccgcgcgcctcccgctccgcgacgtcctcgacgaggccggcctcggcgggaaggccgcgcggaacctccgcctcaagcggccctcggggaggccccagggccgcctcgacgtccacgtcgccgtcaaggagccggccaggtactacgacccctacccggcgccggggggctacgcgcagacgggcacccgcgacccctacggc

SEQ ID NO: 35739 - protein, 159 aa, Panicum virgatum
  misc_feature: Ceres CLONE 1962926
  misc_feature (7)..(95): Pfam Name: C2 Pfam Description: C2 domain
MGSRYEVEVTVGSARDLKNVNWRHGDLRSYAVAWVDSGTRCSTRVDLDGGENPAWDEKVLVPLPPASRLDDAVLHVDVVHANADEGVKPLVGSARLPLRDVLDEAGLGGKAARNLRLKRPSGRPQGRLDVHVAVKEPARYYDPYPAPGGYAQTGTRDPY

SEQ ID NO: 35740 - DNA, 302 bp, Panicum virgatum
  misc_feature: Ceres CLONE 1962926-R
  misc_feature (183)..(183): n is a, c, t, g, unknown, or other
cggcgcggcccccgccgccgacgccgccgacggcaagaagaaggacggcaagacggggacggggacggggccggccgcgggcgcggccgcgggagcgcccggcgggcccgcgcaggccggcggggcgagcaaccaggagaacaagcaggaggagcgcgcggcggagagggcggaggacaaccnggagagggaggacccgcacggcggcggcggcggcaacgggggcggcaacgacgaccagggcggcgacgaggacaacggaccggaacggaccggacccgaccaccgggccggcggcaagg

SEQ ID NO: 35741 - DNA, 1568 bp, Panicum virgatum
  misc_feature: Ceres CLONE 1962928
  misc_feature: Encodes the peptide sequence at SEQ ID NO. 35742
gcacactcgcacctcgcacatctcatggtgtcccaagcacagcaagagccagctctgcctcacagcagcagcagcagcagcatcgccaagcttgcagccgccgcgtccatggacactactagcccggccccgcctctcctcctccgcgccccgactcccagcattgacctccccgcgaccaagcaggacagggccgacgcggccagcaaggcgttcgacctgcgccgggagcccaagatcccggcgccgttcgtgtggccgcacgacgacgcgcgcccgacgtcggccgcggggctggacgtgccggtggtggacgtgggcgtgctgcgcaatggcgaccgcgcggggctgcgccgcgccgcggcgcaggtggccgcggcgtgcgcgacgcacggcttcttccaggtgtgcgggcacggcgtggacgcgggcctggcgcgcgccgcgctggacggcgccagcgacttcttccggctgccgctggccgagaagcagcgcgcccggcgcgtcccgggcaccgtgtccgggtacacgagcgcgcacgccgaccggttcgcgtccaagctcccctggaaggagaccctctccttcggcttccacgacggcgccgcgtcgcccgtcgtcgtcgactacttcgccggcaccctcggccaggatttcgagccaatggggcgcgtgtaccagaggtactgcgaggagatgaaggctctgtcgctgacgatcatggagctgctggaggtgagcctgggcgtggagcgcggctgctaccgggacttcttcgaggacagccgctccatcatgcggtgcaactactacccgccgtgcccggagccggagcgcacgctgggcacgggcccgcactgcgaccccaccgcgctgaccatcctgctccaggacgacgtcggcgggctggaggtcctcgtcgacggcgagtggcgccccgtcctccccgtgcccggcgccatggtcatcaacatcggcgacaccttcatggcgctgtccaacgggcggtacaagagctgcctccaccgcgcggtggtgaaccggcagcaggagcggcggtcgctggccttcttcctgtgcccgcgcgaggaccgggtggtgcgcccgccggccagcggcgccgtcgccgcggcgccgcgccgctacccggacttcacctgggccgacctcatgcgcttcacgcagcagcactaccgcgccgacacccgcacgctggacgccttcacaagctggctcgccctcggcccggcccacgacgcggcgcccgctccctgcagcacctaacgtctctttcgccgggcggggcccggggggttcagcccacgtgcgcgcccaggtggggcgggccgtgggcagtggcggccgtggatcttatatatcttccggacccccggtggcggcctcgtggccagcgggccccgtgccggctttctcatttttggaagctgccgcgcgctgcgcgtgccgggcgcgtgcgccgacggcctactgctatttgctactagtgtacatatacaaacatactcctatattatacatatatataagcaaccgctttttctttc

SEQ ID NO: 35742 - protein, 392 aa, Panicum virgatum
  misc_feature: Ceres CLONE 1962928
  misc_feature (227)..(326): Pfam Name: 2OG-FeII_Oxy Pfam Description: 2OG-Fe(II) oxygenase superfamily
  misc_feature: SWISSPROT Homolog: EC 1.14.11.15 Gibberellin 3-beta-dioxygenase
  misc_feature: Functional homolog of the protein sequence given in SEQ ID NO 51498
  misc_feature: Useful for making plants with modulated biotic stress sensitivity
  misc_feature: Useful for making plants with modulated flowering time
MDTTSPAPPLLLRAPTPSIDLPATKQDRADAASKAFDLRREPKIPAPFVWPHDDARPTSAAGLDVPVVDVGVLRNGDRAGLRRAAAQVAAACATHGFFQVCGHGVDAGLARAALDGASDFFRLPLAEKQRARRVPGTVSGYTSAHADRFASKLPWKETLSFGFHDGAASPVVVDYFAGTLGQDFEPMGRVYQRYCEEMKALSLTIMELLEVSLGVERGCYRDFFEDSRSIMRCNYYPPCPEPERTLGTGPHCDPTALTILLQDDVGGLEVLVDGEWRPVLPVPGAMVINIGDTFMALSNGRYKSCLHRAVVNRQQERRSLAFFLCPREDRVVRPPASGAVAAAPRRYPDFTWADLMRFTQQHYRADTRTLDAFTSWLALGPAHDAAPAPCST

SEQ ID NO: 35743 - DNA, 516 bp, Panicum virgatum
  misc_feature: Ceres CLONE 1962929
  misc_feature: Encodes the peptide sequence at SEQ ID NO. 35744
gagatagagatttcggcattcaatctttgagtgtacggttaggtcaacagaaagtgtataggctctgcattaatatgctcatgacagcatatacggctgcaattttggtaggagcatcatctccaaatctgtatcaaaagattgccactgtgtttggtcatggcttgctcgcttttgtgctttggcagagagcacgacaatttgacatcacaaataagacatgcatcacgccattttacatgttcatttggaagttattctacgccgagtatttcctcataccatttatttagtaagaatcatgccagggaaactaccatctggcatagatatgtaaaattcatttgcggggcttattattaatgatactcctctattcgatgcgtatgcatcatctgttatgtaagtgtaaatgtacaaaatggaggcatttcactctgtggagtgggattattgtggacatatgactaatccacgagtcttggctgtctgaccatatgaatatgccttagtggt

SEQ ID NO: 35744 - protein, 96 aa, Panicum virgatum
  misc_feature: Ceres CLONE 1962929
  misc_feature: The sequence is a functional homolog of SEQ ID NO 2 in US patent 7154029
  misc_feature: Functional homolog of the protein sequence given in SEQ ID NO 50729
  misc_feature: Useful for making plants with altered tocopherol content
DRDFGIQSLSVRLGQQKVYRLCINMLMTAYTAAILVGASSPNLYQKIATVFGHGLLAFVLWQRARQFDITNKTCITPFYMFIWKLFYAEYFLIPFI

SEQ ID NO: 35745 - DNA, 525 bp, Panicum virgatum
  misc_feature: Ceres CLONE 1962938
  misc_feature: Encodes the peptide sequence at SEQ ID NO. 35746
atcttctccccttcttctctcccaaccaagaagaaagacaagagaagaaagagagagagagcgagcgagcatgtaggaataatggcgtccgacggcaacggccgcggcgtggtcaccatctacggcaacaacggcaccaccctgctggagccctccaagctgtccaagtcggccactttctccgtcaaggtgggcctggcgcagatgctgcgcggcggcgtcatcatggacgtcgtcacgccggagcaggcgcgcatcgccgaggaggccggggcctgcgccgtcttggcgctggagcgcgtccccgccgacatccgcgcgcagggcggcgtggcgcgcatgtccgacccgggcctcttccgcgacatcaagcgcgccgtcaccatcccggtcatggcctacgcgcgcatcggccacttcgtcgaggccctgatcctggacgccatccgggtccacttactcggacgagagcgacttgctctcgctcgccgacgactctcaccacatcaacaatctcaacttccg

SEQ ID NO: 35746 - protein, 147 aa, Panicum virgatum
  misc_feature: Ceres CLONE 1962938
  misc_feature (31)..(147): Pfam Name: SOR_SNZ Pfam Description: SOR/SNZ family
MASDGNGRGVVTIYGNNGTTLLEPSKLSKSATFSVKVGLAQMLRGGVIMDVVTPEQARIAEEAGACAVLALERVPADIRAQGGVARMSDPGLFRDIKRAVTIPVMAYARIGHFVEALILDAIRVHLLGRERLALARRRLSPHQQSQL

SEQ ID NO: 35747 - DNA, 582 bp, Panicum virgatum
  misc_feature: Ceres CLONE 1962945
  misc_feature: Encodes the peptide sequence at SEQ ID NO. 35748
gcgcagatggcggcggacgaggcggcggagaggaaggagggggacagccagcgcgcgggagaagagatcgatggggggagcggggcacggcgtgcatttcttggacgcgtgcttcctctgccggaggccgctcgccggcaaccgcgacatcttcatgtacagaggggacacggcgttctgcagcgacgagtgccggagcgcgcagatggcggcggaaggcccgcaggagcgcagcggcaaggtccgggccgggtccatcctggccctgtaaccagaaacttctctcgaatctaagcacggcattttcttttcttttttgccccccttcctttccattccatgtaggagtatttctctacctttacgaaacgcaccaccggagggtcgccaccttcatgtacacggacgggtttgtgttttttgatgatgaaaaccccttgggaccatccggctgtgtgtggtggttgctgttttttttttccttttggtgtgctggttgcttagcttggtgacccatgatgtatgcatactgcacgcacgtaccttgtcatgcatggagctagtagtattattggttagtcc

SEQ ID NO: 35748 - protein, 66 aa, Panicum virgatum
  misc_feature: Ceres CLONE 1962945
  misc_feature: Functional homolog of the protein sequence given in SEQ ID NO 50550
  misc_feature: Useful for making plants with modulated biomass
  misc_feature: Functional homolog of the protein sequence given in SEQ ID NO 51499
  misc_feature: Useful for making plants with modulated nitrogen use efficiency
MGGAGHGVHFLDACFLCRRPLAGNRDIFMYRGDTAFCSDECRSAQMAAEGPQERSGKVRAGSILAL

SEQ ID NO: 35749 - DNA, 638 bp, Panicum virgatum
  misc_feature: Ceres CLONE 1962955
  misc_feature: Encodes the peptide sequence at SEQ ID NO. 35750
tcgacagcggctctactcgtacgggcccaacgccgcggggcaggaccccagcatggacccgacctacctggcggcgctgacgcagcagtgcccgcagcagccggcgagcggcggcggcgccgacgggacggtggccatggaccccgtgacgcccaccgccttggacaccaactactacgcctccatcgtggccaagcgcggcctgctggcctccgaccaggcgctcctcgccgaccccaccaccgccgcgcaggtggtcgcgtacaccaacagccccgacacgttccagaccgacttcgccgccgccatggtcaagatgggcgccatcggcgtgctcaccggcaccgccggcaccatccgggccaactgccgggtcgccaactgatctatccctgatccgtccgaccatcggtggtcacttgattgggtggccgggctgtgtgattaagatgtatgtaacgacgacgtagagtgttggtctgctgctgctgctgctgatgattcaatggtgttagttgtgtaagaagagtaagacgtagagtgttgagctcctcttttttttatttacatttttttgttctcttcttttttatactttttatttatggttttgatgagatgagatatatatatgtagc

SEQ ID NO: 35750 - protein, 127 aa, Panicum virgatum
  misc_feature: Ceres CLONE 1962955
  misc_feature: SWISSPROT Homolog: EC 1.11.1.7 Peroxidase
RQRLYSYGPNAAGQDPSMDPTYLAALTQQCPQQPASGGGADGTVAMDPVTPTALDTNYYASIVAKRGLLASDQALLADPTTAAQVVAYTNSPDTFQTDFAAAMVKMGAIGVLTGTAGTIRANCRVAN

SEQ ID NO: 35751 - DNA, 969 bp, Panicum virgatum
  misc_feature: Ceres CLONE 1962960
  misc_feature: Encodes the peptide sequence at SEQ ID NO. 35752
gagaatctgaagttctgaacctgcacctgcagcagcagagtgcccggtccggcggctccccattcgaccatctccggccgccgcccctccgtcggcccgtctccccagcggcatgggcaccgtcacggccgccgatccgcacacctccttcctcgccgacaaggacgccaaggtcttcgtcgccgggcaccggggcctcgtcggttccgcggtcgtgcgccgcctcctctcgctcggcttcacctccgtcgtcgtccggacccacgccgagctcgacctcacccgccaggccgacgtcgaggccttcttcgccgccgagcgcccgcgctacgtcgtcctcgccgccgccaaggtcggcggcatccacgccaactccaccttccccgccgacttcatcgccgccaacctcgccgacgcggtcatcttcttgatggaccagtactccgggctggagcacgtcaacgtggggagtgggagcgaggtcgccatcaaggagctcgctgagctggtgaaggaggtggtggggttccaggggaagctggtgtgggactccagcaagccggacggcacacccaggaagctcatggatagctccaagatacaaggcatggggtggaagcctaagatcgccctcaaggagggcctcgtcgaaacctacaaatggtatgttgagaatgtcgtctctggcaagaagtagagccttgcttgccagtggtggtggtgtctttctctccatagctactcttgcaagttggtgtcatgatttctagtgttcctatggttgttgattatcagatcatacgattctgttttactacccacatagaagaggtttgttataatgttatgtgttggctgaataatctgtgggtcaaatttgtatactgctaggatcataattgatcttgaacactttttggtgattagaaagtttaacgaccatctgatggatggatgttcttggcctag

SEQ ID NO: 35752 - protein, 194 aa, Panicum virgatum
  misc_feature: Ceres CLONE 1962960
  misc_feature (21)..(192): Pfam Name: Epimerase Pfam Description: NAD dependent epimerase/dehydratase family
  misc_feature: SWISSPROT Homolog: EC 1.1.1.271 GDP-L-fucose synthase
MGTVTAADPHTSFLADKDAKVFVAGHRGLVGSAVVRRLLSLGFTSVVVRTHAELDLTRQADVEAFFAAERPRYVVLAAAKVGGIHANSTFPADFIAANLADAVIFLMDQYSGLEHVNVGSGSEVAIKELAELVKEVVGFQGKLVWDSSKPDGTPRKLMDSSKIQGMGWKPKIALKEGLVETYKWYVENVVSGKK

SEQ ID NO: 35753 - DNA, 663 bp, Panicum virgatum
  misc_feature: Ceres CLONE 1962965
  misc_feature: Encodes the peptide sequence at SEQ ID NO. 35754
ctcgccgtcgactcccatccccacccaccacagacctcacctctccccgcgacgaatcggcgaggcggcggcggcggcgagcgctagaaccttgctgctgaagacgcgggatggccggcatgggcgagatgccgatgaggccggcgcggccgggcccgccgatgcagcaccggggcccgccgccgatggcgcgcctccgccccgaaccgatagaccgcgagaagacctgtcctctcttgctcagggtcttcacaagggttgctggccatcaccaaaatgaagagtttgcggtgagagggaaggagccaaaagatgaagttcagatttacacatggaaggatgccacgctccgtgagctcacagaccttgtaaaagaggttgctcttccagcaaggaaaagaaatgctaggctttcttttgcttttgtgtacccagacaagaatggccgttttgttgtcagacaggtgggttcgacctttgcatatggtcatggaagaggggatgatgccaaaactctggcagagctcgggttccagattggtgattacttgagtgttgcaatcatgtagacgatagccgatgctgaacgcgacgactgcaccggactggatgtaactgttgggacgtcaaaaggcccggggggcaagtgatgaatctgtgtta

SEQ ID NO: 35754 - protein, 152 aa, Panicum virgatum; identical to SEQ ID NO: 12928
  misc_feature: Ceres CLONE 1962965
  misc_feature (30)..(151): Pfam Name: SAP18 Pfam Description: Sin3 associated polypeptide p18 (SAP18)

SEQ ID NO: 35755 - DNA, 158 bp, Panicum virgatum
  misc_feature: Ceres CLONE 1962973
  misc_feature: Encodes the peptide sequence at SEQ ID NO. 35756
ggatcgcggaggactcggtcttggcggaggtcttggcggcggtcgcggtcttgttggaggaggcggaggcggcctcaggggcggcgcttgtgccggaggaggcctctggcacggcggcgggcttgcacgcggccttggtatggggggaggcggtggcg

SEQ ID NO: 35756 - protein, 52 aa, Panicum virgatum
  misc_feature: Ceres CLONE 1962973
  misc_feature: Functional homolog of the protein sequence given in SEQ ID NO 50431
  misc_feature: Useful for making plants with altered alkaloid content
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Functional homolog of the protein sequence given in SEQ ID NO 50178
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50143
  misc_feature: Useful for making plants with altered lignin content
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Functional homolog of the protein sequence given in SEQ ID NO 50210
  misc_feature: Useful for making plants with modulated biomass
  misc_feature: Functional homolog of the protein sequence given in SEQ ID NO 50144
  misc_feature: Useful for making plants with altered terpenoid content
  misc_feature: Functional homolog of the protein sequence given in SEQ ID NO 50179
  misc_feature: Useful for making plants with modulated phosphate use efficiency
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1929 in the 10/374,780 US patent application
  misc_feature: The sequence is a functional homolog of SEQ ID NO 120 in the 10/225,066 US patent application
  misc_feature: The sequence is a functional homolog of SEQ ID NO 218 in the 10/374,780 US patent application
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: The sequence is a functional homolog of SEQ ID NO 791 in the 10/374,780 US patent application
  misc_feature: Functional homolog of the protein sequence given in SEQ ID NO 50268
  misc_feature: Useful for making plants with modulated heat sensitivity
  misc_feature: Useful for making plants with modulated low light sensitivity
DRGGLGLGGGLGGGRGLVGGGGGGLRGGACAGGGLWHGGGLARGLGMGGGGG

SEQ ID NO: 35757 - DNA, 725 bp, Panicum virgatum
  misc_feature: Ceres CLONE 1962974
  misc_feature: Encodes the peptide sequence at SEQ ID NO. 35758
acacagatacattcgtcgatccaccactgtccagtgcttggcggttacgcacgcacgcacacagataggattatcttttactacaccaactcaccaagatactagcaagccgaatcgacaaacaagcagcaggaagaggaggcatggcgctcgcggaggggaacgtcatcttcggcgaggagcaggaggcgctggtgctcaagtcgtgggccctcatgaagaaggactcggccgacctcggcctccgcttcttcctcaagatcttcgagatcgcgccgtcggcgaagcagatgttctcgttcctgcgcgactccgacgtgccgctcgagaagaaccccaagctcaagacccacgccatgtccgtcttcgtcatgacctgcgaggcggcggcgcagctacggaaggccgggaaggtcaccgtcagggagacgacgctcaagcggctgggcgccacgcacttcaagtacggcgtcgccgacggccacttcgaggtgacgaggttcgcgctgctggagacgataaaggaggcgcttcccgccgacatgtggagcctggagatgaagtacgcctggagcgaggcttacaaccagcttgtggcggccatcaagcaggagatgaagcctgccgcatgatgctgctgctgctactcggcctccgcgctgagttccccctacgatgcaccaccatctccaaattcttcatcgctgtttttttttgctgttttg

SEQ ID NO: 35758 - protein, 162 aa, Panicum virgatum
  misc_feature: Ceres CLONE 1962974
  misc_feature (14)..(123): Pfam Name: Globin Pfam Description: Globin
  misc_feature: Functional homolog of the protein sequence given in SEQ ID NO 50202
  misc_feature: Useful for making plants with modulated cold sensitivity
  misc_feature: Useful for making plants with modulated salt sensitivity
MALAEGNVIFGEEQEALVLKSWALMKKDSADLGLRFFLKIFEIAPSAKQMFSFLRDSDVPLEKNPKLKTHAMSVFVMTCEAAAQLRKAGKVTVRETTLKRLGATHFKYGVADGHFEVTRFALLETIKEALPADMWSLEMKYAWSEAYNQLVAAIKQEMKPAA

SEQ ID NO: 35759 - DNA, 743 bp, Panicum virgatum
  misc_feature: Ceres CLONE 1962983
  misc_feature: Encodes the peptide sequence at SEQ ID NO. 35760
aaaattgacacacacacacacacacacacacacacgacatacaatacaagtgcaaatcactcatctagcaatggccgagaaggttgcgcgcttcgctctggcgctcgccatggtggcggccgccggcgtcctcatcacgccgtgcgcggcgcagaactcgccgcaggacttcgtggacctgcacaacgcggcgcggtccgccgtcggcgtcggcccggtgtcgtgggacgacaacgtggccgccttcgcgcagagctacgcggcgcagcgcgccggcgactgcgctctccagcactccagcggcagcggctacggcgagaacatcttcgtgggcggcgccggcgctgactggtcggcgtcggacgccgtcggcctgtgggtggcggagaagcagtggtacgaccacgacagcaactcctgctcggcgccgccggaccagtcgtgcggccactacacgcaggtggtgtggcgtgactccaccaccatcggctgcgcccgcgtcgtctgcgacaacggcggcgtcttcatcacctgcaactacaacccgccgggcaacttcgagggacagagcccgtactagattaatctctatcggagtcgcactgcatgaatagctagttccaaatttcagttcatcgtacgcgtacatgcatatgcaggtgcattgtgacatgatattaaataaattaagtaaaataatgaatgtcataagcaataaataaataatgtgatttcacagtttg

SEQ ID NO: 35760 - protein, 169 aa, Panicum virgatum
  misc_feature: Ceres CLONE 1962983
  misc_feature (35)..(157): Pfam Name: SCP Pfam Description: SCP-like extracellular protein
  misc_feature: Functional homolog of the protein sequence given in SEQ ID NO 50414
  misc_feature: Useful for making plants with modulated biotic stress sensitivity
MAEKVARFALALAMVAAAGVLITPCAAQNSPQDFVDLHNAARSAVGVGPVSWDDNVAAFAQSYAAQRAGDCALQHSSGSGYGENIFVGGAGADWSASDAVGLWVAEKQWYDHDSNSCSAPPDQSCGHYTQVVWRDSTTIGCARVVCDNGGVFITCNYNPPGNFEGQSPY

SEQ ID NO: 35761 - DNA, 720 bp, Panicum virgatum
  misc_feature: Ceres CLONE 1962996
  misc_feature: Encodes the peptide sequence at SEQ ID NO. 35762
ataccttttaattaagaaactctctatacataatgtctgtcctcgaacaactcaagaaattcaccaccattgttgccgattccggtgattttgaatccattgcccaatacaagccccaagatgctaccactaacccctctttgatcttggctgctgctcaaaagccccaatatgctcatctcatcgatgatgctatcaagtatgctcaatccaagaacatctcttctgaagagaagcttgacttggctactgataagctcttggttaactttggttccgagatcttgaagatcgttcccggtcgtgtctccaccgaagttgatgctcgtctctctttcaacactgaggctactattgctaaggctcttgttctcatcaagttgtatgaagagaacggtatcaacaaggaccgtgtcttgatcaagattgcctccacctgggaaggtatccaagcagctcatgtcctcgagacccaacacggtatccactgtaacttgaccttgttgttcggtttcgctcaagctgttgcttgtgccgaggctggtgtcactcttatttctcccttcgttggtcgtatcctcgattggtacaagaagagcactggtcaagactactctgccacctctgatcctggtgtccaatctgtcagcaagatctacaactactacaagaagtttgggctacacaccattgttatgggtgcttctttccgtaccacag

SEQ ID NO: 35762 - protein, 229 aa, Panicum virgatum
  misc_feature: Ceres CLONE 1962996
  misc_feature (12)..(229): Pfam Name: Transaldolase Pfam Description: Transaldolase
  misc_feature: SWISSPROT Homolog: EC 2.2.1.2 Transaldolase
MSVLEQLKKFTTIVADSGDFESIAQYKPQDATTNPSLILAAAQKPQYAHLIDDAIKYAQSKNISSEEKLDLATDKLLVNFGSEILKIVPGRVSTEVDARLSFNTEATIAKALVLIKLYEENGINKDRVLIKIASTWEGIQAAHVLETQHGIHCNLTLLFGFAQAVACAEAGVTLISPFVGRILDWYKKSTGQDYSATSDPGVQSVSKIYNYYKKFGLHTIVMGASFRTT

SEQ ID NO: 35763 - DNA, 558 bp, Panicum virgatum
  misc_feature: Ceres CLONE 1963004
  misc_feature: Encodes the peptide sequence at SEQ ID NO. 35764
gctcaagcagggaaaacaaagcatctcactagagcctggtggccaatttgaacttagtggtgctcctcttgaaacattacatcagacatgtgcagaggtcaattcacatctttatcaggtcaaagcagttggagaggaaatgggaataggatttcttggacttggctttcagccaaaatgggcattgagtgatataccaataatgccgaagggaagatacgaaataatgaggaattacatgcctaaagttggtactcttggcctcgatatgatgttccgtacatgtaccgtgcaggttaatcttgacttcagttcggaacaggatatgataaggaaattccgcgctggccttgcattgcagcctattgcaacagcaatatttgccaattctccatttaaagaaggaaagccaaatggatttctcagcttaaggagccatatctggacagatactgataacaaccgtgcagggatgctcccttttgtctttgatgactcatttggattcgagcaatatgtggattatgcattagatgtccctatgtattttgtgtatcg

SEQ ID NO: 35764 - protein, 185 aa, Panicum virgatum
  misc_feature: Ceres CLONE 1963004
  misc_feature (1)..(185): Pfam Name: GCS2 Pfam Description: Glutamate-cysteine ligase family 2(GCS2)
  misc_feature: SWISSPROT Homolog: EC 6.3.2.2 Glutamate--cysteine ligase
LKQGKQSISLEPGGQFELSGAPLETLHQTCAEVNSHLYQVKAVGEEMGIGFLGLGFQPKWALSDIPIMPKGRYEIMRNYMPKVGTLGLDMMFRTCTVQVNLDFSSEQDMIRKFRAGLALQPIATAIFANSPFKEGKPNGFLSLRSHIWTDTDNNRAGMLPFVFDDSFGFEQYVDYALDVPMYFVY

SEQ ID NO: 35765 - DNA, 527 bp, Panicum virgatum
  misc_feature: Ceres CLONE 1963025
  misc_feature: Encodes the peptide sequence at SEQ ID NO. 35766
atcaaccacaatcccacgcataaatcttaccagctattcccagatcttcgatcttcaccatgatctcgcaggataattccagtatgggctcagataagagctcctccgtacagtttcaggacttcctaccgttgatggcgaggaaactcggtgtggaggggctgattcaggagctctgcaaggggttccagctgctgatggagcccagcacaggcaagatcaccttccagagcctgaagcggaatgcatccaggctcgggttaggcgagcttcgggatgatgagctcctggagatgatgagggaaggggacctggatcagatggagttctgcattctcatggtcagactgagcccagagctgatggaagaagaggcacacagggtgtttgactctgaacactgatgcaattttatccttgtttcttgaatacaacagctctgtaacacggatacgccagcttaccagcgtatcgcgtatccgatacgtgtcggatacggatacatatccgatacgccatggatacgt

SEQ ID NO: 35766 - protein, 114 aa, Panicum virgatum
  misc_feature: Ceres CLONE 1963025
  misc_feature: Functional homolog of the protein sequence given in SEQ ID NO 51220
  misc_feature: Useful for making plants with altered glycerol content
MISQDNSSMGSDKSSSVQFQDFLPLMARKLGVEGLIQELCKGFQLLMEPSTGKITFQSLKRNASRLGLGELRDDELLEMMREGDLDQMEFCILMVRLSPELMEEEAHRVFDSEH

SEQ ID NO: 35767 - DNA, 573 bp, Panicum virgatum
  misc_feature: Ceres CLONE 1963054
  misc_feature: Encodes the peptide sequence at SEQ ID NO. 35768
aaggagagaacatggctccgatccatcagcccggccgttgcatttattagttgcacttcttatgctagtgaaagttctgtagtcgttcttgttcagaataaagttctcctttcttagatgcattattgtactgtgtggcctcttgttaggaatccggtgagcaagttcttcaagagctcacatggaagatggcggtgttccaagaagatctactccccctactactcgtagaagcagatctgctgagtttcacaatttttcagaaaggaggagaagggataggatcaacgagaagctgaaggcgctgcaggagttacttccaaattgcaccaagaccgacaaagtgtccatgctagatgaagcgatcgactaccttaaatcacttcagctacaacttcagatgctggtcatggggaagggaatggcaccggtggttcctcctgagctgcagcaatacatgcactacatcaccgctgatcctgcccagatgccaccattgcgcccttctggccagcagccccggccatttcagataactcaagctaactcacaccgacaatctaacgtcgagtc

SEQ ID NO: 35768 - protein, 130 aa, Panicum virgatum
  misc_feature: Ceres CLONE 1963054
  misc_feature (20)..(69): Pfam Name: HLH Pfam Description: Helix-loop-helix DNA-binding domain
  misc_feature: The sequence is a functional homolog of SEQ ID NO 528 in the 10/666,642 US patent application
  misc_feature: The sequence is a functional homolog of SEQ ID NO 120 in the 10/374,780 US patent application
  misc_feature: The sequence is a functional homolog of SEQ ID NO 388 in the 10/412,699 US patent application
  misc_feature: The sequence is a functional homolog of SEQ ID NO 494 in the 11/435,388 US patent application
  misc_feature: The sequence is a functional homolog of SEQ ID NO 890 in the 10/225,066 US patent application
  misc_feature: The sequence is a functional homolog of SEQ ID NO 905 in the 11/479,226 US patent application
MEDGGVPRRSTPPTTRRSRSAEFHNFSERRRRDRINEKLKALQELLPNCTKTDKVSMLDEAIDYLKSLQLQLQMLVMGKGMAPVVPPELQQYMHYITADPAQMPPLRPSGQQPRPFQITQANSHRQSNVE

SEQ ID NO: 35769 - DNA, 603 bp, Panicum virgatum
  misc_feature: Ceres CLONE 1963071
  misc_feature: Encodes the peptide sequence at SEQ ID NO. 35770
accagcacagggcaaggccgtgatgctcaagcccacagaggacagcaacaccagcgctccatctcctgagaagaaggtccggaagatgagggagtctccattcaacaagaagagtggctcgatcttgcagagaggctctactgctgccgcatcaagctctgagactaccgctgaggcttcaccaccctctggcagctccgcagagccagctgctgccccgcaacccaggaggacagccagggccaccaccagtaagcctgtctacatctctgagagcgaccctgaggatgaagtggtggagttaactgatgattcagactttgacgcggatggtgactctgatgacgagtgaactcggggccttgtgccgtcggactaagctatttgtggttcatgtgtggtgtggtatggtctaaaaaaatgtggtgtgtgctatggtctagtttgtgagttgttacatgctactctggtgcggcgtggccgtaggtacttgatgtgatgcatatcttgtgcgctgtgtatgtggtgttctgtgtcttgttgccaagacactgttcggttaactgatctctgtaattctggcttgcatccactgcttctgcc

SEQ ID NO: 35770 - protein, 116 aa, Panicum virgatum
  misc_feature: Ceres CLONE 1963071
  misc_feature: SWISSPROT Homolog: EC 5.99.1.3 DNA topoisomerase (ATP-hydrolyzing)
PAQGKAVMLKPTEDSNTSAPSPEKKVRKMRESPFNKKSGSILQRGSTAAASSSETTAEASPPSGSSAEPAAAPQPRRTARATTSKPVYISESDPEDEVVELTDDSDFDADGDSDDE

SEQ ID NO: 35771 - DNA, 691 bp, Panicum virgatum
  misc_feature: Ceres CLONE 1963092
  misc_feature: Encodes the peptide sequence at SEQ ID NO. 35772
aaacgggaggtggaagttcgcttgccaatttgccatgcttgtgtttgtttgtttgtttctcagaggaaagtaggctttttttttcttgataaaaaaaaaaaaatagagacacccagcgccgcagcccgcagccactcgacctcccgagcccccaggcggccaggcaccaggtgcggcggcggcggcggcggcggctgcggcggcaagatggcggtgggcaagaacaagcggatcagcaaagggaagaagggcggcaagaagaagaccgtcgatccattcgcgaagaaggattggtatgatatcaaggcgccctctgtcttctccgtgcgcaacattggaaagacactcgtgtccaggacacagggtactaagattgcttctgacggtctgaagcaccgtgtcttcgaggtctccctagctgatcttcagagtgatgaagaccaagcctacaggaagatcaggctccgtgctgaagacgtccagggtcgtaatgtccttaccaacttctggggaatggattttacgacagacaagctccggtcgcttgtcaggaagtggcagactttgattgaggcccatgttgatgttaagaccactgataactacatgttgcggctcttctgcattgggtttacaaagaggagacccaaccaagtgaagcgcacttgctacgcacaggcctcccagatcc

SEQ ID NO: 35772 - protein, 161 aa, Panicum virgatum
  misc_feature: Ceres CLONE 1963092
  misc_feature (11)..(161): Pfam Name: Ribosomal_S3Ae Pfam Description: Ribosomal S3Ae family
MAVGKNKRISKGKKGGKKKTVDPFAKKDWYDIKAPSVFSVRNIGKTLVSRTQGTKIASDGLKHRVFEVSLADLQSDEDQAYRKIRLRAEDVQGRNVLTNFWGMDFTTDKLRSLVRKWQTLIEAHVDVKTTDNYMLRLFCIGFTKRRPNQVKRTCYAQASQI

SEQ ID NO: 35773 - DNA, 830 bp, Panicum virgatum
  misc_feature: Ceres CLONE 1963115
  misc_feature: Encodes the peptide sequence at SEQ ID NO. 35774
gcggttcacacaggcacctaacaacaccatgtctgagaagaaatccggtgcagctcaacttgcttctgatttattagtcggtggctccattggtgcaatctccaaaactgtcatggcacctgtcgagcgtgtcaaacttttgatgcaaacccaagactccaatcctgctgtccttcgtggagaagttgagcgttacaaaggcattggtgattgctttagacgtgtccacgccgaacaaggccttcaagccttctggagaggaaacttggtcaactgccttcgttatgctcctcaacaaggatctgcgctcgcattcaacgattatttgaatgccgcattccctaactacaacccaaacacacacttctggcaaagctttggtgtcaaattgttttctggtggtctttctggagctattgcaaacaccatctgttacccattcgattttgcaagaactcgtcttgcttctgatttggcaaaaggaaagccacaattcaaaggaatcatggattgtattttgacaaccgtcagaggtcaaggtatcactggtctctacacaggatggactgtcacatgtatgggagctttcgtttaccgtgctggacaattaggatgcttcaaacaaatccaagatttgaatccgtaccaaaaggataaaggtgcattgggagctgtctcatcatttctcgctgttactgctgcaagaactgtcgtcatgccattcaactatccttttgacacagtcagaagaagaatgatgttgcaatctgaaaaacctgttgctgaacgtgtctacaaaggttcatgggattgctttgttaaagttctcc

SEQ ID NO: 35774 - protein, 276 aa, Panicum virgatum
  misc_feature: Ceres CLONE 1963115
  misc_feature (125)..(217): Pfam Name: Mito_carr Pfam Description: Mitochondrial carrier protein
  misc_feature (19)..(117): Pfam Name: Mito_carr Pfam Description: Mitochondrial carrier protein
RFTQAPNNTMSEKKSGAAQLASDLLVGGSIGAISKTVMAPVERVKLLMQTQDSNPAVLRGEVERYKGIGDCFRRVHAEQGLQAFWRGNLVNCLRYAPQQGSALAFNDYLNAAFPNYNPNTHFWQSFGVKLFSGGLSGAIANTICYPFDFARTRLASDLAKGKPQFKGIMDCILTTVRGQGITGLYTGWTVTCMGAFVYRAGQLGCFKQIQDLNPYQKDKGALGAVSSFLAVTAARTVVMPFNYPFDTVRRRMMLQSEKPVAERVYKGSWDCFVKVL

SEQ ID NO: 35775 - DNA, 1062 bp, Panicum virgatum
  misc_feature: Ceres CLONE 1963118
  misc_feature: Encodes the peptide sequence at SEQ ID NO. 35776
aaattaaaatccagaatcagtttctaatgagtgagggatcagaagttaaaaccggtaactttatgctcgatttcgccttgggtggtgtctctgccgctgtctccaagactgccgtcgcccccatcgaaagagtcaagcttcttctccaaactcaagacgctaacgccaagctcaccaagaagtacactggtatcgtcgattgtttgaccagagtccccaaggaagaaggtatcagcgctttctggagaggtaacctcgctaacgtcatcagatacttccccactcaagccttgaacttcgctttcaaggatacctacaagaagattttctgcccatacaaccccaagactgaattctggaagttcttcttcggaaacttagcctccggtggtgccgctggtgctacctctttgatggtcgtctatcctttggatttcgccagaactagacttgctgccgatgttggtaagactggtgctgaaagacaattcactggtctcgttgattgcctcactaaggtctacaagtccgatggttacaagggtctctaccaaggtttcggtgtctccgtccttggtatcatcgcctacagagcctgctacttcggtggttacgataccttgaagagagtcttgttctctgatggcaagacctccatcctcttcaagttcctcgtcgcccaagtcgtcactgctgcttctggtttgatctcttatccccttgataccgtcagaagaagactcatgatgcaatctggtgctaagactgttatgtacaacagtaccctcgattgtttcgctaagatcgccaagaatgaaggtggtaaggccttcttcaagggtgccctctccaacatcttcagaggtatgggtgcttcccttgtcttggtcatgtacgacgaaatgcaagcttatttcgcccccaagaagaccaactaaagaccatctcgttaattcacaccataatgatgatcgtaaacatttagtgtcatgttcacgtctgaataaacagttatgtttcctaagatgaaaaagacattttttatttatctatatatcacct

SEQ ID NO: 35776 - protein, 303 aa, Panicum virgatum
  misc_feature: Ceres CLONE 1963118
  misc_feature (11)..(105): Pfam Name: Mito_carr Pfam Description: Mitochondrial carrier protein
  misc_feature (113)..(207): Pfam Name: Mito_carr Pfam Description: Mitochondrial carrier protein
  misc_feature (210)..(301): Pfam Name: Mito_carr Pfam Description: Mitochondrial carrier protein
MSEGSEVKTGNFMLDFALGGVSAAVSKTAVAPIERVKLLLQTQDANAKLTKKYTGIVDCLTRVPKEEGISAFWRGNLANVIRYFPTQALNFAFKDTYKKIFCPYNPKTEFWKFFFGNLASGGAAGATSLMVVYPLDFARTRLAADVGKTGAERQFTGLVDCLTKVYKSDGYKGLYQGFGVSVLGIIAYRACYFGGYDTLKRVLFSDGKTSILFKFLVAQVVTAASGLISYPLDTVRRRLMMQSGAKTVMYNSTLDCFAKIAKNEGGKAFFKGALSNIFRGMGASLVLVMYDEMQAYFAPKKTN

SEQ ID NO: 35777 - DNA, 642 bp, Panicum virgatum
  misc_feature: Ceres CLONE 1963120
  misc_feature: Encodes the peptide sequence at SEQ ID NO. 35778
ttggttttctgtccattgcctctagtcgccttccgccggcgccgccgccaatggtttcctcctgggccgccgccggcaccgccgccgcggcctccctctcaccggcgcattcggcaaaccaaagaacgccggcccagggccgcctcctcttccccggggcggcccccacctcccgctccctccggttcacccccgccggccgccgctcgccggcaacccgttcctcgcgtcggggggccaaggttgggggggcaccgttggttaaccctctcaaggtcatgatagcgggggctcccgcgtcaggcaagggcacccatggtgacctcatcaaggccaattttggtcgggggcacttctctgctgaaaatttgttacgggcaaaaatccctgctgggtccaaaaagggaaagcaggccaaggatttctgggaaaagggccacctagggccggatgaaattgtattcaatatggttaaggaaccccttctgcaaccaaatgctcaggaaaacggttggttatggaacgggaacccaaaaacttattcacaggccagggcgttggaaactcttgaaatccggcctgattttttcatttggttaaaggtcccaaaggacctcctggttgaaagggtggttggagaac

SEQ ID NO: 35778 - protein, 197 aa, Panicum virgatum
  misc_feature: Ceres CLONE 1963120
  misc_feature (78)..(197): Pfam Name: ADK Pfam Description: Adenylate kinase
  misc_feature: SWISSPROT Homolog: EC 2.7.4.3 Adenylate kinase
MVSSWAAAGTAAAASLSPAHSANQRTPAQGRLLFPGAAPTSRSLRFTPAGRRSPATRSSRRGAKVGGAPLVNPLKVMIAGAPASGKGTHGDLIKANFGRGHFSAENLLRAKIPAGSKKGKQAKDFWEKGHLGPDEIVFNMVKEPLLQPNAQENGWLWNGNPKTYSQARALETLEIRPDFFIWLKVPKDLLVERVVGE

SEQ ID NO: 35779 - DNA, 734 bp, Panicum virgatum
  misc_feature: Ceres CLONE 1963124
  misc_feature: Encodes the peptide sequence at SEQ ID NO. 35780
gatccttcagcgccgagatcaagcccctggtcccaaaagttatacaaaagatcgaaaacgccaccaaggtgttgatcggccttggagcgaagacaatcgtcgtccccgggaacttccccataggctgcatcccgaggtacctcaccatgttccagagcaacaaccccggcgactacgatgcggccgggtgtatcaggtggctcaacgacttcgctgaggaacataaccgcgcgctcaggctcatgctggagcgcatcgcccgcaatccgacagtcaccatcgtctacggcgactactacggcgccacccttgagatcacccgtagccctcagaaacacgggttcaggaaggacgttgctctgaccgcgtgctgcggcgacggcggcccccacaactccggcaagctcttctcttgcaacccgacgtcgattctgtgccctaacccgtccaagcacatatcctgggacgggcttcatctcactgaagctgcataccaattcgtggcgcgtggcctgctcgacgctgcaccgtctattctgtccaaatgcagatactaattgaaccctctgcctcttgcattgcatccaaaacatatatcggctcgacaaggccttacaatcacactgcctgctgctggtagagtagatttggtgatgtcaagccatcgcgtggctgctatatttatgtaaaatcgatcttcttgacgactgcacagttctcgtgacaactaagac

SEQ ID NO: 35780 - protein, 184 aa, Panicum virgatum
  misc_feature: Ceres CLONE 1963124
  misc_feature: SWISSPROT Homolog: EC 3.2.1.51 Alpha-L-fucosidase
SFSAEIKPLVPKVIQKIENATKVLIGLGAKTIVVPGNFPIGCIPRYLTMFQSNNPGDYDAAGCIRWLNDFAEEHNRALRLMLERIARNPTVTIVYGDYYGATLEITRSPQKHGFRKDVALTACCGDGGPHNSGKLFSCNPTSILCPNPSKHISWDGLHLTEAAYQFVARGLLDAAPSILSKCRY

SEQ ID NO: 35781 - DNA, 920 bp, Panicum virgatum
  misc_feature: Ceres CLONE 1963151
  misc_feature: Encodes the peptide sequence at SEQ ID NO. 35782
aaatatatcttatataaattaaagcagcgaagcataatgcctccaaagaagttcaagaagtccactaagagcaccaaggctgccaaggccaacagaaaccccctcttcgagaagagacccagaaacttcagaattggtggtgatatccaacctactagagatttgaccagatttgtccgctggcccaaatatatcctcctccagagacaaaagagagtcttgctccaaagacttaaggtcccaccagcactcaaccaattctctcaaactattgatagaaaccaagctactactctcttgaagctcctcagaaagtaccaacctgaatctgaacaaaagagaaaggagagaagattggaagctgctaagctcaaggctgaaaacaagaagcctgctgacactaagccaccaattgctcttaaatacggcttgaacaacgtcactggtcttattgaggataagaaagccagattggtcattattgccaatgatgttgaccccattgaaactatcgtttggctccctcaactctgcagaaagcaagaagtccccttctgcttcatcagaggaaaggcaagactcggtaaattggtcggtttgaagactgccagttgcgtcgctttgaccggtatcagaaaagaagaccaagctgagttcgataacttggttaagactttcaaggctcaattcaatgaaaacgaaaacttgaagagagtttggggtggtggtcttttgggacataaatcaagactcgccaaggaacataaggaaaaactcatcgaggctgaaaaacttaagaaggctcccgtgtaaaaaagcataagttcaataagagtatataagtttgtattaaagtccgcaggcattaccttgttgtaaacaaaatctaaacgttaaacaaagcaccaaaggggcattgg

SEQ ID NO: 35782 - protein, 258 aa, Panicum virgatum
  misc_feature: Ceres CLONE 1963151
  misc_feature (113)..(208): Pfam Name: Ribosomal_L7Ae Pfam Description: Ribosomal protein L7Ae/L30e/S12e/Gadd45 family
MPPKKFKKSTKSTKAAKANRNPLFEKRPRNFRIGGDIQPTRDLTRFVRWPKYILLQRQKRVLLQRLKVPPALNQFSQTIDRNQATTLLKLLRKYQPESEQKRKERRLEAAKLKAENKKPADTKPPIALKYGLNNVTGLIEDKKARLVIIANDVDPIETIVWLPQLCRKQEVPFCFIRGKARLGKLVGLKTASCVALTGIRKEDQAEFDNLVKTFKAQFNENENLKRVWGGGLLGHKSRLAKEHKEKLIEAEKLKKAPV

SEQ ID NO: 35783 - DNA, 723 bp, Panicum virgatum
  misc_feature: Ceres CLONE 1963158
  misc_feature: Encodes the peptide sequence at SEQ ID NO. 35784
atcggcgcatcgtgctcgggcacgcatcaccaaccaccccttgcgcccgtcctcaccccctcaccggccgattcgctcgctcgccgaccgcccgcgcgcgcgcgctcgcgagatccagaccagggcgccgccgccgcgcgccgacgggacgaaccggtaggacggcgccgaagagcacgaggaggaagcgcgggccatggaggcgtcttcctgggacgcccttcgcaagcaggcgaggaggttggaagctcagttagatgaccaaatgattgcataccgtaaattggtttctatgaaatcggatggttcagagaacgatatcgagtcagatatagaaagatcactgaagcaattgcagcaagtaaattcgcaaatgcaaacttgggtatcatcaggaggttctgaagttctttctcatactctgactcgtcatatggagattttgcaagaccttacccaggaattctatcggcttcgatcaagcctcagagtgaaacagcaacatgcttctctccttgacttgagagattttgatagagcaaagtttgatgtcgaagaggcatcagactcagctgatcaagctcttctaagggaacaagctgcaattagcaggagtactggacagatggataacgtgatatcgcaagctcaagtgacgctaggctctctcatgactcaacggtcaacattcgggcggcatcacttcaaagataagcaatgtca

SEQ ID NO: 35784 - protein, 175 aa, Panicum virgatum
  misc_feature: Ceres CLONE 1963158
  misc_feature (46)..(172): Pfam Name: V-SNARE Pfam Description: Vesicle transport v-SNARE protein
MEASSWDALRKQARRLEAQLDDQMIAYRKLVSMKSDGSENDIESDIERSLKQLQQVNSQMQTWVSSGGSEVLSHTLTRHMEILQDLTQEFYRLRSSLRVKQQHASLLDLRDFDRAKFDVEEASDSADQALLREQAAISRSTGQMDNVISQAQVTLGSLMTQRSTFGRHHFKDKQC

SEQ ID NO: 35785 - DNA, 909 bp, Panicum virgatum
  misc_feature: Ceres CLONE 1963159
  misc_feature: Encodes the peptide sequence at SEQ ID NO. 35786
atacggtgccgaactgcgcgctaacctagaacccacaaagggtgttggtcgattactctttccagcaccctcagctgggctaggtgaaaatgggcgcctacaagtatctggaggagctccacaagaagaagcagagcgatgtcgttcgcttcttgctccgcatccgctgctgggagtatcgccagctgccctcagtcatcaggctgaggaggccttctcgccctgacaaggctcgtcgcatgggcttcaaggccaagcagggctatgttgtgtaccgtgcacgcgttcgccgtggtggccgcaagaagccagtgcacaagggtattgtgtatggtaagcccgtgaaccagggtatcacccagctcaagcctacccgcaacctgcgtaacttggctgaggagcgtgttggccgcaagtgcgaaggcctgcgcgtgctaaacagctactgggtgaacgaggactcgacctacaagtactttgaggtcatcctcattgacccatcccacgcagccatccgcaacgatcctcgcatcagctggatcgtcaacccaatccacaagcaccgcgagctgcgtggcttgacagcagctggcaagtcataccgtggtctgcgcgccaaggggcatgctgccaacaagacccgcccatccaggagggccagctacaagaagcgcaatgctgtctcattcaggcgcttccgttaaaccatgtctgttcggctttgccaacactggtggcgcagcctgtcagcagcagctggagcagctttggccttttcaattggtggtcagccagctctgggcacagcgacaattgccctgcgctctgcagtgtatggatgtcagtgaccctgtcctgcttgctggcaagtttagtttccagggttgttatctaagcatcaactccgcg

SEQ ID NO: 35786 - protein, 204 aa, Panicum virgatum
  misc_feature: Ceres CLONE 1963159
  misc_feature (2)..(193): Pfam Name: Ribosomal_L15e Pfam Description: Ribosomal L15
MGAYKYLEELHKKKQSDVVRFLLRIRCWEYRQLPSVIRLRRPSRPDKARRMGFKAKQGYVVYRARVRRGGRKKPVHKGIVYGKPVNQGITQLKPTRNLRNLAEERVGRKCEGLRVLNSYWVNEDSTYKYFEVILIDPSHAAIRNDPRISWIVNPIHKHRELRGLTAAGKSYRGLRAKGHAANKTRPSRRASYKKRNAVSFRRFR

SEQ ID NO: 35787 - DNA, 663 bp, Panicum virgatum
  misc_feature: Ceres CLONE 1963171
  misc_feature: Encodes the peptide sequence at SEQ ID NO. 35788
cacgcgcaccaggcaggcacctcccttccccgagcccccctttcccccctcctcctcctccacccgctgccccgcatccccaccacctccggcgaaggagcagcggatcggagacgaggcgatggggcagcagcagctgatctacgcgttcgtggcgcggggcacggtggtgctggccgagtacaccgagttcaccggcaacttcaccaccatcgcggcccagtgcctgcagaagctccccgccagcaacaacaagttcacatacaactgcgacggccacaccttcaactacctcgtcgaggacggattcacgtactgtgtagtcgctgttgaatcagttggtcggcaaatccccattgctttcctggacagagttaaggaagatttcaccaaaaaatatggtggtgggaaagcagctactgcagcagcaaacagcttgaacagggagtttggatcaaaacttaaagagcacatgcagtactgtgtggaccaccctgaggaggtcagcaagcttgccaaggtgaaggcccaagtctcagaagttaaaggagtgatgatggagaatattgagaaggttctggaccgtggggagaagattgagctgcttgttgacaagactgagaatctccgttctcaggcacaagatttcaggcagcagggcac

SEQ ID NO: 35788 - protein, 180 aa, Panicum virgatum
  misc_feature: Ceres CLONE 1963171
  misc_feature (127)..(180): Pfam Name: Synaptobrevin Pfam Description: Synaptobrevin
MGQQQLIYAFVARGTVVLAEYTEFTGNFTTIAAQCLQKLPASNNKFTYNCDGHTFNYLVEDGFTYCVVAVESVGRQIPIAFLDRVKEDFTKKYGGGKAATAAANSLNREFGSKLKEHMQYCVDHPEEVSKLAKVKAQVSEVKGVMMENIEKVLDRGEKIELLVDKTENLRSQAQDFRQQG

SEQ ID NO: 35789 - DNA, 682 bp, Panicum virgatum
  misc_feature: Ceres CLONE 1963193
  misc_feature: Encodes the peptide sequence at SEQ ID NO. 35790
tcaagtggctcgagcgcttcgcctacatcaacaccaccatctaccccttcacctcgctgccgctgctcgcctactgcaccctccccgccgtctgcctcctcaccggcaagttcatcatgccgtcgatcagcacgttcgccagcctcttcttcatcgcgctcttcatgtccatcttcgcgacgggcatcctggagatgcgctggagcggggtgagcatcgaggagtggtggaggaacgagcagttctgggtcatcggcggcgtgtcggcgcacctcttcgccgtggtgcagggcctgctcaaggtcctcgccgggatcgacaccaacttcaccgtcacctccaaggccaccggcgacgaggacgacgagttcgccgagctctacgccttcaagtggaccacgctcctcatcccgcccaccacgctcctcatcatcaacatcatcggcgtcgtcgccggcatctccgacgccatcaacaacggctaccagtcctggggcccgctcttcggcaagctcttcttcgccttctgggtcatcgtccacctctaccccttcctcaaggggctcatgggccgccagaacaggacgcccaccatcgtcgtcatctggtccgtgctgctcgcctccatcttctccctgctctgggtcaggaacgaccccttcatcgtcaggaccaaggggcc

SEQ ID NO: 35790 - protein, 226 aa, Panicum virgatum
  misc_feature: Ceres CLONE 1963193
  misc_feature: SWISSPROT Homolog: EC 2.4.1.12 Cellulose synthase (UDP-forming)
  misc_feature: Functional homolog of the protein sequence given in SEQ ID NO 51500
  misc_feature: Useful for making plants with altered cell wall content and/or composition
  misc_feature: Useful for making plants with modulated biomass
  misc_feature: The sequence is a functional homolog of SEQ ID NO 6 in US patent 7285702
  misc_feature: Functional homolog of the protein sequence given in SEQ ID NO 50124
  misc_feature: Useful for making plants with altered carbohydrate content
  misc_feature: The sequence is a functional homolog of SEQ ID NO 26 in US patent 7312377
  misc_feature: The sequence is a functional homolog of SEQ ID NO 2 in US patent 7049481
  misc_feature: Functional homolog of the protein sequence given in SEQ ID NO 50125
  misc_feature: Useful for making plants with modulated plant growth and development
KWLERFAYINTTIYPFTSLPLLAYCTLPAVCLLTGKFIMPSISTFASLFFIALFMSIFATGILEMRWSGVSIEEWWRNEQFWVIGGVSAHLFAVVQGLLKVLAGIDTNFTVTSKATGDEDDEFAELYAFKWTTLLIPPTTLLIINIIGVVAGISDAINNGYQSWGPLFGKLFFAFWVIVHLYPFLKGLMGRQNRTPTIVVIWSVLLASIFSLLWVRNDPFIVRTKG

SEQ ID NO: 35791 - DNA, 689 bp, Panicum virgatum
  misc_feature: Ceres CLONE 1963221
  misc_feature: Encodes the peptide sequence at SEQ ID NO. 35792
agatgcaggaacatgcaaacttacagcatgagaaagatgagttggaacaacagttgttggaaataagaaaggaactggatggtgcctaccataccatagcaaatcaggaagaacaagcttcggtgagagagataaagtgggatgcctataggaagtattcagaggatcaactggaagctgagcagcagcgtactgcagagcttgaactgcaagtatcagctcttaaacaacagctccaagaatctgagatccattacaagcgaaaggaagaacaagtttctttaagggaggttcaatgggaagcggataaaactcattcactggacgagctggaagctcagcgtcagtatgccaacgacttggagaaacagatcgaagctcttacacagaagctacaatcagttgacgcacactacaagcagaaggtcacagaagagagggataaacttgctgaggtcaccacggagttcaacaaattgacacaaaaagtaagcaagagtgttgaattggagaagaaggtgcaggaccttgaacagaagctgaaggtagcttactctaaatctgaggaacaggcaaatgatgctgtccagttgagatcccgggaattcaccatggattcatcaacaacttcaggcaaacaacacgacagatcttcagctgctgacacgacctcgccaaacctaagccag

SEQ ID NO: 35792 - protein, 228 aa, Panicum virgatum
  misc_feature: Ceres CLONE 1963221
  misc_feature: SWISSPROT Homolog: EC 2.7.11.1 Non-specific serine/threonine protein kinase
MQEHANLQHEKDELEQQLLEIRKELDGAYHTIANQEEQASVREIKWDAYRKYSEDQLEAEQQRTAELELQVSALKQQLQESEIHYKRKEEQVSLREVQWEADKTHSLDELEAQRQYANDLEKQIEALTQKLQSVDAHYKQKVTEERDKLAEVTTEFNKLTQKVSKSVELEKKVQDLEQKLKVAYSKSEEQANDAVQLRSREFTMDSSTTSGKQHDRSSAADTTSPNLS

SEQ ID NO: 35793 - DNA, 665 bp, Panicum virgatum
  misc_feature: Ceres CLONE 1963229
  misc_feature: Encodes the peptide sequence at SEQ ID NO. 35794
cccaagcagcagctagcatcaatggccacctcctcctcctcctcgatgaccctcctgctgctggtcctgggcgcctccttggcagccagcgccagcgccgcgaccttcaccatcaccaacaactgcgggttcacggtgtggccggcggcgacgcccgtgggcgggggcacgcagctgaaccgaggcgggacgtggaccgtcaacgtgccggcgggcaccagctccggccgcgtgtgggcgcgcacgggctgctccttcaacggcaaccgcgggagctgccagacgggcgactgcggcggcgcgctcgcctgcacgctgtccggccagccgccgctgacgctggccgagttcaccatcggcggcagccaggacttctacgacatctcggtcatcgacggcttcaacgtcggcatggccttctcctgcagcaccggcgtcgggctggtgtgcagggactccggatgccctgacgcgtaccacaaccccaacgacgtcaagacccatgcctgtggcggcaacagcaactaccgggtcaccttctgcccgtgatcgatgagatgaggctgccgtaataatgtatcaagtgattatatatatatatatatatatatatatatatatatatatatatatatatatatatatatatatatatatatatatat

SEQ ID NO: 35794 - protein, 175 aa, Panicum virgatum; identical to SEQ ID NO: 12350
  misc_feature: Ceres CLONE 1963229
  misc_feature (33)..(175): Pfam Name: Thaumatin Pfam Description: Thaumatin family

SEQ ID NO: 35795 - DNA, 495 bp, Panicum virgatum
  misc_feature: Ceres CLONE 1963235
  misc_feature: Encodes the peptide sequence at SEQ ID NO. 35796
atagctagctcgctctcaccggctcatcgctcgctctcggcgctagctccagcccgttctctctctagctagtgtttccttcctctttgctgtcctggtgaggcggttcggatgctgtcccacgtcgagatggcccccgcggccggcgggttcaagctcttcggcaaggtcatcacgcagtgcgccgagagcgcgccgccggtgccggtaccggtgccggcgcagccgcgggagccgccggcgaggggcgcgcgggagagggacgacccggacgagcgggaccagccgatggtcaagcgggaggcggcggaccacgactccgccgacaagcagcagcactccggcggcggcggggagagcaaagggctgcagccgcgcccgcggcagccgccgcaccaggacacagcggaggcgcgcgcgggcgcggccgcctcgtcggcgccgcggctgccgtgcccgcgctgccggagccgcaacaccaagttctgctacttc

SEQ ID NO: 35796 - protein, 121 aa, Panicum virgatum
  misc_feature: Ceres CLONE 1963235
  misc_feature: The sequence is a functional homolog of SEQ ID NO 1122 in the 10/374,780 US patent application
  misc_feature: The sequence is a functional homolog of SEQ ID NO 1145 in the 10/666,642 US patent application
  misc_feature: The sequence is a functional homolog of SEQ ID NO 1322 in the 10/412,699 US patent application
MAPAAGGFKLFGKVITQCAESAPPVPVPVPAQPREPPARGARERDDPDERDQPMVKREAADHDSADKQQHSGGGGESKGLQPRPRQPPHQDTAEARAGAAASSAPRLPCPRCRSRNTKFCY

SEQ ID NO: 35797 - DNA, 386 bp, Panicum virgatum
  misc_feature: Ceres CLONE 1963238
  misc_feature: Encodes the peptide sequence at SEQ ID NO. 35798
acggaactatcccgaaactaacgggccgcgacgacgaggaaacgggatctatgagtgagcagctggggcgcgagtaccagatcggcgaggagatcgggcgcggccgcttcggcgtggtccgccgctgcgcctcccgcgccacgggagagcccttcgccgtcaaggccgtcgaccgctccgcgctcgccgacgacctcgaccgcgcgctggcggggctggagcccatgctggcgcggctggcggccgccgggggcgcccacccggtcgtcgtgcacgtgctcgccgtgttcgacgactacgcctggacccacaccgtcatggacatctgcgtcctgccctccttgctggactccggcctccactagtccgtcgcgtccgcgcaggcc

SEQ ID NO: 35798 - protein, 104 aa, Panicum virgatum
  misc_feature: Ceres CLONE 1963238
  misc_feature (8)..(40): SWISSPROT Homolog: EC 2.7.11.1 Non-specific serine/threonine protein kinase
  misc_feature (2)..(38): SWISSPROT Homolog: EC 2.7.11.19 Phosphorylase kinase
MSEQLGREYQIGEEIGRGRFGVVRRCASRATGEPFAVKAVDRSALADDLDRALAGLEPMLARLAAAGGAHPVVVHVLAVFDDYAWTHTVMDICVLPSLLDSGLH

SEQ ID NO: 35799 - DNA, 1051 bp, Panicum virgatum
  misc_feature: Ceres CLONE 1963248
  misc_feature: Encodes the peptide sequence at SEQ ID NO. 35800
aggcgagtttattgtgtctttagcagcgcggcaaatggcttccctcaaccgatgccttgcctctttggcaaggcttagcctcacaacgcctgccaggccaacgacagccccgttaataccgaaattcctcctcccgacgacgacagttcccttggttcgatatgcatccggtggaggaggaggcatgcgcaagcgccctccaaagaagaagaagacatacaaaactttccggtcgtacgacctgtctccgatggagcagttttccctctgcgatgctatgcgctacctccgcgccttcgaagtcggccggccgcccgctgttattaaatacgagcttcatatcaagcttaaaacacacaaaagcggccccgttattcggaaccgaattcgtcttcctttccctgtcaaaaccgacacgcgcatcggcgttatctgtcccgaggacagccccttgatgaccgaggcgcagcagcttggtgccgtagcagtgggagaggaaagcctttttgagagcatccggcaaggcaacattccattcaacaagcttatctgccacgaggacagccaagacgcattgaagaaagccaacctcggcaaaatcctcggtcccaggggtctgatgcccagccaaaagaccaagactattacgaccgacctcaagtctacagttcaggaactcataggcgcggacgagtacagggaacgcagcggtgtggtgaggttggcagtgggccagatgggatttaccccccaaatgctgtccgataacatcaaggcgctcctgtccctgttgaaggcggacatcaacgatgtggatgacagctacacaaaggcacttgacgaggttgtactcagctccactaacggcccaggtttcagcctgaacggcacgttcaagtcggacgacgagggcgtaaagccggaggacctgcagtccgtgatgtaacctttttgtatcatagatgtatgtcgtgtaccattatttcatgaagcaaaccgcgtcgcgcggttgggtatctaacgcgaattgggagtgcggcgctgggtcatt

SEQ ID NO: 35800 - protein, 253 aa, Panicum virgatum
  misc_feature: Ceres CLONE 1963248
  misc_feature (20)..(230): Pfam Name: Ribosomal_L1 Pfam Description: Ribosomal protein L1p/L10e family
MRKRPPKKKKTYKTFRSYDLSPMEQFSLCDAMRYLRAFEVGRPPAVIKYELHIKLKTHKSGPVIRNRIRLPFPVKTDTRIGVICPEDSPLMTEAQQLGAVAVGEESLFESIRQGNIPFNKLICHEDSQDALKKANLGKILGPRGLMPSQKTKTITTDLKSTVQELIGADEYRERSGVVRLAVGQMGFTPQMLSDNIKALLSLLKADINDVDDSYTKALDEVVLSSTNGPGFSLNGTFKSDDEGVKPEDLQSVM

SEQ ID NO: 35801 - DNA, 669 bp, Panicum virgatum
  misc_feature: Ceres CLONE 1963266
  misc_feature: Encodes the peptide sequence at SEQ ID NO. 35802
agcggataaggctcgctccagaaccccccatggcggccttggcgccgctgacgtcgccggctccgtgccggccctccgccctcgccgcgcgtctgccggcggctcggtcgctgccgctccgctgctcgccgccagccctgggcctcaggcgtcggaccgggcattctcggcggggttcagccgcgctccgggtggaagctaagaagcaaacattctcttcatttgatgagttgctggagaagtctgagaagcctttactagttgacttctatgcaacttggtgtggcccatgccaatacatggttcccatacttcaagaagtgagtgaaaagttaagcgacaaggttcaagttgtgaaaattgatactgagaagtacgcagccattgcaagtcgttacagaattgaagcattgccaacttttatcatcttcaagaacaagaaaccttgctatcgttttgagggagcgttgcctgctaaccagatgattgaacaaattgagagtgctttggctgtctcagagtaacacacatggtgagcagagcagaaaagttttctgaaaaatatgtgctgctactgctaccccgtaacatgtgcctctgcatgttaatgcttcattattgttcaaaacattctcaattttttctatatcattacagtctgaaactaag

SEQ ID NO: 35802 - protein, 164 aa, Panicum virgatum
  misc_feature: Ceres CLONE 1963266
  misc_feature (56)..(159): Pfam Name: Thioredoxin Pfam Description: Thioredoxin
  misc_feature: SWISSPROT Homolog: EC 1.8.1.8 Protein-disulfide reductase
MAALAPLTSPAPCRPSALAARLPAARSLPLRCSPPALGLRRRTGHSRRGSAALRVEAKKQTFSSFDELLEKSEKPLLVDFYATWCGPCQYMVPILQEVSEKLSDKVQVVKIDTEKYAAIASRYRIEALPTFIIFKNKKPCYRFEGALPANQMIEQIESALAVSE

SEQ ID NO: 35803 - DNA, 571 bp, Panicum virgatum
  misc_feature: Ceres CLONE 1963277
  misc_feature: Encodes the peptide sequence at SEQ ID NO. 35804
ctctctctctctctctctctctctctctctccctcatcatcgtcgccacctccatccccttcggcctccgatccctccacgagtcgagcggaggatccgcggcggcggtggtggcggcgggcggtggtcggccggcgatggcgcaccgggtggataacgagtacgactacctcttcaagatcgtgctcatcggcgactccggcgtcggcaagtccaacatcctctcccggttcacccgcaacgagttctgcctcgagtccaagtccaccatcggcgtcgagttcgccacccgcaccctccagatagaaggaaagaccatcaaagctcagatatgggatactgctgggcaagagaggtaccgtgcaatcactagtgcttactacagaggagctgtgggtgcacttttagtctacgacatcacaaagaagcagacatttgaaaatatccagaggtggcttcgtgagctccgtgatcatgcggactccaacattgtgatcatgatggttggtaacaaatcggatctgaaccacctgagatcagttccagagggagatggccaggcatttgcgga

SEQ ID NO: 35804 - protein, 144 aa, Panicum virgatum
  misc_feature: Ceres CLONE 1963277
  misc_feature (14)..(144): Pfam Name: Ras Pfam Description: Ras family
  misc_feature (14)..(128): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50223
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
  misc_feature: Functional homolog of the protein sequence given in SEQ ID NO 50522
  misc_feature: Useful for making plants with modulated oxidative stress sensitivity
MAHRVDNEYDYLFKIVLIGDSGVGKSNILSRFTRNEFCLESKSTIGVEFATRTLQIEGKTIKAQIWDTAGQERYRAITSAYYRGAVGALLVYDITKKQTFENIQRWLRELRDHADSNIVIMMVGNKSDLNHLRSVPEGDGQAFA

SEQ ID NO: 35805 - DNA, 522 bp, Panicum virgatum
  misc_feature: Ceres CLONE 1963285
  misc_feature: Encodes the peptide sequence at SEQ ID NO. 35806
accaccgcatctcacaccccctgagctcagctccaagcagagtcttctccacctcctgtggttagagcgagaggccagaccggcggcctcgccaccggcaccttcggcctgaccggcatctccgtgtgggaggccctggtcctggagatcgtgatgaccttcgggctggtgtacacggtgtacgcgacggccgtggacccgaagaagggcagcctgggcaccatcgcccccatcgccatcggcttcatcgtgggcgccaacatcctggtcggcggcgccttcgacggcgcgtcgatgaaccccgccgtgtccttcggccccgccctcgtgagctggtcctggacccaccagtgggtgtactgggtcggccccctcatcggcggcggcctcgccggcgtcatctacgaggtgctcttcatctcccacacccacgagcagctccccaccaccgactactgagctgagggctgaggcttcggtagccgcccccgccgccgccaccgaagacgttcgcgcgcagcc

SEQ ID NO: 35806 - protein, 101 aa, Panicum virgatum
  misc_feature: Ceres CLONE 1963285
  misc_feature (1)..(84): Pfam Name: MIP Pfam Description: Major intrinsic protein
MTFGLVYTVYATAVDPKKGSLGTIAPIAIGFIVGANILVGGAFDGASMNPAVSFGPALVSWSWTHQWVYWVGPLIGGGLAGVIYEVLFISHTHEQLPTTDY

SEQ ID NO: 35807 - DNA, 544 bp, Panicum virgatum
  misc_feature: Ceres CLONE 1963325
  misc_feature: Encodes the peptide sequence at SEQ ID NO. 35808
ctcatcacaagcgaagcagagcacacaggaagcactccaccttcttcagccgcgctacctgctttccttcctgcttgctcgtgatcaccgagatcaggatgtctggttgcagcggcggcaactgcgggtgcggctccgcctgcaactgcggcggcggatgcaacggctgcaagatgttccctgacgtggaggccgcctccaccaccaccaccaccatggtcatcgctgccgccagcaacaaggcgagctccggcgggttcgaggcggccaccgagagcggcggctgcgactgcaacacctgctgtagctgcaactgaggcggccatgcgccgccgccatggaagcacgaggagaaagccccccggcgtagtatataggagcagcgtctaaataagatcttgccaactgcgccatccatcatctaccgtgtcgtgtcgtgacatccatggtcgcctgccgtgtctcagctggggttgttgtctgaacgtctctggtgatcgacgacgcatgccggtcgtcgatctttagcttgtgtgtccgtccc

SEQ ID NO: 35808 - protein, 72 aa, Panicum virgatum
  misc_feature: Ceres CLONE 1963325
  misc_feature (1)..(71): Pfam Name: Metallothio_2 Pfam Description: Metallothionein
MSGCSGGNCGCGSACNCGGGCNGCKMFPDVEAASTTTTTMVIAAASNKASSGGFEAATESGGCDCNTCCSCN

SEQ ID NO: 35809 - DNA, 755 bp, Panicum virgatum
  misc_feature: Ceres CLONE 1963355
  misc_feature: Encodes the peptide sequence at SEQ ID NO. 35810
gggcgcaatgcgcaaaactccacccaccccgaggtccccgccgcaaaaaaaccacgcgtgcccgctccctctcgccgccggccggcgccgcctcactctcactacactccaccgcgggccaagcactccgcccctcccccactgccccgccccaatgcgacggcggcccccgccgccgccgccgccgactcgacccatggccgcacaaatcctaccactgaagctgctcttgctgctgctgccgctgctcggagacgccacctcggtttccggcagcggcgagcgcgaggcgttgatgaagttcaaggcggctgtgacggccgacccgggcgggctgctgcgcgactggaccccggcctccgcagaccactgccgctggccgggtgtgtcgtgcggcgccggcggggaggtggtcgcgctcaacatctcctccgcgccaggtcgcgcgctcgcgggcgagctgtccccggccgtcgcggcgctgcgggcgctccgcgtgctcgcgctcccgtcccacgcgctctcgggacagctcccaccggcgatctggtccctgcgccgcctccgcgtgctcgacctctccggcaaccgcctccagggcggaatccccgcggcgctggcctgtgtcgggctccagacgctggacctcgcctacaaccaactcaacggctccgtgcccgcggccctcgtcgcgcttcctgggctgcggcgcctgtcacttgcctccaacagattcggcggcgccatccctgacg

SEQ ID NO: 35810 - protein, 186 aa, Panicum virgatum
  misc_feature: Ceres CLONE 1963355
  misc_feature (26)..(67): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAQILPLKLLLLLLPLLGDATSVSGSGEREALMKFKAAVTADPGGLLRDWTPASADHCRWPGVSCGAGGEVVALNISSAPGRALAGELSPAVAALRALRVLALPSHALSGQLPPAIWSLRRLRVLDLSGNRLQGGIPAALACVGLQTLDLAYNQLNGSVPAALVALPGLRRLSLASNRFGGAIPD

SEQ ID NO: 35811 - DNA, 675 bp, Panicum virgatum
  misc_feature: Ceres CLONE 1963365-R
  misc_feature: Encodes the peptide sequence at SEQ ID NO. 35812
tcaagatacggggaagtatgtctttggtgttgatgacacattgaaggctcttgaaatgggtgctgtggagacgctgatagtgtgggaaaaccttgatatcaacagatatgtgcttaagaacagtgtgactggagaaattattatcaaacatctgaacaaagagcaagaagctgaccagagccagttccgtgatctatctaccaatgctgagttggaggttcaggataaaacctcgctcttggaatggtttgctaacgagtacaaagagtttgggtgcacacttgagtttgttaccaacaaatctcaagagggttcattgttttgcagaggatttggtggcatcggtggcatgttgcgctatcaactggatatccgctcttttgatgagatttctgatgacgagggggtatatgaggactctgattaagcaatcaatccgtgacatgcttgtgctggaccttggaaggatgcaattgctatagacctatagtgttctaaattttgcttcagtgttgtagttttgaacactacttcagaagatgcatgttttgtttcctctgcagcagcagcagcttacaattgcattgtgaaccacatcctatcaatcagttgatacctactgtcctgttgtgttgtagacaatttgtgactttgatttaaggtttgacttttagc

SEQ ID NO: 35812 - protein, 141 aa, Panicum virgatum
  misc_feature: Ceres CLONE 1963365-R
  misc_feature (1)..(122): Pfam Name: eRF1_3 Pfam Description: eRF1 domain 3
QDTGKYVFGVDDTLKALEMGAVETLIVWENLDINRYVLKNSVTGEIIIKHLNKEQEADQSQFRDLSTNAELEVQDKTSLLEWFANEYKEFGCTLEFVTNKSQEGSLFCRGFGGIGGMLRYQLDIRSFDEISDDEGVYEDSD

SEQ ID NO: 35813 - DNA, 1444 bp, Panicum virgatum
  misc_feature: Ceres CLONE 1963365
cataacttttccttagtatttggagaaatatgtagggccacgtgctggacacattattccttaaccgagcatatggagatgttttaaagcactatatataggttctaacttgaattgtgcctttgttttctttcctgtttagtgttgcattcggtactagcgtactgccaagtatgaatctggcgaactgtgcagctggttcgcagatgttcgtctgtagtgtttcccctgcctaatctagtgcaggctgccttttcctgcatatctgttactccgctgtgtttctggtttgtcatattacatgcttcatcagatgtgaatttggatctgtactgtactggtatattgcatatgcaaatgatcttgtttgggccgagtgcagttttggtatgattactgcagtatcggtttcgttcctccactgagcagagatggtgcaccatttcttttcatggactctattaggccagtactgttggtgaaaaggagtgttctgcgcgtttgatcgcaagatggtgatctgtaatttttgtcaaggatgaccacttggcatgtggtatgtcggagctttggacctaggcactcggagaagttcacactctaattgcgttggcatgtagtaacagtgagactaggcaggattctttgtgacggcttgccggacctccaccgtcggcgtcgggcgggcaggcggccaaacggaggagagtaccaaatcctctgcttcccgttccccaccccgctgggcgctggcggcggcgccgcgagccgaggcgaggcgaggcgaggcgacgaatcaatcggcgcctccccgctgcccaggctctccaccggaagcacgcgaacccaccgctcttcgctgtgtcgtcggtgagagaagctgcatacttccttgttggattgaccgctcgtttgtgccccaggatctagtccttgctatgagctgagctgagctcttgaatccaaatcccctgtcctggggtggacgctccaggcgtttcagtgtagctaccataattatttggcctgcaaacgagaatgacattaatgctagtagcggcaaggctctgtttagcttgcttttcactgtgttttctcatctccatccaacttcttctgtttgcgtatgggatactactcttgagaaagcaacatcaacagagcccagaattatttgtttttagatggctgcatagagcatacaattcctcgttatcttgataagttgatgctgcttgcatatgtggttcatttgtcaatattatgtagttatacgtccatgtaaccacaatcatactgtgtaccaaagttgatgaagattatatgttgatattggattaagttttgaggtatagctattgctttgctactgtaacatgttcgcatcagtgcttcgatgatatttgattacaatgttagtttttgggagagtatgactcaatcc

SEQ ID NO: 35814 - DNA, 657 bp, Panicum virgatum
  misc_feature: Ceres CLONE 1963404-R
  misc_feature: Encodes the peptide sequence at SEQ ID NO. 35815
agaaggacgaagaggagcagcccgccggcgggtactcggaggccgtggccgccgaggtggtggccgccggcgagagcgagtacgagaggtacaagaaggaggagaaggagcacaagcacaagaagcacctcggcgaggccggcgccgtcgccgccggtgccttcgcgctctacgagaagcacgaggcgaagaaggacccggagcacgcgcaccggcacaagatcacggaggagatcgccgccacggcggccgtcggcgccggcggctacgccttccacgagcaccacgagaagaagaaggaccacaaggacgccgaggaggccagcggcgagaagaagcaccaccacctcttcggctgacccgccggcgagcgagctccggcccggccgccgcgcacccgcctgcttgctccaataattgtggccatgatttcgcaataagtcccttccggacccttagcttgtttgcttgtgtgagactgagaggtggggcccgcgcgtcgaggtgtgttccggcctgtacgtgcttgatttttctttgcgtccgtaattgcgttgaataaccgggagcgatgcacgtgtggctcccagtctgtctgtctgtggttgagtgtctgtatcctgatgatcaactcgtggaagtttttacacccgtttc

SEQ ID NO: 35815 - protein, 118 aa, Panicum virgatum
  misc_feature: Ceres CLONE 1963404-R
  misc_feature (28)..(107): Pfam Name: ABA_WDS Pfam Description: ABA/WDS induced protein
KDEEEQPAGGYSEAVAAEVVAAGESEYERYKKEEKEHKHKKHLGEAGAVAAGAFALYEKHEAKKDPEHAHRHKITEEIAATAAVGAGGYAFHEHHEKKKDHKDAEEASGEKKHHHLFG

SEQ ID NO: 35816 - DNA, 573 bp, Panicum virgatum
  misc_feature: Ceres CLONE 1963404
atacacagcaatccaccatggccgagcaggcagagagcaacgagagcgagcagctgaagcagctgcaggagcaagtgcaggacctgtgcgatgccatcgagaaagaggtcgacagcaaccttcccggcagggacgatctggagaaaatctgcgaagtcctcaaagagatcaagggcaagatcacaccaccggtccttctccccctgagcaagagggaggagctgggcaacctgcttcccaccatcaggtacgcattggagcagcgcaggcagccacggcgagatcatcctgccgacatgtcgtcgaccgggtgctacccctgcaagccccggccgtcgtcgcagctgcagaggcagagccagcagcaggaacacgacgagggcgccgccgtgtcgctgaagctgttgcaccggctgacccagaacgtgctggagccggagcagtactacgagtggacgacgagctacgtggacgagagcaggatctacggctgggacaaggaggccaacgaggtggcggaggcgctggtcgcccccgagggcggcgagaagaacctgttccgggcggcgggca

SEQ ID NO: 35817 - DNA, 398 bp, Panicum virgatum
  misc_feature: Ceres CLONE 1963414
  misc_feature: Encodes the peptide sequence at SEQ ID NO. 35818
atccgagaaaaacacaagcttcagttttggcataaagagctcgtcaggcctccgcattcattccacctaggagctgaacctgcaaatggcggcgactctgaagctgaggatcctcgccgtggctgcgaccgccgccgtcgtcgcgtcgtcgctggtcgccacggcctctgcacaggccgcggaaccagcgcccgccccgacgtccgacgcgtccatggccgcgccggcagtggccgcagcgtctctgactgcgcttgtctttggctacctcttctagttgatttgtggttctgctcagttttttattccccttctctctttctctccgttctttggttggtgtgtgtatgattatgtaattaaaggtttatttttatataaatgttgtgatcagcaca

SEQ ID NO: 35818 - protein, 63 aa, Panicum virgatum
  misc_feature: Ceres CLONE 1963414
  misc_feature: Functional homolog of the protein sequence given in SEQ ID NO 50452
  misc_feature: Useful for making plants with altered carbohydrate content
  misc_feature: Functional homolog of the protein sequence given in SEQ ID NO 50546
  misc_feature: Useful for making plants with altered cell wall content and/or composition
MAATLKLRILAVAATAAVVASSLVATASAQAAEPAPAPTSDASMAAPAVAAASLTALVFGYLF

SEQ ID NO: 35819 - DNA, 1506 bp, Panicum virgatum
  misc_feature: Ceres CLONE 1963416
  misc_feature: Encodes the peptide sequence at SEQ ID NO. 35820
agccatctgaaccaccatcttcttcgccgagtcagtcttggttctccaactccaccagcaaaaccaagccaccagactcatggccggcttcattagttcttggccatgacgacctcacgttgaagcaaaaagccctcctggtgatcctctcttcaccaccatcacctccgtcgagcagtagctgtgactgcagacgacgatcgtgtcgacgccagatcagtccacctccaaggctccaactcgccggcctcagtacatcatcagtatcatcggtataaacaagcgaagaaacagcaaaacttcatcatgggactttagcatctgtctttttcccctgacgggagatcactgttgtaactaaaaaaaaggatttaaattcagctgacgggatagcactaccaaagagctcaagaggggattaccaaagagctagtcaagaaaccaaacctggctattcatggcgggggtcttggatgctttggcatcctatgtccaaaacatgcttattgagatggcaagggatgaggtgcatgtgctgcttggggtctctggagagattgaaaaaatagacatcaagctcaaggacctcaagaacttccttgtggatgctgataggaggagcatcaccgaccagagtgtgcaggcatgggtactggagcttagagaggccatgtatgatgccaccaacatcctcgacatctgtcagctcaaggccatggagcggggtccaagccatgatgctgggtgcttcaacccactgctgttctgcttgcggaatcccattcatgcccacaagatcggcagccgcatcaagaaccttaatcagaggttagaagatatcaagaaacgtagcttggacttcaacttcatcaacctaaattcatatgaggaccgtagtaggagggtggcatcgtctcgtcttggtagccgtgagacatctggtgagcttgatgagtcaagtttggttggtgagaatattgaggaggacacaagaaatttggtggagatgctaacagcaaaggatctatcaaatcgtgagaacaacaaaattctggttttcgctatcgtgggagttggagggatcggtaaaacaaccttggccaagaagatctttaatcacgacatcatccaacaagaatttgcacagaaaatatggttgagcatgaaccaggatgtcaatgagactgagctgctgagaagagctatcattgaagctgggggtgaccaccaatctgttggaaatacgaggggcgcgcttgagcgagctcttaaggaagccttgaatgggcaaaagatcttattggtgatggatgatgtttggaagcatgaagtatgggaggatgtgctccaaactcccttggttagtgctgccctagctcatggtagccgtgtcctcatcaccacaagacatgacatggtcgcaagagggataatggcaacaaaaccctaccactatgtcaataaacttgatcccgaagatgcgtggttgttactcaaaaagaaggt

SEQ ID NO: 35820 - protein, 349 aa, Panicum virgatum
  misc_feature: Ceres CLONE 1963416
  misc_feature (153)..(349): Pfam Name: NB-ARC Pfam Description: NB-ARC domain
MAGVLDALASYVQNMLIEMARDEVHVLLGVSGEIEKIDIKLKDLKNFLVDADRRSITDQSVQAWVLELREAMYDATNILDICQLKAMERGPSHDAGCFNPLLFCLRNPIHAHKIGSRIKNLNQRLEDIKKRSLDFNFINLNSYEDRSRRVASSRLGSRETSGELDESSLVGENIEEDTRNLVEMLTAKDLSNRENNKILVFAIVGVGGIGKTTLAKKIFNHDIIQQEFAQKIWLSMNQDVNETELLRRAIIEAGGDHQSVGNTRGALERALKEALNGQKILLVMDDVWKHEVWEDVLQTPLVSAALAHGSRVLITTRHDMVARGIMATKPYHYVNKLDPEDAWLLLKKK

SEQ ID NO: 35821 - DNA, 682 bp, Panicum virgatum
  misc_feature: Ceres CLONE 1963416-R
cctgcactacatagactcggcctggaggattatgaaatggaaacagtcccaagatacctgcaagatgtaacgccaaggcacttgctgctagactgcagcttaccgctacttacttccatagctgcagggaaaactagccgtgagtgggacaagttcaaacatatccagcatgtcaaggcatatgcagacgatgagggtgttcagagaaaatggtacgtgctacacacaggacatcctttccgcttcgagaccaatttcagccgctccgccattatccaagcccgcaacgagcccaagtgtcttgcttacacaatcacatgcactattgaagatgagtggccggtaggacgacgtgcatctaccaacaaacgtcagcccctgtggctacgcttcaggtgcaatgcttatcgctatttaattctctggttgcgtcgagagtgcccgcactgcaatgaggcagaccgcatcgccccctcatcaaaccaatggaccgaagcagtggtgtattcagcgtgcacaaaacttgtaggaggcagatatagtagacagtagcgacaaaattgtcaaagtgccttcttgtactctgcatttgggctagcattaagttaaggatggatctaaacatccgaattcttagaacaaatttgatattttaaaatagatatgcttaaaattttatgct

SEQ ID NO: 35822 - DNA, 1279 bp, Panicum virgatum
  misc_feature: Ceres CLONE 1963431
  misc_feature: Encodes the peptide sequence at SEQ ID NO. 35823
cgtagagtctttttttttttttttgggaactccgactccggagagtcgagtctcgactcccgactcccaagcaagtctcccctcccgatctaaacccgtcgaaaccctaatccccatcgccgccgccatggtgagccccatcctgaccctccccgcgccggagggcaacggaggcgcggtcggtgacgccgacaagcagcagcagacggcgccttccacgccccctcccggcgcgaaggcggacccgccggcgacggtggccacccacacgcgcaccatcggaatcatccaccctccgcccgacatccgcgccatcgtcgagaagaccgccgtcttcgtcgccaagaacgggcccgagttcgagcgccgcatcatctccctcaaccagggcaacgccaagttcaacttcctccagccctccgacccctaccacgcctactaccagcaccgcgtctccgagatcgctgcggcgccgcccggctccgacgcccccgcgggcgccgagcccgacggaggcccccccgccgcgccagcggcggccccggcggacggcgccgccgcacctgctgatggcgctgcggcggcggcagatgcgaagcccgaccactccgcgcccttccgcgtggcaccgcctgccaaggtgctggtgccgcccaaggcggagctgtacacggtgcggctgcccgagggcatcacaggggaggagctggacatcatcaagctgacagcgcagttcgtggcccggaacgggaagaacttcctgacgagcctggcacagcgtgagagcaacaacgtgcagttccattttatccggcccacgcacagcatgttcccattcttcacatcactaacggatgcatactcgagtgtgctgaggccggaagagggggtgccggcactgttaaaggagttgagggaggggtcgaaggatctgactacggtgctggagagatgcctgaatcggttggagtgggatcggtcgcaggagcaggcaaggcagcaggcggaggataagattgagcaggaaaggatgcagatgtcaatgatcgactggcatgattttgttgttgttgagacaattgaatttgcagaggatgagtatgaggggcttcctgtgccacctactctggaagagttgaaacgccggaagaggatgcagaatttgggagaggacgaagcgatggaaatggctgaaccagctaaggaggttgagatggaaatggatgaagacgagatgcaacttgttgaggaaggaatgcgggcagcacagcttgaggag

SEQ ID NO: 35823 - protein, 383 aa, Panicum virgatum
  misc_feature: Ceres CLONE 1963431
  misc_feature (64)..(108): Pfam Name: Surp Pfam Description: Surp module
  misc_feature (197)..(241): Pfam Name: Surp Pfam Description: Surp module
MVSPILTLPAPEGNGGAVGDADKQQQTAPSTPPPGAKADPPATVATHTRTIGIIHPPPDIRAIVEKTAVFVAKNGPEFERRIISLNQGNAKFNFLQPSDPYHAYYQHRVSEIAAAPPGSDAPAGAEPDGGPPAAPAAAPADGAAAPADGAAAAADAKPDHSAPFRVAPPAKVLVPPKAELYTVRLPEGITGEELDIIKLTAQFVARNGKNFLTSLAQRESNNVQFHFIRPTHSMFPFFTSLTDAYSSVLRPEEGVPALLKELREGSKDLTTVLERCLNRLEWDRSQEQARQQAEDKIEQERMQMSMIDWHDFVVVETIEFAEDEYEGLPVPPTLEELKRRKRMQNLGEDEAMEMAEPAKEVEMEMDEDEMQLVEEGMRAAQLE

SEQ ID NO: 35824 - DNA, 726 bp, Panicum virgatum
  misc_feature: Ceres CLONE 1963431-R
  misc_feature: Encodes the peptide sequence at SEQ ID NO. 35825
acccatggtcaatcctatggaatccctcagcctccagcaccgcctctgcctccacagcctcctgccgaagagcagccacctccacctgatgaaccagaaccaaagaggttgagagcagatgatgcttctcttatcccggcagagcagttcctcactcagcatccgggtcctgctagcatctcagtatctgtacccaaccttgatgaaggaaatctgcgtggccaagttttggagattcgtgtccaatcactgtcagacacagttggtagtctgaaggagcagattgctggagagttgcagctccctgctaataagcagaagttgagtgtgaggactagtttcctcaaagacaacctttctcttgcttactacaatgtgggtcctggagtggtgatcaatctaacactgagggagcgtggtgggagaaagaaatgaagcattttcaacctcagctcagtgtcaggttaatgcgtagaaccattgttcagagctatcatggagaacctttttactggatcttgctgcggtatttttcatattattttcttgagcacaatctttggcgttatctgaacgctattctttcctcttataacaatggtgtgaggttctgccttgatgtagcttgtagtatgttactggaggtttgctactggataccttggccagctggccacttaaactctgtatcacatgtcttctttagcttcttctggttggtcttag

SEQ ID NO: 35825 - protein, 144 aa, Panicum virgatum
  misc_feature: Ceres CLONE 1963431-R
  misc_feature (70)..(139): Pfam Name: ubiquitin Pfam Description: Ubiquitin family
THGQSYGIPQPPAPPLPPQPPAEEQPPPPDEPEPKRLRADDASLIPAEQFLTQHPGPASISVSVPNLDEGNLRGQVLEIRVQSLSDTVGSLKEQIAGELQLPANKQKLSVRTSFLKDNLSLAYYNVGPGVVINLTLRERGGRKK

SEQ ID NO: 35826 - DNA, 1372 bp, Panicum virgatum
  misc_feature: Ceres CLONE 1963451
  misc_feature: Encodes the peptide sequence at SEQ ID NO. 35827
aaaaggccaccaaagcccgggacaggtaggcaaacgtgcccccagctaccaccatggcatcctctcctcctcctcgccgggaagaggaaggagaagaagaggagcgccggcatgacgacgacgaggacgacgaccggatcacctcccctcttttgccgccggaagcgtcggcgtcgcgcagctcgccggtggatgatgacgacgaggaggaggagaactcgccgatcgaggaggtggcgctgacggtgccggtgggcgacgacccggagacgccggtgctgacgttccggatgtgggtgctgggcacggcgtcgtgcgcgcttctctccttcctcaaccagttcttctggtaccgcaaggagcctctcaccatcacggccatctcggcgcagatcgccgtggtgccgctgggccgcctcatggcggcggcgctcccggaccgggccttcctccggggcacgcgctgggagttctccctcaacccggggcccttcaacgtcaaggagcacgtgctcatcaccatcttcgccaactccggcgccggcaccgtctacgccatccacgtcatcaccgccgtccgcgtcttctacggcaagcacatcaccttcttcgtctccctcctcgtcgtcctcaccacccaggtgctggggttcggttgggcgggaatattccggcggtatctggtggagccggcggtgatgtggtggccgtccaacctcgtgcaggtctcactgttcagggcgctccatgagaaagaacagcgggttaaaggcagcttgacgcgcaaccagttcttcctggtggcattcatctgcagcttcgcctactatatcttcccgggttacctgttcctgatgctcacctccctctcctgggtctgctgggtcttcccccactctgtgttcgcccagcagctcggctccggtctgcagggccttggcattggagcgatcggtcttgactggtccacagtctcctcctacctcgggagccctctcgccagcccctggttcgccactgcgaatgttgcagcagggttcttcatcatcatgtacataatcacacccattgcttactggttcaacttctacaaagcgcaaaacttccccatcttttctgatggcctcttcaccttgtccgggcaaaagtacaacatatctagcatcgtggattcccatttccatttcgacacaaaagcgtacgagaagaatggcccactgtacctcagcactttctttgctgtcacatatggtgttggtttcgcatcccttaccgcgacaattgttcatgttttcctcttccatggaagtgaaatttggcagttaagtaaatcagcttttcaagacaaaaaggtggacatacatacaaagct

SEQ ID NO: 35827 - protein, 439 aa, Panicum virgatum
  misc_feature: Ceres CLONE 1963451
  misc_feature (75)..(438): Pfam Name: OPT Pfam Description: OPT oligopeptide transporter protein
MASSPPPRREEEGEEEERRHDDDEDDDRITSPLLPPEASASRSSPVDDDDEEEENSPIEEVALTVPVGDDPETPVLTFRMWVLGTASCALLSFLNQFFWYRKEPLTITAISAQIAVVPLGRLMAAALPDRAFLRGTRWEFSLNPGPFNVKEHVLITIFANSGAGTVYAIHVITAVRVFYGKHITFFVSLLVVLTTQVLGFGWAGIFRRYLVEPAVMWWPSNLVQVSLFRALHEKEQRVKGSLTRNQFFLVAFICSFAYYIFPGYLFLMLTSLSWVCWVFPHSVFAQQLGSGLQGLGIGAIGLDWSTVSSYLGSPLASPWFATANVAAGFFIIMYIITPIAYWFNFYKAQNFPIFSDGLFTLSGQKYNISSIVDSHFHFDTKAYEKNGPLYLSTFFAVTYGVGFASLTATIVHVFLFHGSEIWQLSKSAFQDKKVDIHTK

SEQ ID NO: 35828 - DNA, 635 bp, Panicum virgatum
  misc_feature: Ceres CLONE 1963451-R
atgatgcatcagttatatggggccttattagcccacgcagaatattcggcgacctaggcacttactcggctgtgaactggttcttcttgggtggagctattgctcctctactagtatggcttgcacacaaggcattcccaggccagagctggatcttactcatcaacatgcccgtgctgatcggtgccactggccagatgccacctgctactgcagtcaactacaccacatggatacttgttgggtttttgtcaggttatgtggtttacagatatcggcgtgactggtgggagcgacacaattatctgctttctggtgcactagatgctggtttggcgttcatggccgtcctgatatacttatgcctaggcttggagaacatcagtttgaactggtggggcaacaatttagacggatgtcctcttgcttcttgtccaactgctaaaggtattgttgttgagggctgcccagtgtatacatgagaactcatggtgtgacctggagagaagaaaacagggatcgatgtaaataattaaactttattttcaaacaatttagagatgagaacttggtgtaatttttattgaattctggaagattcaaataatattaaaggaaaatgggtagttatcgcc

SEQ ID NO: 35829 - DNA, 1393 bp, Panicum virgatum
  misc_feature: Ceres CLONE 1963454
  misc_feature: Encodes the peptide sequence at SEQ ID NO. 35830
agatagatctgcgctgtgcgtgtcgagcccgtccctgtctcgccgtctcctttctcctctcctctccactctccaccgagcagcgcgaatccttagcggccaaggctttccgagctcagctcggggagttttaaacgctgcccgaggaaaggaggaccgcactcgctgctggtcgcttgctttcggtggcgagcgtctcggtaaagcggcggctgcggcagagattggacttgctcgttgcgcagtgcagtgctgccgtggagacgggaatctgccgcaggctgtaatcttcagggactcataattgatcgttatttccaaagatcagagtaacgtgcccgactttgtcgccttcatcctctggggtcgctcggcagctgatgccctcgttgggggattgttgaagggataaggtcgtggcaatgagcaagccggcgcgcgtgcagcgcgcgtccccgccgcccctggttgcttcggctgccatcttgctgctattctccgcgttaccgcgctgtcagccatacacttacgagcaagatgtgtttgcgataaatggcttgtacacggcgcttggagcaccgcagctgccaaattggactacaaatggcggtgacccctgcaatgagggctggcagggtgtttcatgcgtggcctcaaatattacctccataattctcagcagtgcaaacttgggtggacagctgggtaacactttggggaatttcacatcattaatcaccttggatcttagcaacaataatattggcggaactatacccgatggtctaccagtcacaatgcagaaatttttcctttcagctaaccagctaagtggtagcctcccaagtacattgtcatcccttacacttttgacaagcatgtcactcaataacaaccaattatctggagatattccagatgtatttttagcactcactgggctcgcgaatttagatttttcttctaacaacttaaccggtccgctgccaccttcaatgggaaatttgacagcattgactagcctgcatattcagaacaatcaactaacaggaacccttgatgtgctgcaagatcttcctttccaagatttgaatgtagaaaacaatcttttgtctggtcccgtgcctgtgaagttactcaacttgccaaactttaagaaggatgggaacccattcaataccagcatagccccatccgctcagcctcctgcagcgccaacaccattaccgtcagtctcacctccagctaggcatgtcccctcaaaagaaccttcaacctcttctagtgttcagggaggaagtactccaggatcaggaaaacatactgtttccacaatcaaattagttggatatatccttatcggggtggtatcagcagtagttattgtgctaat

SEQ ID NO: 35830 - protein, 323 aa, Panicum virgatum
  misc_feature: Ceres CLONE 1963454
  misc_feature (36)..(76): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature: Functional homolog of the protein sequence given in SEQ ID NO 50266
  misc_feature: Useful for making plants with altered cell wall content and/or composition
MSKPARVQRASPPPLVASAAILLLFSALPRCQPYTYEQDVFAINGLYTALGAPQLPNWTTNGGDPCNEGWQGVSCVASNITSIILSSANLGGQLGNTLGNFTSLITLDLSNNNIGGTIPDGLPVTMQKFFLSANQLSGSLPSTLSSLTLLTSMSLNNNQLSGDIPDVFLALTGLANLDFSSNNLTGPLPPSMGNLTALTSLHIQNNQLTGTLDVLQDLPFQDLNVENNLLSGPVPVKLLNLPNFKKDGNPFNTSIAPSAQPPAAPTPLPSVSPPARHVPSKEPSTSSSVQGGSTPGSGKHTVSTIKLVGYILIGVVSAVVIVL

SEQ ID NO: 35831 - DNA, 635 bp, Panicum virgatum
  misc_feature: Ceres CLONE 1963454-R
  misc_feature: Encodes the peptide sequence at SEQ ID NO. 35832
aacaacatctggtgcgatgggccacttctcagctctatgatattgatgccatagcaaagatggtagatccttccattcaaggacaatgttctgaaaaggcactgtctcgttttgctgacatcattagccgctgcattcagcacgaaccagaatttaggccaccgatgtctgaagttgtccaagacttaactcgcatggcaagtaatgcatcaaaggcttccatgtaggcggtccagaaggtgggttaaaaatgtgggggcctgtgcttcaaaattggaatgcaagaatgcacctcattttggagtgtcatgtggttcttgccagattcattctctcccaagttgtgaagacgcacttgtaccattgatgcagtagtaggatactctggccgacgcaagaaggatggaatacagtagcaggatgcaagaatgcaccgtgttttatccattgccataatgctcctccgaatctccggtcaaatttttttagttcgaagttattgttgtaattctgtagtctgcacaatgtatttctcggctcctggttccgattccagatcactcgatgtgatcatgcatggttctctagaccatatgtaaatacaagtactgaaataaatatattagaatttgctc

SEQ ID NO: 35832 - protein, 74 aa, Panicum virgatum
  misc_feature: Ceres CLONE 1963454-R
  misc_feature: SWISSPROT Homolog: EC 2.7.11.1 Non-specific serine/threonine protein kinase
  misc_feature: Functional homolog of the protein sequence given in SEQ ID NO 50266
  misc_feature: Useful for making plants with altered cell wall content and/or composition
QHLVRWATSQLYDIDAIAKMVDPSIQGQCSEKALSRFADIISRCIQHEPEFRPPMSEVVQDLTRMASNASKASM

SEQ ID NO: 35833 - DNA, 432 bp, Panicum virgatum
  misc_feature: Ceres CLONE 1963466
  misc_feature: Encodes the peptide sequence at SEQ ID NO. 35834
gatcgcatctgcctgcctgcccaccttcccttcccttcctccccaccccaccccggcgacgcggccgccccgagaccgagcaaccccaccgagagggagaggagcataggaacaaggagagcaagatgtcgtcggcgttcagcggcgatgagacggcccccttcttcggattcctcggcgccgccgccgccctcatcttctcttgcatgggtgcggcgtacgggacgccacccacgccaacgccgccctctccgtcaccttcgggcaaaggcaagtgccccaagaacgcgctcaagctcgcggtgtgcgccaacgtggccggcctcgtgaaagccatggtggggaagccgccggccgagccgtgctgctgcctcctcggcggcctcgccgacctcgaggccgccgcctgcctctgcaccgccatcaaggcca

SEQ ID NO: 35834 - protein, 102 aa, Panicum virgatum
  misc_feature: Ceres CLONE 1963466
  misc_feature: SWISSPROT Homolog: EC 3.6.3.14 H(+)-transporting two-sector ATPase
MSSAFSGDETAPFFGFLGAAAALIFSCMGAAYGTPPTPTPPSPSPSGKGKCPKNALKLAVCANVAGLVKAMVGKPPAEPCCCLLGGLADLEAAACLCTAIKA

SEQ ID NO: 35835 - DNA, 676 bp, Panicum virgatum
  misc_feature: Ceres CLONE 1963469
  misc_feature: Encodes the peptide sequence at SEQ ID NO. 35836
ggaaccgggcagcccagcgcacctgcggtcgactccgcgggagggggacgccgtcgccgtccggcagccactgcctgcgctgctctccggcgaccgactcgctccactccccggcgaaaacatgatcgtctgcgtcgccgtcgtcggacaccagagcttcacggaggcggacgacgccctcaagctccaccacatcgtccactgctccctcgacgtcatcgacgagcgagtaaacaatcctaaaaggagtgcgcctacattgaatgagacatttttgggtcttctgtacccaactgagaactacaaagtgtatggctatttgacaaacacaaaggtcaaatttatcatggtcacgactgatcttgatgtcaaagatgcagatgccagaaattttttcaggaagttccatgctgcatatgtggatgctgtctcgaaccccttccatgtcccagggaagaagattgcttccagaagctttggcgcaagagtaagcaccattgtgaagtcattcggttcaggaactactggttgagttgaaaggctcttttgtcagacttcctgtaatcaaacatggttcagtcccgctgattgacggtttactctacacattgtgtactacttgtatgttgaacgagattctagtgtggtactgatgaaagaaagatggttgttcatt

SEQ ID NO: 35836 - protein, 136 aa, Panicum virgatum
  misc_feature: Ceres CLONE 1963469
  misc_feature (7)..(129): Pfam Name: Sedlin_N Pfam Description: Sedlin, N-terminal conserved region
MIVCVAVVGHQSFTEADDALKLHHIVHCSLDVIDERVNNPKRSAPTLNETFLGLLYPTENYKVYGYLTNTKVKFIMVTTDLDVKDADARNFFRKFHAAYVDAVSNPFHVPGKKIASRSFGARVSTIVKSFGSGTTG

SEQ ID NO: 35837 - DNA, 524 bp, Panicum virgatum
  misc_feature: Ceres CLONE 1963485
  misc_feature: Encodes the peptide sequence at SEQ ID NO. 35838
atccaatcgcgacttccaccatggcagaagcggccggcggcggcccccagctccccgaggatctcgttgtctcggagatcctgacgcgtctgccggtgaagcccctcctccggtgccgcgccgtctgccgctcctggcgcctccggctcacctccgacgccaaattcctcctcgcccaccaccgtcgccagccctcgctcccgctcctcaccaactgggacagggacacgcatgagagaaggatcgacgccctggaccaccgcaccggcgagcggcatcctgtcggccggatcgctgcctgcgacggcctcatcatcctccatgcctacggcggcctcgagatctgcaacccggcgacccgccagcgcgcgcctctcacgctgctccacggcgccgcctgcatctccgcgctttaccctcaccgcccgtccgggtcgcaccgggtgctgtgctgcttcgagagagccgaggacggccacgccgtcgccgtgtaccacgtgcacaccgtcgggtccggcgagctc

SEQ ID NO: 35838 - protein, 167 aa, Panicum virgatum
  misc_feature: Ceres CLONE 1963485
  misc_feature (6)..(54): Pfam Name: F-box Pfam Description: F-box domain
MAEAAGGGPQLPEDLVVSEILTRLPVKPLLRCRAVCRSWRLRLTSDAKFLLAHHRRQPSLPLLTNWDRDTHERRIDALDHRTGERHPVGRIAACDGLIILHAYGGLEICNPATRQRAPLTLLHGAACISALYPHRPSGSHRVLCCFERAEDGHAVAVYHVHTVGSGE

SEQ ID NO: 35839 - DNA, 472 bp, Panicum virgatum
  misc_feature: Ceres CLONE 1963498
  misc_feature: Encodes the peptide sequence at SEQ ID NO. 35840
gaaggccaaaaggcaacgaagactcgaagaagagaggaacactcgaggggaaactgctctctcggcgatcgctcgaggcggcctctcaagatgtatgactttgttcaggtggtgctgcaaccagatcggttcctgagcgagctgacgagcatgtacgagcggagcacggagaaaggctccgtgtgggtcaccatgaagcgatcgtctctcaagggcaaggcacagttgcagaaaatggagaagaaggggaaggaggtggagtaccggtgccttgtccgcgcctctgatggcaagaagagcatctccacctcggtctctctaaaggagtacgcaaagttccaagcttcatatgcaacagtgcttaaagcccatatgcatgctctgaagaaaagggagaggaaagacaggaagaaggcggcagatgctgagaaggcccccgagaccgtgcccaagaagcagaagatatcatcct

SEQ ID NO: 35840 - protein, 127 aa, Panicum virgatum
  misc_feature: Ceres CLONE 1963498
  misc_feature (9)..(98): Pfam Name: SRP14 Pfam Description: Signal recognition particle 14kD protein
MYDFVQVVLQPDRFLSELTSMYERSTEKGSVWVTMKRSSLKGKAQLQKMEKKGKEVEYRCLVRASDGKKSISTSVSLKEYAKFQASYATVLKAHMHALKKRERKDRKKAADAEKAPETVPKKQKISS

SEQ ID NO: 35841 - DNA, 603 bp, Panicum virgatum
  misc_feature: Ceres CLONE 1963519
  misc_feature: Encodes the peptide sequence at SEQ ID NO. 35842
atctcagtagcactggctggtctcttggtgcaccaatacatacactcctaagctaagcttatagtaagccatggcatccaaggccctcatcatcttggccctcaacctcctcttcttcacggcagccaacgcctgcggcaagtgcccgaccccatcgcccccggctctgccaccgccgccgccgcccaccccatcctacaacaagtgcccggtcgacacgctcaagttcggcgtgtgcgccaatgtgctcggactcgtcagtggcgaggtcggcaaggtacctgctgagccgtgctgcagcctcctcggcggccttgccgacctcgaggccgccgtctgcctctgcacggccatcaaggccaacgtgctcggcgtcgtcgtcgacatccccgtcaagctaagcgccctcatcaactactgtggcaagtgcgcccccagtggctacaaatgtgcgtaattaagcttcgcggttactctcgtcgccgcgtctccgtagcacgccgtcacttgcagggtgtagatgcatgcgtcggtcctgctgatctttgtgccttattcacttggttctgcagcctaaaaccatttcacccaaatgtttgtccg

SEQ ID NO: 35842 - protein, 128 aa, Panicum virgatum
  misc_feature: Ceres CLONE 1963519
  misc_feature (46)..(127): Pfam Name: Tryp_alpha_amyl Pfam Description: Protease inhibitor/seed storage/LTP family
  misc_feature: Functional homolog of the protein sequence given in SEQ ID NO 50545
  misc_feature: Useful for making plants with modulated oxidative stress sensitivity
  misc_feature: Functional homolog of the protein sequence given in SEQ ID NO 51501
  misc_feature: Useful for making plants with modulated biomass
  misc_feature: Useful for making plants with modulated flowering time
MASKALIILALNLLFFTAANACGKCPTPSPPALPPPPPPTPSYNKCPVDTLKFGVCANVLGLVSGEVGKVPAEPCCSLLGGLADLEAAVCLCTAIKANVLGVVVDIPVKLSALINYCGKCAPSGYKCA

SEQ ID NO: 35843 - DNA, 564 bp, Panicum virgatum
  misc_feature: Ceres CLONE 1963542
  misc_feature: Encodes the peptide sequence at SEQ ID NO. 35844
aaattcctccttttcctccgaaatctccgtcgctaattgctactgacattcattccgcttgctcgctcccaggtaatccattcgcagtcggccaagtcctcggagcgcgggagatggcggatcaggagacccctgttgcggttgaggcacctacccctgttctcggggagccgatggacttgatgactgccctgcagcttgtcatgaagaagtccagtgctcatgatggtcttgtgaagggccttcgtgaggctgccaaagccattgagaagcatgctgctcagctctgcgtgcttgctgaggactgtgaccagcctgattatgtcaaactggtgaaggcactgtgctccgagcacaatgttcatctggttaccgtgcctagcgccaaaactcttggcgagtgggctgggctttgcaagattgactctgagggcaaggcaaggaaggttgtgggctgctcctgtgtcgttgtcaaggactacggtgaggaatctgagggccttaacatagtgcaggagtacgtcaagtcccactaaatgcgacacactcccggcgcctgggagc

SEQ ID NO: 35844 - protein, 140 aa, Panicum virgatum; identical to SEQ ID NO: 27771
  misc_feature: Ceres CLONE 1963542
  misc_feature (25)..(120): Pfam Name: Ribosomal_L7Ae Pfam Description: Ribosomal protein L7Ae/L30e/S12e/Gadd45 family

SEQ ID NO: 35845 - DNA, 1479 bp, Panicum virgatum
  misc_feature: Ceres CLONE 1963546
  misc_feature: Encodes the peptide sequence at SEQ ID NO. 35846
gaaccagcagcagttgccagttgcagcgccctcctctctcgtctcctctctgggtggacgcaccgcaccgcaccgcaccccaactcccaagccctcccaagcaggcagaggcagcagcacaccgaagagggaggcgacgagagatcccatcgcatcccctccgctcgccgtctccctccctcctccgcgctacgcccgccgccgcttcggtcccgcccgcctcgctttgctcgtccggcacaggttgcatcccgttcctcctcctccgtctccgggttcggctggatcgaaatgggcgcctgcgtgtccaaggtcaccgactgctgctgccgcacgccgcgcaacggcataaccaacgagacaactgacgctgtgacggaggagcagggggaggcatacgagctgccggtgttccaggagttcacctttgagcagttgcgcctcgctacgtcagggttcgcggtggagaacatcgtgtctgagcacggcgagaaggcgcccaatgtggtatacaagggcaagctcgatgcccagcgccgcatcgccgtcaagcgcttcaaccgctccgcctggcctgacccacgccagttcctggaagaagctagatcagttggccagatccggagcaaaagattsgcaaatttgcttggttgttgctgtgaaggtgatgagagattgcttgttgcagagtacatgcccaatgacacgctagccaaacatcttttccattgggaatcacaagcaatgaaatggcctatgagattaagggttgttctctatcttgccgaggctttagaatattgcaccagcaggggtcgtgctctctaccatgatctcaatgcctacagagttctgtttgatgatgactgtaatcctagactttcctgttttggcctcatgaagaacagtcgggatggaaaaagttacagtaccaatttagcatttacacctccagaatacatgaggactggacgaatcactcctgaaagtgtcatatacagctttgggaccatgctattggatgttcttagtgggaagcatattcctcctagccatgcccttgacctgattcgagatcggaactttaatatgcttacagactcgtgtttggagggccaattttcgaatgaggaaggaacagaactggtgcgattagcttcaaggtgccttcactatgaaccccgtgagcgacctaatgtaagatcacttgtgcaatcattggctcctcttcagaaggatgttgagactccgtcttatgaactgatggacattccacgtggcggtgcatcatctatccaatcattacatctttcccctcttgccgaagcctgttccagaaaggatctgacagcaatacatgaaattctagaaaagacaggctacaaggatgacgaggggacagcaaatgagctctcatttcaaatgtggacgaatcaaatgcaagatactttgaactcaaagaagaagggagacactgct

SEQ ID NO: 35846 - protein, 395 aa, Panicum virgatum
  misc_feature: Ceres CLONE 1963546
  misc_feature (72)..(310): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature (115)..(115): Xaa is any aa, unknown, or other
MGACVSKVTDCCCRTPRNGITNETTDAVTEEQGEAYELPVFQEFTFEQLRLATSGFAVENIVSEHGEKAPNVVYKGKLDAQRRIAVKRFNRSAWPDPRQFLEEARSVGQIRSKRXANLLGCCCEGDERLLVAEYMPNDTLAKHLFHWESQAMKWPMRLRVVLYLAEALEYCTSRGRALYHDLNAYRVLFDDDCNPRLSCFGLMKNSRDGKSYSTNLAFTPPEYMRTGRITPESVIYSFGTMLLDVLSGKHIPPSHALDLIRDRNFNMLTDSCLEGQFSNEEGTELVRLASRCLHYEPRERPNVRSLVQSLAPLQKDVETPSYELMDIPRGGASSIQSLHLSPLAEACSRKDLTAIHEILEKTGYKDDEGTANELSFQMWTNQMQDTLNSKKKGDT

SEQ ID NO: 35847 - DNA, 674 bp, Panicum virgatum
  misc_feature: Ceres CLONE 1963546-R
ctagtaatatctccaacatggccaacagcattctatcttcaggcagcagcattactagcacaaggcatggagaatgaagctcaagaagcactaaaagatggttgtagcctagagcaaagtagcagcagtgggcattgagtgcgaacagatttgtagtcacaaagtgcacataatttcaggtgcttgtttgaacagagtattaatgggtatggaagcaggtgttggtgatttgtcaattcggctaggggttggttaaccttgttcagattttgtgcgtgtggaacgtcgtccctcccatatcttcatgtaggatgatgtatatatggaagaaaacgacaacagagaggccctgaaagagatggcaaagacatccaaaggtgaataagtaccgcagacaggaaattaatggagaaagggaaactttctcttggttcgtccagctgaaaaaggaaacccaagggaaacgtcaaaaaggggttgctggtgtacatgtccatcgtgctggtagtgggtgtataaacctgtacagcgagggtttttttttttttcagtctttgtttcatatgtgttagctcccattggtatatttgtggtgaagatggtggaattcttttcagaggcgaaaaatagcggtgttggatggactgttccatttatggatcaccgacgcattc

SEQ ID NO: 35848 - DNA, 511 bp, Panicum virgatum
  misc_feature: Ceres CLONE 1963557
  misc_feature: Encodes the peptide sequence at SEQ ID NO. 35849
gccggtctctctctctctctctccccccaccacgctacgcttagcttacctccaagtccatctccggcgcgagctagctctcgctgctcgatcggcccagatccacaaccaacagcaagcggctgcggggctgcaatgccgggtccggggagcatgccgctggcgctgggcctggacacggcgggggtgcaggtgccctggtacttccggtgccccatctccctggagctcatggccgaccccgtcaccgtgtccacgggccagacctacgaccgcgccagcatcgagtcctgggtcgccaccggcaacaccacctgccccgtcacccgcgcgccgctcgccgacttcacgctcatccccaaccacaccctccgccgcctcatccaagactggtgcgttgcacaccactccatgggcgtccagcgcatccccacgcccaagcagcccgccgacccagacctcgtccgctcccgcgtcgaccacggcccgggcctccccgcgctccgcaggc

SEQ ID NO: 35849 - protein, 125 aa, Panicum virgatum
  misc_feature: Ceres CLONE 1963557
  misc_feature (19)..(93): Pfam Name: U-box Pfam Description: U-box domain
MPGPGSMPLALGLDTAGVQVPWYFRCPISLELMADPVTVSTGQTYDRASIESWVATGNTTCPVTRAPLADFTLIPNHTLRRLIQDWCVAHHSMGVQRIPTPKQPADPDLVRSRVDHGPGLPALRR

SEQ ID NO: 35850 - DNA, 715 bp, Panicum virgatum
  misc_feature: Ceres CLONE 1963559
  misc_feature: Encodes the peptide sequence at SEQ ID NO. 35851
atcgcgtcgtcgtcgaaaccctttgcccctcccaaatcgcggaaaccctagcccccaaatcataccgcagcagcagctggtactgaaccctatcctctcgccgaggcctcgactccctcccccacccaaaaacccagaaccccccctctaatccgattctttctttgcagccaccgccgctccaatcccccttacttccccagctccgctcgctagatccattcatgatgggagaggccaaggagaacgacgtatacgaggaggagctcctggactacgaggaggacgacgacaagacagtcgatggctccgccgccaagcccaccggagaggtcgcgaagaagggctacgtcggcatccacagttccgggttcagagacttcctcctcaagccagagctgcttcgtgctatccaggactgcggttttgagcatccatccgaagtgcaacacgagtgcatccctcaagcaattcttgggatggatgtcatatgtcaagcaaaatctgggatggggaagactgcagtttttgtcctatcatccctccaacagattgatcctgttgcgggtcaggtagcagcacttgtattgtgccacacaagggaactcgcctaccagatctgccatgagtttgagaggttcagcaaatatctgcctgaagttaaagttgctgtcttctatggaggagttcacatcaggaagcataaagatttgct

SEQ ID NO: 35851 - protein, 163 aa, Panicum virgatum
  misc_feature: Ceres CLONE 1963559
  misc_feature (72)..(163): Pfam Name: DEAD Pfam Description: DEAD/DEAH box helicase
  misc_feature: Functional homolog of the protein sequence given in SEQ ID NO 50368
  misc_feature: Useful for biocontainment applications
  misc_feature: Useful for making plants with modulated biomass
  misc_feature: Useful for making plants with modulated cold sensitivity
MMGEAKENDVYEEELLDYEEDDDKTVDGSAAKPTGEVAKKGYVGIHSSGFRDFLLKPELLRAIQDCGFEHPSEVQHECIPQAILGMDVICQAKSGMGKTAVFVLSSLQQIDPVAGQVAALVLCHTRELAYQICHEFERFSKYLPEVKVAVFYGGVHIRKHKDL

SEQ ID NO: 35852 - DNA, 740 bp, Panicum virgatum
  misc_feature: Ceres CLONE 1963562
  misc_feature: Encodes the peptide sequence at SEQ ID NO. 35853
acccagagctctgtagaagaagaggcgaggggcgaaccggagccactcagcggccacctcaccgcaccaccgactgcccgcccgcctgctcctgctcgccgccgcccgctgctctcgccattccagctccagcgctcgccgcctcagcaggccgcagcgcctctcctcctccgcccgcccgcccgcccgccggctgccttccggatgagaagcggcgcaaccggggcggcggaagtgtggtcggcgtgaggcttcgtcggagtccgtgaacgcgccgacaaggatcctggagatcaagcgcatgggttccttggaggcccggtaccggccggccggggcagctgaggacacagctaagagaaggactcagaaaagcaaaagtttcaaagaggttgaaaaatttgatgtttttgtactggagaaaagctcgggatgcaaattcagatccttgcaacttttgctctttgctatcatgtctgctgcatttctaaccctcctatacacaccgtctgtgtatgaacatcagctacagtcaagctctcgacttgtcaatgggtggatatgggataagagaagttctgatcccctatatgtatcttctgccagcattcaatgggaagatgtatataaaagtattcaaaatctgaatggtggtgaacaaaagctcaaagttgcactcctgaattttaacagaactgagtttggcacttggacagatatgctcccagaaagtgattttt

SEQ ID NO: 35853 - protein, 146 aa, Panicum virgatum
  misc_feature: Ceres CLONE 1963562
  misc_feature: Functional homolog of the protein sequence given in SEQ ID NO 50884
  misc_feature: Useful for making plants with altered carbohydrate content
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPLYVSSASIQWEDVYKSIQNLNGGEQKLKVALLNFNRTEFGTWTDMLPESDF

SEQ ID NO: 35854 - DNA, 697 bp, Panicum virgatum
  misc_feature: Ceres CLONE 1963598
  misc_feature: Encodes the peptide sequence at SEQ ID NO. 35855
gcgtgggggaggtagtgttggaccaagtgttcctccaggtccatcgagatcagttcccgagctgcaccaagccccatatgtccaatatcaaccccctgtggtggtatcaccatccccaccggcagctggctcttcctcgcagcctatggaggctgtggtgagcactggacaagtccagcaacagtttcagcaacttgctattcgtggtgagagttcaaccagccaagccattcagatggcaccagcatcaagcaaatcagttaaattcccattgcgccctggcaagggtacttatggctccaggtgcatcgtgaaggcaaatcatttctttgctgagctgcctgataaagaccttcaccactacgatgtttctattacgcctgaggttacttcacgtggcgtcaatcgtgctgtcatgggacagcttgtaactctttatagacagtctcatttggatgggcgtctacctgcatatgatggaaggaagagcctttatacagcgggaccattgccatttacatctagggcatttgaaattactctgcaagatgagggggctagtcttggtggaggccaaaggcgcgaaagggtatttaaggtggtgatcaaatttgctgcccgcgctgatctccaccatctggctatgtttctagctgggaggcaaccagatgctcctcaagaggctctttcagtactt

SEQ ID NO: 35855 - protein, 231 aa, Panicum virgatum
  misc_feature: Ceres CLONE 1963598
  misc_feature: The sequence is a functional homolog of SEQ ID NO 2086 in the 10/374,780 US patent application
RGGGSVGPSVPPGPSRSVPELHQAPYVQYQPPVVVSPSPPAAGSSSQPMEAVVSTGQVQQQFQQLAIRGESSTSQAIQMAPASSKSVKFPLRPGKGTYGSRCIVKANHFFAELPDKDLHHYDVSITPEVTSRGVNRAVMGQLVTLYRQSHLDGRLPAYDGRKSLYTAGPLPFTSRAFEITLQDEGASLGGGQRRERVFKVVIKFAARADLHHLAMFLAGRQPDAPQEALSV

SEQ ID NO: 35856 - DNA, 303 bp, Panicum virgatum
  misc_feature: Ceres CLONE 1963603
  misc_feature: Encodes the peptide sequence at SEQ ID NO. 35857
ctcctccgccgtcgcctctccactttcgccatccttcgccgccgtggcggtcgcctcgctctccttatagccttctccgactccgaggggcagccgctgggtccgacccgaggtgtacccgctgttcgcggtcatgggcgtggccgtcggcgtttgcggatttcagctcttccggaccatcggcgctaacgcggaagtcagggtaaaccgggctgggagggcacctggtgtgcttgacaaacatgacgaggggatgcgttacataatgaacaaactccgtaatcttcgtgcttgatcccaccc

SEQ ID NO: 35857 - protein, 53 aa, Panicum virgatum
  misc_feature: Ceres CLONE 1963603
  misc_feature (1)..(52): Pfam Name: B12D Pfam Description: B12D protein
MGVAVGVCGFQLFRTIGANAEVRVNRAGRAPGVLDKHDEGMRYIMNKLRNLRA

SEQ ID NO: 35858 - DNA, 672 bp, Panicum virgatum
  misc_feature: Ceres CLONE 1963604
  misc_feature: Encodes the peptide sequence at SEQ ID NO. 35859
aatggctggtcgttccatcgatccactagtgcacccatagctttaccaacatgtacacacctagccagcaatactgactgagatccactagtgcgcagtgcagggtgccatggcgagcgccacctccagtctcctcgtcccggcgacccctaccgcctcaacgctcctgcatgcccctccaagaagaccgccgccagccgccgccggcggggccgcacgttgtcatgccggccgggccagcagcgccggcggcaacaatgacggcctcctctggctgccccggcgggacgtgctcgccggtctgggcggcggcgtcgccgccggcctcgtcgggtacccggacctcgcgtccatcgccctggaggcgagccccgcggagagctgccggcggggcgacaaggtcacggacaagctggtggagtgctcggacccggaccgcggctccccgtgcccgccgccgatgccgaccccggtcgtcgtcgacttcgagccggagcgcacggcgacgcgcgtccgccgcgcggcgcacctcctcgaccgggagtaccaggagaagtacaaggaggccgtcgggaagatgcgggcgctgccgccgtccaacccgctgagcttcgcggcgcaggcggccgtccacgaggcctactgcgacggccactaccggtacgacccggc

SEQ ID NO: 35859 - protein, 187 aa, Panicum virgatum
  misc_feature: Ceres CLONE 1963604
  misc_feature: SWISSPROT Homolog: EC 1.10.3.1 Catechol oxidase
MASATSSLLVPATPTASTLLHAPPRRPPPAAAGGAARCHAGRASSAGGNNDGLLWLPRRDVLAGLGGGVAAGLVGYPDLASIALEASPAESCRRGDKVTDKLVECSDPDRGSPCPPPMPTPVVVDFEPERTATRVRRAAHLLDREYQEKYKEAVGKMRALPPSNPLSFAAQAAVHEAYCDGHYRYDP

SEQ ID NO: 35860 - DNA, 1458 bp, Panicum virgatum
  misc_feature: Ceres CLONE 1963627
  misc_feature: Encodes the peptide sequence at SEQ ID NO. 35861
atcttctcccaccagccagcggctgccgcctctcccggtcccagtcaccaatctcttcttcccacccagccacactcccagaagcagcttccctcccgttcccacccctaggccgcctccgcttcgtctgcctcaagccggccgcttctgctcccatcctgccgccctgccggccgccaccccatctcaccagatccgccggccgccgaccagcgataggcctcgaccgccatggagtaggttccgaagctcccgccctccgccccgaaggtgcgaagagcacgagtctacgcgcggcggccgccgcctccatcttccacggcagcgacgggcgacggtggcgccgccagcctgttacgactcgcttccccatccccccgttctggcgagcttcgacgagccgagctggagcttcggtcgagccgaactcgagcctgcctgactgggagcccgagggtcaagccaggctcggctcgagctgcgtcgagctcgagccgcgctcctgagcccgctcgtgctcggctcgtcgacagccctggcatcggtttcgctattatataacagcgctgcgtgtctgcgccgccgcctctgctcatctgctgcccccttcaaatcgggcaccacaaccctgagtctgctggggagcagaggggggagcccaacggattgggtcgaatcttctccccaatccctcgactagagctaccccgccctttggaaatcctctgatctgatgaactgagtatatttctgtctgtggaagaaaggaacttggtccattaattttgtcacaagtggaaccaagcaatatgtcctcagtaggtctactaaatccctcgtcaggatatgaagctagtactagtggtgccactgatcgattgccggatgagatgaacgggatgagcataagagatgaaaaggaagttgaagctgttgttgtcaatggcaatgggatggaggttggtcataccatcgtaacatctgttggtggaagaaattcacagccaaggcagaccattagttacatggcagagcgtattgtagggcaaggttcatttggaattgtcttccaggccaggtgtctggaaactagtgagagagtagctataaagaaagttcttcaagatgtgaggtataagaaccgtgagctgcaaacaatgcaagttcttgatcaccctaatgtcgtatgcttgaagcattacttttgctcaacaactgaaaaggaagagctttacctcaatttggtgcttgaatatgtgccagaaactgttcaccgtgttattaagcattacaataagatgaatcaacgtatgccgttgatatatgttaaactctatatgtaccagatttgtagagctttggcttacatgcataactgcgtaggagtatgccacagagatataaagccacaaaatattctggtgaacccacatactcatcaactgaaattgtgtgatt

SEQ ID NO: 35861 - protein, 216 aa, Panicum virgatum
  misc_feature: Ceres CLONE 1963627
  misc_feature (72)..(216): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50366
  misc_feature: Useful for making plants with modulated water use efficiency
  misc_feature: Functional homolog of the protein sequence given in SEQ ID NO 50365
  misc_feature: Useful for making plants with modulated biomass
MSSVGLLNPSSGYEASTSGATDRLPDEMNGMSIRDEKEVEAVVVNGNGMEVGHTIVTSVGGRNSQPRQTISYMAERIVGQGSFGIVFQARCLETSERVAIKKVLQDVRYKNRELQTMQVLDHPNVVCLKHYFCSTTEKEELYLNLVLEYVPETVHRVIKHYNKMNQRMPLIYVKLYMYQICRALAYMHNCVGVCHRDIKPQNILVNPHTHQLKLCD

SEQ ID NO: 35862 - DNA, 682 bp, Panicum virgatum
  misc_feature: Ceres CLONE 1963627-R
  misc_feature: Encodes the peptide sequence at SEQ ID NO. 35863
aattaagcgcatgaacccaaactatactgagtttaagtttccacaaatcaaagctcacccatggcacaagatcttccacaaaagaatgccatctgaagctgtagatcttgtttctcggctcctacagtactcaccaaacctccggtgcgctgcattggaggcgttaatccatccattctttgacgaactacgggatccgaatgcccggttaccgaatggtcgttctcttccccatctcttcaattttaagtctaatgagttaagaggagtaccaacggattttgccatgaaattaattcctcagcatgccaagaagcaatgtgccttcttaggaatatgaggaagcagttcagagtgctcacaaaaagaagcaagcagcagtttggaggttacctacatattacatcaatattatgtcgaaaactgcagagtagcatttgcctacagtattattggatgagcaatgcatgctgttttctttcactttggctgtgatgtctcatgtttgttctacaatggcagtgagcgctttcaccacattctgtaaagctgatgaagacattaagcgtgatcatttcctgtggtctgtatattggtctgcctcaaccttgagaattaattctttgcatattttattctttctttttggagatggattatttgcatatctatctgtgtcacc

SEQ ID NO: 35863 - protein, 112 aa, Panicum virgatum
  misc_feature: Ceres CLONE 1963627-R
  misc_feature: SWISSPROT Homolog: EC 2.7.11.1 Non-specific serine/threonine protein kinase
  misc_feature: Functional homolog of the protein sequence given in SEQ ID NO 50366
  misc_feature: Useful for making plants with modulated water use efficiency
  misc_feature: Functional homolog of the protein sequence given in SEQ ID NO 50365
  misc_feature: Useful for making plants with modulated biomass
IKRMNPNYTEFKFPQIKAHPWHKIFHKRMPSEAVDLVSRLLQYSPNLRCAALEALIHPFFDELRDPNARLPNGRSLPHLFNFKSNELRGVPTDFAMKLIPQHAKKQCAFLGI

SEQ ID NO: 35864 - DNA, 714 bp, Panicum virgatum
  misc_feature: Ceres CLONE 1963724
  misc_feature: Encodes the peptide sequence at SEQ ID NO. 35865
acagcggaggactccttccacgtcccgcccgagccgcccgctccccggcaaccgcagctccagcgacgccccctcctccccactactagtactagagtccactcaccacacagacatcccctacccggagaggcagagagagctctcctcgtggactagggactagaagaggagagccatgtctgccgcagcctgcgcgccgacgcggctcgggatatcgctcgcgttcgccgaccgaatggcgccgccgccggcgctcgaggaggaggacccggccggcgaggggtgcgtgaacgcgcagctctggctcgcgtgcgcgggctccatgtgcaccgtcccgcctgtcggcgccgcggtctactacttcccgcagggccacgcggagcaggccagcgacgccgtcgacgtgctgtccgccgcgcgcggcgtcccgcccttcgtcccgtgccgcgtcgtcgccgtcaggtacatggccgagccgcacaccgacgaggtcttcgccaggatacgcctcgccccgctccgccccggggagcccgtggcggacgtcggcgacgccgccgcgggcgaggccggggacgaccaccagcaccagcaccagcccaagccggcgtccttcgccaagacgctcacgcagtccgacgcccataacggcggcggcttctccgtgccgcgcttctgcgccgagaccatcttcccggagctggactaccc

SEQ ID NO: 35865 - protein, 178 aa, Panicum virgatum
  misc_feature: Ceres CLONE 1963724
  misc_feature: The sequence is a functional homolog of SEQ ID NO 1185 in the 10/666,642 US patent application
  misc_feature: The sequence is a functional homolog of SEQ ID NO 1184 in the 10/666,642 US patent application
  misc_feature: The sequence is a functional homolog of SEQ ID NO 442 in the 10/666,642 US patent application
  misc_feature: The sequence is a functional homolog of SEQ ID NO 1428 in the 10/666,642 US patent application
  misc_feature: The sequence is a functional homolog of SEQ ID NO 1431 in the 11/479,226 US patent application
  misc_feature: The sequence is a functional homolog of SEQ ID NO 168 in the 10/666,642 US patent application
  misc_feature: The sequence is a functional homolog of SEQ ID NO 1186 in the 10/666,642 US patent application
MSAAACAPTRLGISLAFADRMAPPPALEEEDPAGEGCVNAQLWLACAGSMCTVPPVGAAVYYFPQGHAEQASDAVDVLSAARGVPPFVPCRVVAVRYMAEPHTDEVFARIRLAPLRPGEPVADVGDAAAGEAGDDHQHQHQPKPASFAKTLTQSDAHNGGGFSVPRFCAETIFPELDY

SEQ ID NO: 35866 - DNA, 1280 bp, Panicum virgatum
  misc_feature: Ceres CLONE 1963738
  misc_feature: Encodes the peptide sequence at SEQ ID NO. 35867
cgtcaaaaaattttctctctccaaaatttctcttagaaaaaatttctaaaattggaaaacgacaaaaaaatttctaaaaatagaaaagaaaaattgctgtcgtgaaatcgaccgtacgggagcctcccgtacggttgaccgtaaattagcgagacccactagccactcgcctcttgactgcgggcacaactattccttacggaaacggggtttcactcgctggattttgcttgctttgctttccgggcaagcctatttctgaaagcttaggatcagggcaaaggttctgattagccacacacacgtactacaccgacagcgacacgaataaacaaagtgatgatggaaaaaagagcatggcttcacgctcataaggttgtgctctctgtataaaaaaactttgcctcgcggcctcacgctcatatcggcaggcaaataatggactagttatttgttgatccccaagttgggttaggtcgataaacccatcgggcccacgcacgagtgaacgtgcaggctgatgatacgctcgccaccgttatatatccatatgaaattcttgcgatcttgttgacttgtagctgcaactgcacagtcgcaaggaaggttctgattcacttcattagttcatttggttgggcaaatcttactgacatggtctttcaaataaaaaaccttactgacatgtgacatgggtgcgtgcgcaggaatgtgatggcgcagactggcgagatccggtgcgccatggaccacatcctcgaggccgagaggaggggcgagatcaaccacgacaacgtcctctacatcgttgagaacatcaacgtcgcaggttataattacattcaactactcttcttatttccagattcccaccaaactcctcccgttcaaatccagaatctctgctcaatttagctgtcgttacagagtctccagaaacagaatatgctctgtttcttaaaacgaagcaggggatgctctgcctttgtagaaaagaaatagcctttttcacaacatatcacatggctacgtgcccacttgcattatatacatgtggggtccaagaagaaaacattaaaatagcttgcctatgggtcgtcatgatgccgtggatcactgttccgttccaaaataccggtatggaccttaggggtagattgaaatggttgttggaactgctgccacgtaatcacgctacgacttgtgttttctagatattggttacaagtcaaactgccaccaactgtcggtgcatcggcagtgctcctgcctgttttcag

SEQ ID NO: 35867 - protein, 66 aa, Panicum virgatum
  misc_feature: Ceres CLONE 1963738
  misc_feature: SWISSPROT Homolog: EC 1.14.13.11 Trans-cinnamate 4-monooxygenase
  misc_feature: Functional homolog of the protein sequence given in SEQ ID NO 51193
  misc_feature: Useful for making plants with altered carbohydrate content
MAQTGEIRCAMDHILEAERRGEINHDNVLYIVENINVAGYNYIQLLFLFPDSHQTPPVQIQNLCSI

SEQ ID NO: 35868 - DNA, 523 bp, Panicum virgatum
  misc_feature: Ceres CLONE 1963742
  misc_feature: Encodes the peptide sequence at SEQ ID NO. 35869
gtctgcggacacgagcccgcacccttttcgtcactgcagcaagctgtgcagtctgcaggactgcaagtctgcaacccagagtctccagtagcgatccaccggcgagctcagatcagaatcccctcccctctcctcgcgactcgcgagcccgcagggaaggaatggagagcggcggggtcgggatgggcggcggcgagtgcaggagcaacgactacggtgacgccgcctactgggacgcccgctactcctcctccgggtcccgcgcttccggcggcggcgagttcttcgactggtaccagacgtacgcggcgctgcgcccgctcctccgggcccgcatccccgccgcctcccgcgtcctcatggtcggctgcggcaactcccttttgtcagaggatatggcgaaggatggttacaaggacattgtaaacatagacatttcatctgtggtcatcgagcatatgagagagaaacacaaggagattccacagctgacctatatgcagatggatgttagggacatgac

SEQ ID NO: 35869 - protein, 120 aa, Panicum virgatum
  misc_feature: Ceres CLONE 1963742
  misc_feature: SWISSPROT Homolog: EC 3.4.24.71 Endothelin-converting enzyme 1
MESGGVGMGGGECRSNDYGDAAYWDARYSSSGSRASGGGEFFDWYQTYAALRPLLRARIPAASRVLMVGCGNSLLSEDMAKDGYKDIVNIDISSVVIEHMREKHKEIPQLTYMQMDVRDM

SEQ ID NO: 35870 - DNA, 680 bp, Panicum virgatum
  misc_feature: Ceres CLONE 1963744
  misc_feature: Encodes the peptide sequence at SEQ ID NO. 35871
gtgagcgatcctaccatatattttatcagctatgtgctggtgcacctgcttctcttagagagaaattgaatttgaaaaaggtggatgagttcaaatatcttaagcagagctgttgctattcaattgctggtgtggatgatgcccaaatgtttcgaactgtgacggaagctatgaacattgtccatatcagcaaagaagaccaagagagtgtttttgcaatggtctctgcggtcctttggcttggggatgtctcgttcactgtcattgataacgaaaatcatgttgaaatcattgtagatgaagcttccgaaacagttgcagagcttcttggctgcagtattgaagatcttaatttggctttgtcaaagcgccacatgaaagtcaataatgaaaacattgtccagaaacttacacttgccaaggctactgacacaagagacgctctggccaaatcagtctatgccagtttgtttgagtggcttgtagaacaaattaataagtctctctcagttggcaagcgtcgaactgggagatcaatcagtattcttgatatctacggctttgaatcatttgataagaacagtttcgaacagttctgcatcaattatgccaatgagaggctacaacaacattttcatcgtcatttgtttaagcttgaacaagaggaatatgttgaggat

SEQ ID NO: 35871 - protein, 225 aa, Panicum virgatum
  misc_feature: Ceres CLONE 1963744
  misc_feature (1)..(225): Pfam Name: Myosin_head Pfam Description: Myosin head (motor domain)
  misc_feature: SWISSPROT Homolog: EC 2.7.11.1 Non-specific serine/threonine protein kinase
ERSYHIFYQLCAGAPASLREKLNLKKVDEFKYLKQSCCYSIAGVDDAQMFRTVTEAMNIVHISKEDQESVFAMVSAVLWLGDVSFTVIDNENHVEIIVDEASETVAELLGCSIEDLNLALSKRHMKVNNENIVQKLTLAKATDTRDALAKSVYASLFEWLVEQINKSLSVGKRRTGRSISILDIYGFESFDKNSFEQFCINYANERLQQHFHRHLFKLEQEEYVE

SEQ ID NO: 35872 - DNA, 479 bp, Panicum virgatum
  misc_feature: Ceres CLONE 1963751
  misc_feature: Encodes the peptide sequence at SEQ ID NO. 35873
acatgcttgccgtcatcttcttggacagaggttagaggcagaggctgcctccagactcgtcggagtcagccatgatagaggcagcggccatgcccgcttgctcctccatcccctcgcccttcaccaccaagttcactgatggaaacggagaagtggagctcagactggacgtccaaaagctcggcatcgagggttcaaaagatgtttttgttgatgttggtgatacatctctattgatcagagctaagtctgatgggacactgagaactttgatgaatttccaaacactgtttgataggatcaagtcttccgagaccatatggtttattgatgaggatcagctggtggtaaatttgaagaaagttgagcaagagttgaaatggcctgatattgatgaatcctgggagtccctcactgctgggatcacccagttattgacagggatcagcatccatattgttggtgattccacagacatc

SEQ ID NO: 35873 - protein, 135 aa, Panicum virgatum
  misc_feature: Ceres CLONE 1963751
  misc_feature (17)..(97): Pfam Name: CS Pfam Description: CS domain
MIEAAAMPACSSIPSPFTTKFTDGNGEVELRLDVQKLGIEGSKDVFVDVGDTSLLIRAKSDGTLRTLMNFQTLFDRIKSSETIWFIDEDQLVVNLKKVEQELKWPDIDESWESLTAGITQLLTGISIHIVGDSTD

SEQ ID NO: 35874 - DNA, 516 bp, Panicum virgatum
  misc_feature: Ceres CLONE 1963753
  misc_feature: Encodes the peptide sequence at SEQ ID NO. 35875
atcgaagccatagtaggagagaaaaggaaaaaggcagctagtgacagaatccgacatagacttgcttggctgatcgagctgatcagcgagagctcaagaaggcttccagagctgattccaatagaatggtcatgggaaagcacggagcggcggcattgcttgcggcggtcctggcggcgtctgcgcttgttggcctcgccgccgccggcaacttctgcgaggagtgcgacgcgacgtgggagccccagaactgctgggcctacgacgatggcaacaggctctccctcgccctcgtcagcaactcatcaggctccatgatccggtcgaagaagcagttcctctgcgggactgtgtcgaccatgatccagcttgtcccgggcgactctgccggcaccgtcacaacctactacacgtcctcgctcggcgacaaccacgacgagatcgactacgagttcctgggcaacgtgaccgggcagccctacaccatccacaccaacgtctacgccgacggcgtcg

SEQ ID NO: 35875 - protein, 130 aa, Panicum virgatum
  misc_feature: Ceres CLONE 1963753
  misc_feature (30)..(130): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Functional homolog of the protein sequence given in SEQ ID NO 50386
  misc_feature: Useful for making plants with altered carbohydrate content
  misc_feature: Functional homolog of the protein sequence given in SEQ ID NO 51502
  misc_feature: Useful for making plants with altered cell wall content and/or composition
MVMGKHGAAALLAAVLAASALVGLAAAGNFCEECDATWEPQNCWAYDDGNRLSLALVSNSSGSMIRSKKQFLCGTVSTMIQLVPGDSAGTVTTYYTSSLGDNHDEIDYEFLGNVTGQPYTIHTNVYADGV

SEQ ID NO: 35876 - DNA, 744 bp, Panicum virgatum
  misc_feature: Ceres CLONE 1963754
  misc_feature: Encodes the peptide sequence at SEQ ID NO. 35877
caaacccccctcttcgttcccctcgccgctgtcgtcgccgaccgagggagccatggatccagccgctccccgccgcgggcacctacagatccacctcctggtggtggccctcaccgtattcgtggccctcgtcgcgcggtccggcgccgaggtcatcaccctcaccgaggagaccttctccgacaagatcaaggaaaaggacacagtatggtttgtgcaattttgcgtcccctggtgtaaacactgcaagaaccttggaacactttgggaggacctgggaaaggttatagaaggtgaggatgaaattgagatagggcaagtcgactgtggtgtcagcaaaccagtatgctccaaggtggatatccactcctacccaacattcaaggtgttttatgaaggtgaagaagtagcaaaatataaaggaccaagggatgtggaatcactgaagaactttgtgttgaatgaagctgagaaagcaggtgaggcgaagcttcaagctgattgaggctagaactagaacattggcgtagacaaggatcttgcttagatcttttttatcttgccagtgtcctgtatcctggcatttgatagaggacaaggacagttcctgtatcttttgagttttcacctgctagtcctaatcagctaatggaagttcacatgtactccagtccatacgatgtgctcgacattgataaactaactattgattaaaatccaacgacacaaaggcctatttatatc

SEQ ID NO: 35877 - protein, 150 aa, Panicum virgatum
  misc_feature: Ceres CLONE 1963754
  misc_feature (33)..(138): Pfam Name: Thioredoxin Pfam Description: Thioredoxin
  misc_feature: SWISSPROT Homolog: EC 5.3.4.1 Protein disulfide-isomerase
MDPAAPRRGHLQIHLLVVALTVFVALVARSGAEVITLTEETFSDKIKEKDTVWFVQFCVPWCKHCKNLGTLWEDLGKVIEGEDEIEIGQVDCGVSKPVCSKVDIHSYPTFKVFYEGEEVAKYKGPRDVESLKNFVLNEAEKAGEAKLQAD

SEQ ID NO: 35878 - DNA, 1443 bp, Panicum virgatum
  misc_feature: Ceres CLONE 1963770
  misc_feature: Encodes the peptide sequence at SEQ ID NO. 35879
acgcccccctcacctccttcgttactcctacttggattgatgaatcgattcgtttcattccggtgtctgtccacagcgctcgcaatcgaagcccttcgactctgaggctcctccctccctctctttctctctctcacgctccaagaagaggagggtcccagcgcaatttctctctctctctttctctctctccacgttgacgcgcaccaagtgcagtgcggtgctcggcgtccgggagggagacgaggaatctccaaggaggacaggaggtgaggtgaggtgcggtcaatccatggagacggagccccatggaagacgaccaactgctgcttgcttcactgcctgtgcctgagagattgcactgaatgggacctatttgatgttttccccattctctatttgggcgctagctgatggatctccacatgaaacttctccttgtctccctcagctgtgttcttctgatgcaggcagcatcatgtgatggaaccacgggggaaactgaaatgacaaattggacatgtgtatgtgcagctcatccgctaggtgaatctaactctaacagcagcttgttgtccaattgctcttcgtcctgtcattgccagcaagatgagaatggtggcacggggtcatggaactgcacatgtgcctctgacaagacccgtcagaaagaagaacatgctatgctacacgataggagttgcttcacttcctgtaactgtacatccggaagttcagaggaagggaaaaggcatgtctccagtagaacagtcataattacgctcctagtgtgtgtggttctcaccactactgcttttcttgtcaccactgtatactacattcgccgcaaggatgcgctctctcctcgttctcagatatactcctttgataaatacactagctggagcagcagatcaaaccttgtcagccatcgatcatctcctctcccccaactgaaaccgaaaccaaggctcagagttctcaaagagtttctatgtagctgccctatcatttgtgggagtgaaagtggcacattcccgggtgttgtcatcaggttttcgtactcagagttggatgaagcaactgggaaattctcagatgagcatcttattggagttggtggatcaagcaaggtataccgaggccagcttagcgatggcaaagttgttgccgtgaaaaagcttaggcccctgggaggtgccgacgaagacttcgagttcctgtctgagatcgagctgctgtcgaggctgaaccactgccacgtggtgccactgctggggtactgttcggagatccagagccggcagctggagagactgctggtgtttgagtgcatgtccaacggcaacctcagggactgtctggacctgaaacaaggtaggaagcccatggactggcagacccgggtgagcatcgcgcttggcgccgccagggggctggagt

SEQ ID NO: 35879 - protein, 343 aa, Panicum virgatum
  misc_feature: Ceres CLONE 1963770
  misc_feature: SWISSPROT Homolog: EC 2.7.11.1 Non-specific serine/threonine protein kinase
MDLHMKLLLVSLSCVLLMQAASCDGTTGETEMTNWTCVCAAHPLGESNSNSSLLSNCSSSCHCQQDENGGTGSWNCTCASDKTRQKEEHAMLHDRSCFTSCNCTSGSSEEGKRHVSSRTVIITLLVCVVLTTTAFLVTTVYYIRRKDALSPRSQIYSFDKYTSWSSRSNLVSHRSSPLPQLKPKPRLRVLKEFLCSCPIICGSESGTFPGVVIRFSYSELDEATGKFSDEHLIGVGGSSKVYRGQLSDGKVVAVKKLRPLGGADEDFEFLSEIELLSRLNHCHVVPLLGYCSEIQSRQLERLLVFECMSNGNLRDCLDLKQGRKPMDWQTRVSIALGAARGLE

SEQ ID NO: 35880 - DNA, 658 bp, Panicum virgatum
  misc_feature: Ceres CLONE 1963770-R
ccgggcgacgacgaggaggaggtggtggacctgacggagccccgactggagacgttcacgccggcattgttcagatgattcattacttcgtttgccgtcgtcgccgccgtggctcatccagctggctgcagcgcgcccatgctcggctcccgttcgcatcctccgctccgcctccacgcgcgctttgcggtcgcggccttgtcggccatcaccggcgtcggtcaccattctccaacatacctgacgtgggcggcacccgatgaatattccagccgtaccgacaaatcctaatagcaaaacagctcaaacagttgataatctctacagagtaatcaaattcttttgattgcatttcaacatgcaactgatagtttcaaaataaagtattccctgaaagttccgatcccgacggaggaggtgtgcagatcatggcgcacctggcttgggagtgcatgcagcgggaggctaggccctccaaatcctctccaacatcgctagcaacggctcatttagtactagatgttgagctttttgcaactagcgatagtgtcaactgaatcggaaactagcttaccatctgtatagactgaatgttcaagtgaaattcgggttactgaatgttgtttgcttaatatctccaggaagttcagaggaaggc

SEQ ID NO: 35881 - DNA, 1405 bp, Panicum virgatum
  misc_feature: Ceres CLONE 1963778
  misc_feature: Encodes the peptide sequence at SEQ ID NO. 35882
aactgagctcaagcgccgccaccccccgcacccggttccctccgcctctctcccgtcccctttcctcgcccaacctctcaccataacctcaccagtcgccaccgccatgggaggctccgccggcgccggcgccggcatggccgatgcgcggggaggaggagctccgccggaagccgacgaaggggccggcggcaacgacacagccgaggatacatatcagcatggacagcctgtctactttccagaagaactggtggacaattgggtgtcgttttctcgccgcggcttgtattattgctacaacatctccttgcgagggtgtttgaacacaaccgctactccagcagacataatattagctgtcaaatgtgacatgggtcctgaattcctctataacttatttaactcgggtggtgtcgatgtcaccattcggtacatgagtatcgttcatctgaatcaagaacaggtcatttttgccagaagatttcagaccaccattatttctttgctcattggcaatggccactcggaggtcagagatgctataaaatacttccatgaactacaagtatctgaaggcgttgtctatcttcttctgccttcagtttctggcaagattgattggtgtggtatcaagttctcaacctcatcagtatatgatgcgactgaaaaagatatgggacattgtcattcttgtaaagatcctgatttactgcagacaatggatggtccttgctgcaggtgcatgcttcagaattctgttgtctacatccctcgtgatagaaaattttataatattacagggttccttgacttaaatgaaaacaacccgctgcatttgagagacgagagtgttgttagctccgcgagacgtggcctatgtttaacctctcaaagcaacccactattggttgccagtggactattcacagtgcaaaatttcctctacaagtgctacggaaaagggaaagaaactagtggcagaattgctgttaagttgccacctgaactctgcagagtagtcatggcgccagtttcaacaaatattttatgcagcttctcatttgttccttccataatgtatcgtatccagtgtctgcttctttctgcaaagttgaaaatccagttgggcccaagaatgcaacagttcaacataacagctctgaagattctggaagcgcttacaacaaaggaatgccaggaggaattttcactggaatcattagaaacacttggggattctttccttaagtatgttacaggccagcatctttttagcaaatacaagcatcgagagggcaagctaacctccatgagaaaagaattggtctccaacacaactctatgtcatctagcttgcaacaggaatcttgtggggtacattcgaggtgaagagtttaatctg

SEQ ID NO: 35882 - protein, 432 aa, Panicum virgatum
  misc_feature: Ceres CLONE 1963778
  misc_feature (371)..(432): Pfam Name: Ribonuclease_3 Pfam Description: RNase3 domain
  misc_feature: SWISSPROT Homolog: EC 3.1.26.3 Ribonuclease III
MGGSAGAGAGMADARGGGAPPEADEGAGGNDTAEDTYQHGQPVYFPEELVDNWVSFSRRGLYYCYNISLRGCLNTTATPADIILAVKCDMGPEFLYNLFNSGGVDVTIRYMSIVHLNQEQVIFARRFQTTIISLLIGNGHSEVRDAIKYFHELQVSEGVVYLLLPSVSGKIDWCGIKFSTSSVYDATEKDMGHCHSCKDPDLLQTMDGPCCRCMLQNSVVYIPRDRKFYNITGFLDLNENNPLHLRDESVVSSARRGLCLTSQSNPLLVASGLFTVQNFLYKCYGKGKETSGRIAVKLPPELCRVVMAPVSTNILCSFSFVPSIMYRIQCLLLSAKLKIQLGPRMQQFNITALKILEALTTKECQEEFSLESLETLGDSFLKYVTGQHLFSKYKHREGKLTSMRKELVSNTTLCHLACNRNLVGYIRGEEFN

SEQ ID NO: 35883 - DNA, 518 bp, Panicum virgatum
  misc_feature: Ceres CLONE 1963778-R
  misc_feature: Encodes the peptide sequence at SEQ ID NO. 35884
tgccaccccaaagactgtggagctgtccccggtgtcagaactgaaagaaatatgcgagcacagaaaataccccaagccgctatacttaactcgtgataatggagttggagtaacaagggtggttgcaaaggtgaaggctgcaggtacagtgtactgtggaactggaaaaggccgcaacaagaaagtggcagaaattttggccgcaaaggctctgctccagaaactgaaggccgcatctgtagcatgaagcttggagcagcagcattagttttctttagttacctacgttcctatagtcgtttttgcagtggattaagtctggtcgttcttgagcgctgcagcttgtgggaaacgttcaaggtttgagcgcggcctgtgtcaaaagctgcttctttagaatggatgggtctccgttcatgttagcagttgatatgtgttcacaatttcagtttgtacatataacaaatgcacatcgatacctcatgaccattccagtatcaagcctatattttattttt

SEQ ID NO: 35884 - protein, 81 aa, Panicum virgatum
  misc_feature: Ceres CLONE 1963778-R
  misc_feature (10)..(75): Pfam Name: dsrm Pfam Description: Double-stranded RNA binding motif
ATPKTVELSPVSELKEICEHRKYPKPLYLTRDNGVGVTRVVAKVKAAGTVYCGTGKGRNKKVAEILAAKALLQKLKAASVA

SEQ ID NO: 35885 - DNA, 497 bp, Panicum virgatum
  misc_feature: Ceres CLONE 1963791
  misc_feature: Encodes the peptide sequence at SEQ ID NO. 35886
actcacttcatactcgcacaactgactgactgttgctcagtgcccagtgctcgcccggttcccaccgctctgccgcctgctgtgccctgcctgcctgctctgtccttccctcccctggcagagaatctgcagggctttgccggccggccggccgggcctgcagggaggaggcagcagcgctagcatggtgccgtcgaagaagttccgcggcgtcaggcagcgccactggggctcctgggtctccgagatcaggcacccgctgctgaagaggagggtgtggctgggcaccttcgagacggcggaggaggcggcgcgggcgtacgacgaggccgccgtcctcatgagcggccgcaacgccaagaccaacttccccgtgccgaggaccgccaccggggagctcgcgcccgtgccgccggcgcgggacgcccgcggcggctcgtcgtcggccgctgcctccggcggcggtaacagcagcctgtcgcagatcctgagcgcca

SEQ ID NO: 35886 - protein, 104 aa, Panicum virgatum
  misc_feature: Ceres CLONE 1963791
  misc_feature (5)..(56): Pfam Name: AP2 Pfam Description: AP2 domain
  misc_feature: The sequence is a functional homolog of SEQ ID NO 1302 in the 10/374,780 US patent application
  misc_feature: The sequence is a functional homolog of SEQ ID NO 1447 in the 10/412,699 US patent application
  misc_feature: The sequence is a functional homolog of SEQ ID NO 150 in the 11/375,241 US patent application
  misc_feature: The sequence is a functional homolog of SEQ ID NO 908 in the 10/666,642 US patent application
  misc_feature: Functional homolog of the protein sequence given in SEQ ID NO 51503
  misc_feature: Useful for making plants with modulated biomass
  misc_feature: Functional homolog of the protein sequence given in SEQ ID NO 51504
  misc_feature: Useful for making plants with modulated flowering time
  misc_feature: The sequence is a functional homolog of SEQ ID NO 12 in the 10/225,068 US patent application
  misc_feature: The sequence is a functional homolog of SEQ ID NO 1247 in the 11/479,226 US patent application
  misc_feature: The sequence is a functional homolog of SEQ ID NO 168 in the 10/374,780 US patent application
  misc_feature: The sequence is a functional homolog of SEQ ID NO 574 in the 10/412,699 US patent application
  misc_feature: The sequence is a functional homolog of SEQ ID NO 628 in the 11/435,388 US patent application
  misc_feature: The sequence is a functional homolog of SEQ ID NO 732 in the 10/225,066 US patent application
  misc_feature: The sequence is a functional homolog of SEQ ID NO 1755 in the 10/374,780 US patent application
  misc_feature: The sequence is a functional homolog of SEQ ID NO 212 in the 10/666,642 US patent application
  misc_feature: The sequence is a functional homolog of SEQ ID NO 2600 in the 10/374,780 US patent application
  misc_feature: The sequence is a functional homolog of SEQ ID NO 2706 in the 10/374,780 US patent application
  misc_feature: The sequence is a functional homolog of SEQ ID NO 294 in the 10/225,066 US patent application
  misc_feature: The sequence is a functional homolog of SEQ ID NO 352 in the 10/225,066 US patent application
  misc_feature: The sequence is a functional homolog of SEQ ID NO 1756 in the 10/374,780 US patent application
  misc_feature: The sequence is a functional homolog of SEQ ID NO 198 in the 10/374,780 US patent application
  misc_feature: The sequence is a functional homolog of SEQ ID NO 52 in the 11/375,241 US patent application
  misc_feature: The sequence is a functional homolog of SEQ ID NO 642 in the 10/412,699 US patent application
  misc_feature: The sequence is a functional homolog of SEQ ID NO 860 in the 11/435,388 US patent application
  misc_feature: The sequence is a functional homolog of SEQ ID NO 996 in the 10/225,066 US patent application
  misc_feature: The sequence is a functional homolog of SEQ ID NO 1157 in the 10/374,780 US patent application
  misc_feature: The sequence is a functional homolog of SEQ ID NO 1360 in the 10/412,699 US patent application
  misc_feature: Functional homolog of the protein sequence given in SEQ ID NO 51064
  misc_feature: Useful for biocontainment applications
  misc_feature: Useful for making plants with altered terpenoid content
  misc_feature: The sequence is a functional homolog of SEQ ID NO 151 in the 11/479,226 US patent application
  misc_feature: The sequence is a functional homolog of SEQ ID NO 32 in the 10/412,699 US patent application
  misc_feature: Functional homolog of the protein sequence given in SEQ ID NO 51051
  misc_feature: Useful for making plants with altered alkaloid content
  misc_feature: The sequence is a functional homolog of SEQ ID NO 1427 in the 11/479,226 US patent application
  misc_feature: The sequence is a functional homolog of SEQ ID NO 2076 in the 10/374,780 US patent application
  misc_feature: The sequence is a functional homolog of SEQ ID NO 616 in the 10/225,066 US patent application
  misc_feature: The sequence is a functional homolog of SEQ ID NO 1234 in the 10/374,780 US patent application
  misc_feature: The sequence is a functional homolog of SEQ ID NO 2602 in the 10/374,780 US patent application
  misc_feature: The sequence is a functional homolog of SEQ ID NO 656 in the 11/435,388 US patent application
  misc_feature: The sequence is a functional homolog of SEQ ID NO 68 in the 10/225,066 US patent application
  misc_feature: Functional homolog of the protein sequence given in SEQ ID NO 51505
  misc_feature: Useful for making plants with altered lignin content
  misc_feature: Functional homolog of the protein sequence given in SEQ ID NO 50411
  misc_feature: Useful for making plants with altered cell wall content and/or composition
  misc_feature: Functional homolog of the protein sequence given in SEQ ID NO 50344
  misc_feature: Useful for making plants with altered sterol content
  misc_feature: Functional homolog of the protein sequence given in SEQ ID NO 50251
  misc_feature: Useful for making plants with altered oil content
  misc_feature: The sequence is a functional homolog of SEQ ID NO 159 in the 11/479,226 US patent application
  misc_feature: The sequence is a functional homolog of SEQ ID NO 2218 in the 10/374,780 US patent application
  misc_feature: The sequence is a functional homolog of SEQ ID NO 36 in the 10/412,699 US patent application
  misc_feature: The sequence is a functional homolog of SEQ ID NO 466 in the 11/435,388 US patent application
  misc_feature: The sequence is a functional homolog of SEQ ID NO 492 in the 10/225,066 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 314 in the 10/666,642 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
MVPSKKFRGVRQRHWGSWVSEIRHPLLKRRVWLGTFETAEEAARAYDEAAVLMSGRNAKTNFPVPRTATGELAPVPPARDARGGSSSAAASGGGNSSLSQILSA

SEQ ID NO: 35887 - DNA, 298 bp, Panicum virgatum
  misc_feature: Ceres CLONE 1963797
  misc_feature: Encodes the peptide sequence at SEQ ID NO. 35888
caactcgcatctggagccatcggagttcatcagcactctctagtcacagcacatcttcttctcctcctgctacagagctcaggcaaaagcttcgccgccacaacatcccaatggctcgcttcgccgtggtcgccgccatcgtcgccctcctcgccgtcaccgcggccgcgcaggccccggccgcgacgcccaccccggcgcccaggatggccccgctgccgcgtcccccggcgcgctccccggccaccgccccgggaccgctcccccagccgccccctgccccggcgccctccccgca

SEQ ID NO: 35888 - protein, 62 aa, Panicum virgatum
  misc_feature: Ceres CLONE 1963797
  misc_feature: Functional homolog of the protein sequence given in SEQ ID NO 50188
  misc_feature: Useful for making plants with altered carbohydrate content
  misc_feature: The sequence is a functional homolog of SEQ ID NO 1433 in the 10/374,780 US patent application
  misc_feature: The sequence is a functional homolog of SEQ ID NO 1519 in the 10/412,699 US patent application
MARFAVVAAIVALLAVTAAAQAPAATPTPAPRMAPLPRPPARSPATAPGPLPQPPPAPAPSP

SEQ ID NO: 35889 - DNA, 713 bp, Panicum virgatum
  misc_feature: Ceres CLONE 1963830
  misc_feature: Encodes the peptide sequence at SEQ ID NO. 35890
accaactggcgccaccacgggtgagtggcgacgggccacggccatcactcccgccgcgccgccaggaccaaccgccgccgccgccgccagagcgtcggcgcacgcgccgctgcctgccgctaccccaaaacgccggaatccgccgtcgagcgagcgaccgctgcccactaggaccaccacaccacaattccccgccgcgtgcgagcccaactcggcaactcgcctcgcctcccggcaccggccccccgctcgggcccgtgctcgcggcggtctcgatcagaagccagaagggcgtcctggccacggcgttccccgacgtgctgggattgggcgtggctcgtaaggcacgcttcccgcgcggtacaagtgcgacccaaaggcgctggcagagaggatccctgctgcagcggcagcacaacgagttcagggatggcctctggtggagccttccgcaaccttcttctcctggcggtcctcctctgcctcgcgctcacctcgtcggtcggtggcgaggcgtcgagaagattctggatcgagaatgataccttcatgaaggatggggcgccgttccagatcgtcggcggcgacgtccactacttccgcattgttcctgagtactggaaggatcgccttttaagagcaaaggcactaggcttgaacacaatttcaacatatgtaccttggaatctgcatgagccagaaccacagagttt

SEQ ID NO: 35890 - protein, 94 aa, Panicum virgatum
  misc_feature: Ceres CLONE 1963830
  misc_feature: SWISSPROT Homolog: EC 3.2.1.23 Beta-galactosidase
MASGGAFRNLLLLAVLLCLALTSSVGGEASRRFWIENDTFMKDGAPFQIVGGDVHYFRIVPEYWKDRLLRAKALGLNTISTYVPWNLHEPEPQS

SEQ ID NO: 35891 - DNA, 1428 bp, Panicum virgatum
  misc_feature: Ceres CLONE 1963853
  misc_feature: Encodes the peptide sequence at SEQ ID NO. 35892
aaaacccacgcttcctccactccttgggttttgttcgggctttagcgctcgcccgctgccctctcgcgtgcggcggaacacggctgcgctccgcctccatccctgcgttgcgctcgagaggcttcgatctgcactgtctgcggccgcgcttcggcgagccaaacatcttaaagaagatttttatatattttggtgaagatgaagagaacgcgaaaggcgcagtcaggaaaatcccactcatggtggtgggatagccatattagtccacaaaactctaagtggctctctgagaatgtagaagaaatggagaagcaagtgaaagagatgctggagcttattggaggagaattctctgcagaaaaggctgaggcgttttaccagcaacgacctttgcttgtcactcatgtggagaacttccatcgcatgtatcgtgctctttctgcgcggtatgacaatgtgattggagaactgcgcaaaaatatcccatcatctctgcaatcacatggctcttttggtgtctctgaatcagattctgagacacagtctttttcatctccagaatctgacatgcaagaaaatatgccacagcagaagcaaaaacctggaccagattaccttgatgtttccgttggctctggtgttagctctgatgtatcgaagaaggggagtgaaggttcttcttcatcttcagattctgattcagagcttgatgaagcgaaagaggaaaatggaagtattttgtatgccctgagccaaaaaatcattgagctagaagatgagcttcacgaagcaaggggaaagctcgatgctttagaggaaaagcatgcacattgccaggatatggaatccaacaacattcagaaacagcttgaagaaagggattctgctttaaagagcccaacagaagtcgacagtggaaaggaagcattcgaagctgtgctgttggagcacaaacatgagatcgaagtgctgaagggagaaatggcctcagcagctaagcagtttgaggttgaattggcacatcgtgatcttgaaattgataagtgcaaggctgagcttgaagtagtctcagagaagtatttacatgataagtctactcttgaggatgagcatagaaggctccacggagtcatcaagaatatggaaggtgacctagcaaaaatgtcagaggataaattgctgcttgagtctcggattgaagaacttgagcaggcagctcacagcttagaacattcagcttccgagataatgaagctgcaagaagtaacaaggaatacacaagcagaattagaaaaggttactgaggagaaagaagtcctcaaggaacgtgctaacgaatttgagcagctttgtagggccctcaagacttcaggtacagaggttgcaatgctaccagaaaccatcaagaccctggaagcccagctagag

SEQ ID NO: 35892 - protein, 409 aa, Panicum virgatum
  misc_feature: Ceres CLONE 1963853
  misc_feature (14)..(85): Pfam Name: KIP1 Pfam Description: KIP1-like protein
MKRTRKAQSGKSHSWWWDSHISPQNSKWLSENVEEMEKQVKEMLELIGGEFSAEKAEAFYQQRPLLVTHVENFHRMYRALSARYDNVIGELRKNIPSSLQSHGSFGVSESDSETQSFSSPESDMQENMPQQKQKPGPDYLDVSVGSGVSSDVSKKGSEGSSSSSDSDSELDEAKEENGSILYALSQKIIELEDELHEARGKLDALEEKHAHCQDMESNNIQKQLEERDSALKSPTEVDSGKEAFEAVLLEHKHEIEVLKGEMASAAKQFEVELAHRDLEIDKCKAELEVVSEKYLHDKSTLEDEHRRLHGVIKNMEGDLAKMSEDKLLLESRIEELEQAAHSLEHSASEIMKLQEVTRNTQAELEKVTEEKEVLKERANEFEQLCRALKTSGTEVAMLPETIKTLEAQL

SEQ ID NO: 35893 - DNA, 630 bp, Panicum virgatum
  misc_feature: Ceres CLONE 1963853-R
atctgctagctgatattatggctcgtgatgaaaagatgaagcaggtggacgatcacctgaaacagcttcagtttgagcatgccaagctgatggcagaggctgactctgcccgcaagtccttgtcagaggtgcatgtgcgggtttccgagctggaggaagaggtcgagaaacagaagcttgtcatatctgagagcgcagagggaaagcgggaggccatcaggcagctgtgcttctccgttgaacactaccgcagcgggtatgagcagctgcggcagctgctgcaaggccacaggaggccattggtgatggcaacctgataaatgaacaatatcagtttgccaatgaaatgcacactcgcatgtctttggtcctgttctatatgtagctttattctttcacaacttctgccatgcagcttcagttattaaggatcatgtggtatgtgcctgaaatgtaatttggtgggataatcgtatcgctcctttgtactccttggaatttttcttcttcttgtcagctgatgaatattatgaacgttgctatgcgtgatttttgatctttctaagctattcagtattctgaatgttacgctaggcatcatctctgaaccttttcagttattcagtaact

SEQ ID NO: 35894 - DNA, 1413 bp, Panicum virgatum
  misc_feature: Ceres CLONE 1963856
  misc_feature: Encodes the peptide sequence at SEQ ID NO. 35895
attcgcatcgcatcgcatcgcagcgcgtcgcggcgagcgagcggcagctcgggaagaagaaaaaggaaggaaagccaggggaagcgggcgcgacccgcgcacgaccaccgccacccgcctcccctcccgtcgagtggaatccccgtggactccccccgcccccgcttccgcctccgccgacgcgcctccggccccgcctgcctcctcaggtatccaaccgaggaggacatagagctgagcacaagaagcttgatttgaaagggagccatgaagaaggtgttcaatcaaacggtccgggacataaaaagagaggtgaataagaatgtcctcaaggttcccagaatagaacaaaagattcttgacgccacaagcaacgagccatggggcccacatggatctctcctggcagacattgctcaagcaacgcataactatcatgagtatcagatgatcatgaatattgtgtggaagaggatcaatgacactggtaaaaattggcggcatgtctacaagggattgattgtcttggattacctggttgcgcatggtaccgagcgggttattgatgacataagagagcatgcttatcagatatcgacacttgctgacttccagtacattgattcttctgggagagatcaaggcagcaatgtgcggaggaaatcccagagccttgttagtttagttaatgataaagaaagaatccaggaagttaggcagaaagcccttgcgaccagggacaagtaccggagtgcatttgccaccagtggaccacacaggagcccaggtggatacggtggtggttatgacaatgatcgttttgagggcagctatggcagtagatacgataacagaaatggaaatggaagggatagagaatatggatacagggatgatgacagatatggtggtcctggagatacacccaatcgggaaggagatcgttattccagagattctaatgaacgctatggtagagattatagagaagatgagtacaaaggaagtcacagcaaccatgaatatgctgaaggaacaggccgcaggagctatggtcgggaaacggattcatatggggatgatgaagcttattcatcccgtggccgtggcagcaacgccgatgggcctacccaggatgagaggtaaataatggagattggtcacttgcacagttctgttttcctctaagttgtgttacctacgttgacaggcctatagagcgaaagctttctaaccagcagatcgcttcaccaccaccaaactacgaagatgttacaagagatggccaggataatcttcatgctgacagaaacggaggaagtattcctgctgctgtaccaaaggtgtcctctcctgttcctgcaacaagtgttcccgcagaacaggtgaatggggttcacgataatactgtcg

SEQ ID NO: 35895 - protein, 292 aa, Panicum virgatum
  misc_feature: Ceres CLONE 1963856
  misc_feature (23)..(146): Pfam Name: ENTH Pfam Description: ENTH domain
MKKVFNQTVRDIKREVNKNVLKVPRIEQKILDATSNEPWGPHGSLLADIAQATHNYHEYQMIMNIVWKRINDTGKNWRHVYKGLIVLDYLVAHGTERVIDDIREHAYQISTLADFQYIDSSGRDQGSNVRRKSQSLVSLVNDKERIQEVRQKALATRDKYRSAFATSGPHRSPGGYGGGYDNDRFEGSYGSRYDNRNGNGRDREYGYRDDDRYGGPGDTPNREGDRYSRDSNERYGRDYREDEYKGSHSNHEYAEGTGRRSYGRETDSYGDDEAYSSRGRGSNADGPTQDER

SEQ ID NO: 35896 - DNA, 560 bp, Panicum virgatum
  misc_feature: Ceres CLONE 1963872
  misc_feature: Encodes the peptide sequence at SEQ ID NO. 35897
agcccccctttctccccgccgccacctcgccctcgcgctcgccttcgccctcgctccctccctccgattgcaagagcgctcaaggcggcgaccgcatctccaagatggtgctccagaacgacatcgacctgctcaacccgccggcggagctcgagaagctcaagcacaagaagaagcgcctcgtccagtcccccaactccttcttcatggatgtcaagtgccagggctgtttcagcataaccactgtgttcagccactcccagaccgtggtggtgtgtcctggctgccagacggtgctctgccaaccgaccggtggaaaggccaggctcactgagggctgctccttccgccgcaagggcgactaggctgctggtgtgtgcaacagggaggaaaaagatcgatgtcctgctgagcaaagtttaaccttcccagtagaggattttgttaattatgcctgttaagctcctgtgatgaaacctgcactttgtttgagttctgaaagatttcatacatactcttaacctccttttcctttgcttatttctattgaattcatgatg

SEQ ID NO: 35897 - protein, 86 aa, Panicum virgatum; identical to SEQ ID NO: 9875
  misc_feature: Ceres CLONE 1963872
  misc_feature (30)..(84): Pfam Name: Ribosomal_S27e Pfam Description: Ribosomal protein S27

SEQ ID NO: 35898 - DNA, 696 bp, Panicum virgatum
  misc_feature: Ceres CLONE 1963901
  misc_feature: Encodes the peptide sequence at SEQ ID NO. 35899
acgtcgcattgtacccagatcccaccggagcagaggaggatggcggagatgttcaccgtgaaggtgggggaggcgacgccggcctgcggcggcaggccggcggccgggcccgtctaccggagcgtctacgccaaggacggcctcatggagctgccgccggacatccagtccccttgggatttcttcagtggagcagtcaagaaataccccaagaacatgatgctcggccagcgtcaagtcacagatggcaaggccggtgaatatgcgtggcaaacgtatgaggaagtttacctgaaggtcacgaggattggatcagccatcagaagcttcggtgtaaacccgggggctcactgtggcatatatggatccaactgtccagaatgggttatggccatgcaggcatgcaacagtcaaggaatatgttatgtcccactgtatgacaccctcggagcaaatgctgttgaattcatcatggatcatgctgagatatccattgcttttgtccaggagagcaagatcaaatcaatactagccgtagtccctaagtgcacagcccgccttagagcaattgttagttttggagattttataagtgagatgaaaaaggaagctgagaaatttggtgtatcttgcttttcttgggaagattttcttcaatgtgctttgtttgaatagggaaaacaaaactacgaacat

SEQ ID NO: 35899 - protein, 211 aa, Panicum virgatum
  misc_feature: Ceres CLONE 1963901
  misc_feature: SWISSPROT Homolog: EC 6.2.1.3 Long-chain-fatty-acid--CoA ligase
MAEMFTVKVGEATPACGGRPAAGPVYRSVYAKDGLMELPPDIQSPWDFFSGAVKKYPKNMMLGQRQVTDGKAGEYAWQTYEEVYLKVTRIGSAIRSFGVNPGAHCGIYGSNCPEWVMAMQACNSQGICYVPLYDTLGANAVEFIMDHAEISIAFVQESKIKSILAVVPKCTARLRAIVSFGDFISEMKKEAEKFGVSCFSWEDFLQCALFE

SEQ ID NO: 35900 - DNA, 661 bp, Panicum virgatum
  misc_feature: Ceres CLONE 1963912
  misc_feature: Encodes the peptide sequence at SEQ ID NO. 35901
accggccgattcgctcgctcgccgaccgcccgcgcgcgcgcgctcgcgagatccagaccagggcgccgccgccgcgcgccgacgggacgcccttcgcaagcaggcgaggaggttggaagctcagttagatgaccaaatgattgcataccgtaaattggtttctatgaaatcggatggttcagagaacgatatcgagtcagatatagaaagatcactgaagcaattgcagcaagtaaattcgcaaatgcaaacttgggtatcatcaggaggttctgaagttctttctcatactctgactcgtcatatggagattttgcaagaccttacccaggaattctatcggcttcgatcaagcctcagagtgaaacagcaacatgcttctctccttgacttgagagattttgatagagcaaagtttgatgtcgaagaggcatcagactcagctgatcaagctcttctaagggaacaagctgcaattagcaggagtactggacagatggataacgtgatatcgcaagctcaagtgacgctaggctctctcatgactcaacggtcaacattcggcggcatcacttcaaagataagcaatgtcagcagccggcttccgacgattaaccacgtcctctcgtccatcagaaagaagaaatctatggacaccatc

SEQ ID NO: 35901 - protein, 219 aa, Panicum virgatum
  misc_feature: Ceres CLONE 1963912
  misc_feature (68)..(218): Pfam Name: V-SNARE Pfam Description: Vesicle transport v-SNARE protein
PADSLARRPPARARSRDPDQGAAAARRRDALRKQARRLEAQLDDQMIAYRKLVSMKSDGSENDIESDIERSLKQLQQVNSQMQTWVSSGGSEVLSHTLTRHMEILQDLTQEFYRLRSSLRVKQQHASLLDLRDFDRAKFDVEEASDSADQALLREQAAISRSTGQMDNVISQAQVTLGSLMTQRSTFGGITSKISNVSSRLPTINHVLSSIRKKKSMDT

SEQ ID NO: 35902 - DNA, 1440 bp, Panicum virgatum
  misc_feature: Ceres CLONE 1963954
  misc_feature: Encodes the peptide sequence at SEQ ID NO. 35903
tgttcctcggttcctcctctcctccccccttctcgccaagggaggcgaaggcgataaccaccgacatgcttccccacatgccctagcgatccgttctcatttgcagacccaatccaatccccgagcgatcaccaacctagccgtgtagatttccaccctcacatggaggaaaaatccaatcttcgcatgtgacctctccttaaaatctcccgcaagaatcaagcaaatcaattccaaaggggagagaagaacagagcaatcccgttgcttcgcgtcttcgccttcccgttggcgtttcttctccgttcttcggtctgcccggccgcataaacctccgctaaagctcctctgtcgcgcccaattcgtcagccattcccccaaggatccccaaaggcgagaggcacccacgccaagatccaatccttcgagctatttggtttcaatccgtacagattcctccggagagtacccagaatcggagaaggttttcatttctgatcggtcgccggcgcggattcgtcggtgtttttttttcccccacgaagggcaggccctccgtacggttacgttcttgatccggggaggaaccaccgccggtgaaagacaatgcagccggacccgcaaggccccggcagggggaagacgggtggcgccaatgcgcacgctcggctgccgccgccggtgtcgacggggtcggcggggcggccggcgtcggtgttgccgcacaagacggccaacgtgcgcgaccactaccgcatcgggaagaagctgggtcaggggcagttcggcaccacgtaccagtgcgtgggcaaggcggacggcgccgagtacgcctgcaagtccatccccaagcgcaagctgctgtgccgcgaggactacgaggacgtatggcgggagatccagatcatgcaccacctctccgagcaccccaacgtcgtccgcatccgcggcgcctacgaggacgcgctcttcgtgcacctcgtcatggagctctgcgccggcggcgagctcttcgaccgcatcgtcgccaaggggcactacagcgagcgcgccgccgcgcagctcatcaggaccatcgtcggggtggtggagggatgccactcgctcggcgtcatgcaccgggacctcaagccggagaacttcctcttcgcgagcaccgctgaggatgccccgctcaaggccaccgactttgggctatctgtgttctacaagcccggtgataaattttctgacgttgttggtagcccctattatgttgcccctgaggtgcttcagaaatgctatggcccagaagctgatgtctggagtgctggagtgattctgtatattttgctatgtggtgtacccccattctgggcagagagtgaagctgggatcttcaggcagattttgagaggcaaacttgacttggaatctgaaccgtggccaagtatctctgat

SEQ ID NO: 35903 - protein, 277 aa, Panicum virgatum
  misc_feature: Ceres CLONE 1963954
  misc_feature (49)..(276): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 2 in US patent 7084323
MQPDPQGPGRGKTGGANAHARLPPPVSTGSAGRPASVLPHKTANVRDHYRIGKKLGQGQFGTTYQCVGKADGAEYACKSIPKRKLLCREDYEDVWREIQIMHHLSEHPNVVRIRGAYEDALFVHLVMELCAGGELFDRIVAKGHYSERAAAQLIRTIVGVVEGCHSLGVMHRDLKPENFLFASTAEDAPLKATDFGLSVFYKPGDKFSDVVGSPYYVAPEVLQKCYGPEADVWSAGVILYILLCGVPPFWAESEAGIFRQILRGKLDLESEPWPSIS

SEQ ID NO: 35904 - DNA, 557 bp, Panicum virgatum
  misc_feature: Ceres CLONE 1963954-R
  misc_feature: Encodes the peptide sequence at SEQ ID NO. 35905
tgaggatatgatcaaagatgtggaccaaaacaatgatggacaaattgattatagcgagtttgctgcaatgatgagaaagggcaatgctggtggaactggaaggcgaaccatgcggaacagcttgcatgtggatcttggtgaactcttgaagccttctgagaactaaatggtaccagaggattctgctttccagatgcttcgttctgaagttttgtgtgcctcatcagctgatgccaatgccaccgaaaagctgttaaatttttgcagtggtacaagtagttagtgggaagagcatactatggtatccgtgtaacaaattttaggtgctgggagatgatatactatgctacttcgagtcctgttgtcttgtcatgaatgttgttgataatttcaggtttgtaccatgactgacctttgttgtcagtgtacactgctgttgtcccataagataggcatctaggcctctccatttgaattaccatccatttgtaaacatgttctctcaaaccaatttcttattgatgatttgtcggaaaaacgttgttttttccccattt

SEQ ID NO: 35905 - protein, 54 aa, Panicum virgatum
  misc_feature: Ceres CLONE 1963954-R
  misc_feature: SWISSPROT Homolog: EC 2.7.11.1 Non-specific serine/threonine protein kinase
EDMIKDVDQNNDGQIDYSEFAAMMRKGNAGGTGRRTMRNSLHVDLGELLKPSEN

SEQ ID NO: 35906 - DNA, 597 bp, Panicum virgatum
  misc_feature: Ceres CLONE 1963983
  misc_feature: Encodes the peptide sequence at SEQ ID NO. 35907
acttcgcatcacgcaacgcccccaggcactcgtcagtcgtcacgcacacatccaaacccacttcccgatccgacccggaggttcggagcggagatgaagtcgagggcgaggtccagcggagccgactccaggctctccgtgaggaagtccaaggccgagaaggacccgaacaagcccaaaaggcctccgagcgccttcttcgtcttcatggaggagttcaggaaggactacaaggagaagcaccccaatgtcaagcaagtctccgtgattggcaaggctggtggtgacaagtggaagtccctttccgatgctgagaaagctcccttcgtgtccaaggccgagaagctcaaagctgagtacaccaagaagatggatgcctacaataacaagacggctggaggccctacagcttctggtgactctgacaagtccaagtccgaggtgaacgacgaggatgaggagggtgacgagtgatgcatccatgtctccagccaagtcgtcgcagtcagtagtagggaagtcttcgtcgtcggcctaaccgggcattgctgctccttagcctctggatgctgtcggtctctctagatgtagcagtag

SEQ ID NO: 35907 - protein, 126 aa, Panicum virgatum; identical to SEQ ID NO: 18826
  misc_feature: Ceres CLONE 1963983
  misc_feature (28)..(97): Pfam Name: HMG_box Pfam Description: HMG (high mobility group) box
  misc_feature: Functional homolog of the protein sequence given in SEQ ID NO 50397
  misc_feature: Useful for making plants with altered lignin content
  misc_feature: Useful for making plants with altered terpenoid content
  misc_feature: Functional homolog of the protein sequence given in SEQ ID NO 50396
  misc_feature: Useful for making plants with altered alkaloid content

SEQ ID NO: 35908 - DNA, 596 bp, Panicum virgatum
  misc_feature: Ceres CLONE 1963984
  misc_feature: Encodes the peptide sequence at SEQ ID NO. 35909
accaacgcgccaccagccagccagcagagagccgctgctccaatggtctccttctcctccctctccgccccctcctcctcctcctccacctcctcctccaccccgtccttcaccgtccccaccaaaacctcccccggcaccgcctccgtctcattccccagggcgagtgagtcgcgcaagcgcggggccaggatggcgacggtgagggcggaggcggtggacgcgaccatcagcccgcgggtgagcgcgctccgcccgtccaagaccatggccatcaccgaccaggccaccgcgctgcgccaggccggcgtgcccgtcatcggcctcgccgccggggagcccgacttcgacacgccgaccgtgatcgccgaggctggaatgaatgctatcagggatggcgccacaagatacacgcccaatgctgggactctggagctgaggaaggctatctgcaaaaagcttcaggaggagaatggattatcctacacccctgatcaggtgctagtgagcaatggagccaagcagtgtatcacacaagctgtgcttgccgtatgctcacctggtgatgaagttttgatacctgctccatattgggt

SEQ ID NO: 35909 - protein, 184 aa, Panicum virgatum
  misc_feature: Ceres CLONE 1963984
  misc_feature: SWISSPROT Homolog: EC 2.6.1.1 Aspartate transaminase
  misc_feature: Functional homolog of the protein sequence given in SEQ ID NO 51506
  misc_feature: Useful for making plants with modulated nitrogen use efficiency
MVSFSSLSAPSSSSSTSSSTPSFTVPTKTSPGTASVSFPRASESRKRGARMATVRAEAVDATISPRVSALRPSKTMAITDQATALRQAGVPVIGLAAGEPDFDTPTVIAEAGMNAIRDGATRYTPNAGTLELRKAICKKLQEENGLSYTPDQVLVSNGAKQCITQAVLAVCSPGDEVLIPAPYW

SEQ ID NO: 35910 - DNA, 1355 bp, Panicum virgatum
  misc_feature: Ceres CLONE 1963991
  misc_feature: Encodes the peptide sequence at SEQ ID NO. 35911
atcgagccgagcccctgcccgcaccaaggaccgctgcccacaccaccgcaccacaaccacaattccccgccgctgcccagctcggcaactcgcctctcctcccgccaccggccccgcgctcgggcccgtgctcgcggcggtctcgatcagcagggcgtcctggtcacggcgttccccggcgctttgggattgcgcgtggctcgtaaggcacgcttcccgcggtacaagtgcgacccaaaggcgctgggcagagaggagccctgcaggctgcagcggcagcacaacgagttcagggatggcctctgatggagccttccacaaccttcttctcctggcggtcctcctctgcctcgcgctcacctcgtcggtcggtggcgaggcgtcgagaagattctggatcgagaatgataccttcatgaaggatggggcgccgttccagatcgtcggcggcgacgtccactacttccgcattgttcctgagtactggaaggatcgacttttaagagcaaaggcactaggcttgaacacaattcaaacatatgtaccttggaatctgcatgagccagaaccacagagttggaaattcaatgggtttgcagatcttgaatcatatctgagacttgcacaaaaattaggaatgctggtcatgcttcgtgtaggtccatacatttgtggagaatgggacttaggaggttttccaccttggttgctcaccatagaacctgctcttaaactgcgatcatctgattcgacatatctctccttggtggggagatggtggggagtactacttccaaaagtagcaccattattgtacagaaatggaggtccagttattatggttcagattgaaaatgaatttggttcatttggagatgacaagaattaccttcattaccttgttcaactggctagaagatatcttggagatgacattgttctttatacaactgatgggggcgccatgggcaatttaaagaacggatcaatttctcaagatgatgtttttgctgctgttgattttgaaaccggatccaatccatggcccatattcagattacagaagaaatacaacttaccaggaaaatcagcccctctaagttcggaattttatactgggtggctaacacactggggtgaaagtatggcaacaacagatgccactagtacagctaaagcccttaaaacaattttgtgccgcaatggttctgctgtactttatatggctcatggtgggaccaattttggattttatagtggtgcaaatactggccaagatgaatatgattacaagccagaccttacttcttatgactatgatgcaccaattaaggagcatggagatgtgcataatt

SEQ ID NO: 35911 - protein, 353 aa, Panicum virgatum
  misc_feature: Ceres CLONE 1963991
  misc_feature (39)..(352): Pfam Name: Glyco_hydro_35 Pfam Description: Glycosyl hydrolases family 35
  misc_feature: SWISSPROT Homolog: EC 3.2.1.23 Beta-galactosidase
  misc_feature: Functional homolog of the protein sequence given in SEQ ID NO 51507
  misc_feature: Useful for making plants with altered cell wall content and/or composition
MASDGAFHNLLLLAVLLCLALTSSVGGEASRRFWIENDTFMKDGAPFQIVGGDVHYFRIVPEYWKDRLLRAKALGLNTIQTYVPWNLHEPEPQSWKFNGFADLESYLRLAQKLGMLVMLRVGPYICGEWDLGGFPPWLLTIEPALKLRSSDSTYLSLVGRWWGVLLPKVAPLLYRNGGPVIMVQIENEFGSFGDDKNYLHYLVQLARRYLGDDIVLYTTDGGAMGNLKNGSISQDDVFAAVDFETGSNPWPIFRLQKKYNLPGKSAPLSSEFYTGWLTHWGESMATTDATSTAKALKTILCRNGSAVLYMAHGGTNFGFYSGANTGQDEYDYKPDLTSYDYDAPIKEHGDVHN

SEQ ID NO: 35912 - DNA, 577 bp, Panicum virgatum
  misc_feature: Ceres CLONE 1963991-R
  misc_feature: Encodes the peptide sequence at SEQ ID NO. 35913
gaattttatgaaggccatttccatattgactctgagagtgagataaaggatacatttatatcatttcgtggttggaacaagggtgttgtttttgtgaacaacttcaacattggaagattttggccggcacgtggaccacagtgtgccctttatgttcccgggccaatcctcagacctggagacaacgtcattgtaatctttgaactgcacggtccaaatcctgagctcaccgtcaactttgtaacagatccagatttcacatgcggtccaaaacagtaacaatggtagcacgtggtgtgcagagcacggtgcagcggatttggtctccttcctctcgcttctcacctcgacgttagtgcttgtgtgctgccatccaaaagatgcaaggttccccttcgctttgcgccactcatagcatcttcacgccatgattagcagagcagggttcattctctagatccctcgtcgtatatgttgatccacggtacatccatcgctcgctgtactgaacattgtattctcagatctgggagtcaccattttagcagagatgaatctacgtgatccccatttcagc

SEQ ID NO: 35913 - protein, 92 aa, Panicum virgatum
  misc_feature: Ceres CLONE 1963991-R
  misc_feature: SWISSPROT Homolog: EC 3.2.1.23 Beta-galactosidase
  misc_feature: Functional homolog of the protein sequence given in SEQ ID NO 51507
  misc_feature: Useful for making plants with altered cell wall content and/or composition
EFYEGHFHIDSESEIKDTFISFRGWNKGVVFVNNFNIGRFWPARGPQCALYVPGPILRPGDNVIVIFELHGPNPELTVNFVTDPDFTCGPKQ

SEQ ID NO: 35914 - DNA, 554 bp, Panicum virgatum
  misc_feature: Ceres CLONE 1964004
  misc_feature: Encodes the peptide sequence at SEQ ID NO. 35915
agattctgtttaacttttttattttatcccaagagcctttagaaatctatcaatcttattcgtcaaaatggaaccacaaactgaagaagtcaccgcggctgttgaagaaagtaaaaccgagacctacaagagctacctgattctacacaatgtcggaaaaaagaagaatgtaggaaccatcgttaggagtgcttgtgctttcaatttggagaaagttttcctggtctcaaagggagtcggcactaagaagtataagcctgaaaaagatttcaacttctttggaaatcagaacacagcagcccagattgactattacgcttttggttctttgaaggaagctaaggaatattttgtgcagaataaaatatatgtctgcggtattgagattatggagagtgcacagagtataaataagcatccctttttgggcagcacagcctttctccttggaaatgaaggaacgggtttgacagatcagcaaaaagcaatatgcgaccacttcgtgtacattcctcaatacaccaacaaaactgcaagtcttaatattgccgtag

SEQ ID NO: 35915 - protein, 162 aa, Panicum virgatum
  misc_feature: Ceres CLONE 1964004
  misc_feature (21)..(162): Pfam Name: SpoU_methylase Pfam Description: SpoU rRNA Methylase family
MEPQTEEVTAAVEESKTETYKSYLILHNVGKKKNVGTIVRSACAFNLEKVFLVSKGVGTKKYKPEKDFNFFGNQNTAAQIDYYAFGSLKEAKEYFVQNKIYVCGIEIMESAQSINKHPFLGSTAFLLGNEGTGLTDQQKAICDHFVYIPQYTNKTASLNIAV

SEQ ID NO: 35916 - DNA, 720 bp, Panicum virgatum
  misc_feature: Ceres CLONE 1964004-R
tcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttc

SEQ ID NO: 35917 - DNA, 1400 bp, Panicum virgatum
  misc_feature: Ceres CLONE 1964005
  misc_feature: Encodes the peptide sequence at SEQ ID NO. 35918
gaaaaagaagggcaaaggcctcccctctctctctctctctctggtgcggcggtgccagagagagggagactggaagaagaggaggaaagtgaagcggaagggaggagtagcgagaggaaggcgaagggggccatggcgaggaagcatggctggcagctccccgcgcacacgctccaggttgtcgcaattacggttttcttgcttcttgtggtcgcattttatgcgttctttgcaccatttctagggaagcaagtcctagaatatgttgcaatcggcacctatactttcatggcattcgctgtcttcatcctttatatccggtgcactagcataaaccctgcagatcctgggatcatgtcacagtttgaggatggcttcattgatgcacctggaagtactgctgacatacagggcactaatttgccagcaaaaactgatactgctgctggcacaaactccccaacatctacttataggagctctctagatggccgttctaatcgtggtggtttagctgttggagacgcaaatatagatctagggtcccaaccaccaagaagttcaaggagctgcttacttggagggcttgtttgtgctttgtttatcaaggaggattgtaggaaatttgatgattcagagaatcaagtggacggtgaagatgccttgttttgcacattatgtaatgctgaggttcgcaaattcagtaaacattgcaaaagctgtgacaagtgtgttgacggatttgatcatcactgtcggtggttaaataactgtgttggacggaagaactatttcacttttcttgctctgatgactaccagtctcctctggcttgccattgaaattggagtaggcattgctgttcttgttatatgcttcaccaacaagaattcagagagaattatccaagacaagcttgagaatggcttacctcgtcctgcctttgctaccattgtcgcctttttcactcttctttctctagttgcttgtgtacctttaggggaacttttcttcttccacatgatcttgatcagaaaggggatcacaacttatgaatatgttgttgcaatgagagctatgagtgaagcaccacaagaggaagaggaccaggaggaggtaaacattgtttactccccaacaaattcagccactactgggttcagtggtgctagttcacttggtcttcactacaagggttcatggtgcacacctccaaggatttttgttgataaggatgaggtgatcccacatttggagccaggcatggtaccatcaaccgtcgaccctgatgctgtgagacacactgaaagagcaaacaaagccaagaagcaagtcaaaatcagtgcctggaagctttgcaagctggacagcaatgaggcaatgaaagctgcagcgaaagc

SEQ ID NO: 35918 - protein, 422 aa, Panicum virgatum
  misc_feature: Ceres CLONE 1964005
  misc_feature (169)..(233): Pfam Name: zf-DHHC Pfam Description: DHHC zinc finger domain
MARKHGWQLPAHTLQVVAITVFLLLVVAFYAFFAPFLGKQVLEYVAIGTYTFMAFAVFILYIRCTSINPADPGIMSQFEDGFIDAPGSTADIQGTNLPAKTDTAAGTNSPTSTYRSSLDGRSNRGGLAVGDANIDLGSQPPRSSRSCLLGGLVCALFIKEDCRKFDDSENQVDGEDALFCTLCNAEVRKFSKHCKSCDKCVDGFDHHCRWLNNCVGRKNYFTFLALMTTSLLWLAIEIGVGIAVLVICFTNKNSERIIQDKLENGLPRPAFATIVAFFTLLSLVACVPLGELFFFHMILIRKGITTYEYVVAMRAMSEAPQEEEDQEEVNIVYSPTNSATTGFSGASSLGLHYKGSWCTPPRIFVDKDEVIPHLEPGMVPSTVDPDAVRHTERANKAKKQVKISAWKLCKLDSNEAMKAAAK

SEQ ID NO: 35919 - DNA, 555 bp, Panicum virgatum
  misc_feature: Ceres CLONE 1964005-R
cactgcaggagagagaaggcgaaccgccgcgtccttcccagtgttttgctccaggaacgtttcagacgaacccaccgccgttcaacaggtgagctcatggtacttgtttgctgacagataactacaccgacaacaggggtaagatgatcgctggcttcactgctgggtgacataataagagttctgaacagctgctggcagacttctccactgtcttaaggatcatcaaagattccagcagagcagcatctgtcggaaaaccatcggaaagagtcagcagggctgatctttacactgaagcttgactggaacgaaaactggaagcatgacagttagaggaaccaatcggttgcgacttgcgatgtaaattctttgctcgttaattatgggtagcatttttatccagcattttagtgcttgaatgctctggttcaacaggacgagggtgcctgaaattcatgtggttccaagaaaacctgcagagttgttgctcgggtaaatcacttgttattgtagtcacagtttatactttatagagaatgcagtacatcttat

SEQ ID NO: 35920 - DNA, 633 bp, Panicum virgatum
  misc_feature: Ceres CLONE 1964012
  misc_feature: Encodes the peptide sequence at SEQ ID NO. 35921
accgggggaagaagggaagcttcacgccttcacctcaccactccccccactccactctctctccttcccctctttctccccacacacacggaaacagccactcctcacctcccccaccctccggttcatgtcctgctgctccccatgtcgcccccactcgagctcgactacataggactctcgccgccggaggtcgccgccgacgacctgaagggcaccgagctccgcctcggcctgccggggtccgagtcgccggagcgccgcgtcgcggctgccaccgcgaccaccctggacctgctcccagccaagggcgccaagcgcgggttctccgacgaggtgccgccgccgtcgcccgccgccgctgcgggcaagggcaagaaggtggcggacgaggaggacgacgacaagaaggtggcagcgaccccgcagccggccgccaaggctcaggtggtgggatggccaccaatccgcagctaccgcaagaacacgatggctactacccagcagaagggcagcaaggaggatgctgaggccaagcagggccaagggttcctctacgtgaaggtcagcatggatggcgccccgtacctcaggaaaattgacctcaagacatacaagaactacaaggatctc

SEQ ID NO: 35921 - protein, 162 aa, Panicum virgatum
  misc_feature: Ceres CLONE 1964012
  misc_feature (21)..(162): Pfam Name: AUX_IAA Pfam Description: AUX/IAA family
MSPPLELDYIGLSPPEVAADDLKGTELRLGLPGSESPERRVAAATATTLDLLPAKGAKRGFSDEVPPPSPAAAAGKGKKVADEEDDDKKVAATPQPAAKAQVVGWPPIRSYRKNTMATTQQKGSKEDAEAKQGQGFLYVKVSMDGAPYLRKIDLKTYKNYKD

SEQ ID NO: 35922 - DNA, 1447 bp, Panicum virgatum
  misc_feature: Ceres CLONE 1964033
  misc_feature: Encodes the peptide sequence at SEQ ID NO. 35923
gagattccccccccccgattccactccaagcactccaccactccaccacaccctttcctcccccgcagaccctccccgcgccgcctccttctccacctccggcgacgcgcggcggtcgccccccctccgcacccgccgcctgccatcccctccccgaccaaggatctgcgccgccgccgcccgctcccttgccgcgcgccgttcccccccttgattcgcgccgtcgctggcgtagcgcccccggagtcgcgccgccccgccacccctgccctctcccgccgctgccgacgcccctgccatccccccggaccgaagcaacgccgcctgcctctcccttgctgtgcgccgctgcctcccccttttggaaatcaggagctatatgagcagctgagaagttgagttttgaggccattgggtactctcaggagaagtgcattgatagcctgaccattaacttcttaagatggctacacagttaccatgctttacacagctcagtccaccatcttctagttggggaaacgaagctgcaagctgcaaggatacatctggtagggcatttgtcagaagtactcgagctttgggtcattgtcacttccggtgctgtgcaaggccccgcagtggcaactctttccagaagaaagactcgttccttgaccttcatccagaggtgtctctgctccgcggtgagaagaatgttgaggttgtggacccattgaaaggtgcttctgatggaagtccgttagaggggctgggagtgccaccagaccggagtgattataatgaggccaaaatcaaggttattggagttggaggtgggggttcaaatgctgtcaacaggatgattgagagtgctatgcatggtgttgagttttgggttgtgaacactgatgtgcaggcgataagaatgtctcctgtgcttcctcacaataggctgcagattgggcaggagctgactcgaggtttgggtgcagggggaaaccctgatattggtatgaatgcagcaaaggagagcagtgaatccatacaggaagcactttatggtgctgacatggtttttgtgacggctggaatgggtggagggactggaactggaggtgctcctgtaattgctggaattgccaagtccatgggtatacttactgtcggtattgtcactacgcctttctcatttgaggggaggcggcgggcagttcaagcacaggaaggaatagcagctttgcgaaacagtgtggacaccctaattgtcatcccaaatgacaagttgttatctgctgtttctccaaatactcctgtaacagaagcattcaatttggctgatgatatccttcgacaaggcattcgtggcatttctgatatcattacggttcctggattggttaatgttgattttgctgatgtacgtgccatcatgcaaaatgcagggtcatctttgatgggtataggg

SEQ ID NO: 35923 - protein, 327 aa, Panicum virgatum
  misc_feature: Ceres CLONE 1964033
  misc_feature (109)..(304): Pfam Name: Tubulin Pfam Description: Tubulin/FtsZ family, GTPase domain
MATQLPCFTQLSPPSSSWGNEAASCKDTSGRAFVRSTRALGHCHFRCCARPRSGNSFQKKDSFLDLHPEVSLLRGEKNVEVVDPLKGASDGSPLEGLGVPPDRSDYNEAKIKVIGVGGGGSNAVNRMIESAMHGVEFWVVNTDVQAIRMSPVLPHNRLQIGQELTRGLGAGGNPDIGMNAAKESSESIQEALYGADMVFVTAGMGGGTGTGGAPVIAGIAKSMGILTVGIVTTPFSFEGRRRAVQAQEGIAALRNSVDTLIVIPNDKLLSAVSPNTPVTEAFNLADDILRQGIRGISDIITVPGLVNVDFADVRAIMQNAGSSLMGI

SEQ ID NO: 35924 - DNA, 691 bp, Panicum virgatum
  misc_feature: Ceres CLONE 1964033-R
ttgctactggattcaagcggcaggatgaaccagaggatcgcaccccaaagggcggccagcagatccaaggcgagaatggccgacgcccatcctccgcagagggcagtatggtggagatccccgaattccttcgacgaagaggcccttctcgcttcccacgagtttgaaccaggcttcccccttctcccgccctgtatgatatacctccgttaggtcagatggctcctgcaaggctccgaagccttccagactaggtgtcgtagtggttcttgttcagttttgtttgctccttcgtctccagtctttcagtcaataatgtgtagaagtgagcttgctagtgctatagaaaaatgtgttcccttttacactgatctgcttgacattgtctgtcgtgccctgattccttcagctggccggcacttcagctgaaaacatctgtttgtcttagttaaggtccattttggtgttcctgtggtgtgccgcgacgacgagcctagcttgttccgttatgggatcctcaaaggccatggcagcgtcaccttagcacctcttgtggtgcttctccggcacactggtagggtcctagggtgtaagcgccgccgcaacaccattatttatgttgtgaaagcataagaatagaagaaccaaatatgaggaattattttttattctatgaatatcgatgatttac

SEQ ID NO: 35925 - DNA, 588 bp, Panicum virgatum
  misc_feature: Ceres CLONE 1964044
  misc_feature: Encodes the peptide sequence at SEQ ID NO. 35926
aactcaaccaagctgctcccaactctccacaccctgacacccatctctcttctcttcatcacattgctctcttctctgcgtcacattacgagctgcaagcctgcaaacactctctctgcacctcttggcattgggcgccgtcgggcattgtcaccgttgagcagcatcatcgtctccatggaaccgatctcggcgtctgtgagtgtgccccggcccgcgtgctcggcgtacgggcggcggcggcgggcgacggcggcgaagcccgtgggcggcctcgccgggcggtgcaacgccgtgctgaagcagcacaagacgaggctgtacatcctcggcaggtgcgtctccatgctcgtgtgctggcgcgaccacgacgccgactgacctcttggcatcggccggcagcgcgagcgagcttgctggaggggatcggccggtctgaccatgttgggtttcggtgtgtagggcggcttgaaatactttagagaggctagtgcgaaacagtaatgtggtgtattgcagtaaactggttgctaaattggactgattataggtgatggtgaagtgatgaagtccagaagtgtaaatgaa

SEQ ID NO: 35926 - protein, 67 aa, Panicum virgatum
  misc_feature: Ceres CLONE 1964044
  misc_feature (42)..(60): Pfam Name: DVL Pfam Description: DVL family
MEPISASVSVPRPACSAYGRRRRATAAKPVGGLAGRCNAVLKQHKTRLYILGRCVSMLVCWRDHDAD

SEQ ID NO: 35927 - DNA, 645 bp, Panicum virgatum
  misc_feature: Ceres CLONE 1964048-R
  misc_feature: Encodes the peptide sequence at SEQ ID NO. 35928
aaggttgaccgcagtggagcctacgttgctaggcaggctgccaagagcattgtcgctaacggccttgctcgccgcgccatcgtccaggtctcctatgccattggtgtgcctgagccgctctccgtgtttgttgacacatacggcactggcgcgatccccgacaaggagatcctcaagattgtgaaggagaacttcgacttcaggcctggcatgatcatcatcaacctcgacctcaagaaaggtggcaacgggcgctaccttaagacagcagcctacggtcactttggaagggatgaccctgacttcacctgggaggtggtgaagcccctcaagtgggagaagccttctgcctaaggcgcccttttggaagaagcttttggtctgccacgcttatcatgttttgtggctcctgtgttgtgattcttgatctgccccttgctgtcatttgtattgtactgtcctaataagtggtacttgtgagggtattactgtgtctggttatttacgtagaggaggatttattgtctaatgtttctggttttgttagaggaggatttattgtctaatgtttctggttttgctacatatgtaatggtgaatctacaggttactttgggaagaaatggaacctgctgctttctggtt

SEQ ID NO: 35928 - protein, 117 aa, Panicum virgatum
  misc_feature: Ceres CLONE 1964048-R
  misc_feature (1)..(106): Pfam Name: S-AdoMet_synt_C Pfam Description: S-adenosylmethionine synthetase, C-terminal domain
  misc_feature: SWISSPROT Homolog: EC 2.5.1.6 Methionine adenosyltransferase
  misc_feature: Functional homolog of the protein sequence given in SEQ ID NO 50364
  misc_feature: Useful for making plants with modulated biomass
KVDRSGAYVARQAAKSIVANGLARRAIVQVSYAIGVPEPLSVFVDTYGTGAIPDKEILKIVKENFDFRPGMIIINLDLKKGGNGRYLKTAAYGHFGRDDPDFTWEVVKPLKWEKPSA

SEQ ID NO: 35929 - DNA, 1445 bp, Panicum virgatum
  misc_feature: Ceres CLONE 1964048
tgatctacaaacaagccacacgctcccaaacgctttttttgctaggcaagctgcacgtgctgctttaggattgctgagagattttctttaagcaagctgctgaaatttttgagctgctgcttctttattataatatgttcctgttccgtgatgttccctaatagatgttactttttaacttacagtaggtgtggaagcatgcttgattgattaatctgttcctaggagctcatttgacaacttgttgcgtttatgctgattcgttccagaccttttagtttccttgtgcttcgcatccactagccacacgtatggaccatactcttgcgccggtggatcagaaataccaaaccttgtttttgaggattttgtttgactttgcatgacgaatctctcgtcctgcagtgtgtggccttgttatgtgccaacaatacagaatgttttatgcgccataagatacaaagatgccctttttgtgcttgtttactagcctaacttttcttttcttttttaattattgtctttagtccatgagactataggacaaattctgctaatcctttttttgactaaaaggagtacaatgtttcctggaaagctgattatcctgtcagtgtgctatataaacgttttgacaaattgttagctatttgtcttacatataggagccagtctcggttttgtcgatccagcaattgctttgatcacgataattcttagtttgtcaaccatattgtctgcaactaaacatttgtattgtctgctgcagatcagagaagatggccgcagttgacaccttcctcttcacctccgagtccgtgaacgagggacaccctgacaagctctgcgatcaggtctcagatgctgtgctcgatgcttgccttgctgaggaccccgacagcaaggttgcttgcgagacctgcaccaagactaacatggtcatggtctttggtgagatcaccaccaaggccaatgtcaactacgagaagattgtcagggagacttgccgcaacattggtttcgtgtcagcagatgtcgggcttgatgctgaccactgcaaggtgctcgtgaacattgagcagcagtcccctgatattgctcagggtgtgcatggccacttcacaaagcgccctgaggagattggagctggtgaccagggacacatgtttgggtatgctactgatgaaacccctgagctgatgcccctcagccatgtccttgccaccaagcttggtgctcgtctcactgaggtgcgcaagaacgggacctgcccctggctcaggcctgatggaaagacccaggtgactgttgagtaccgcaatgatggtggtgccatggtgcccatccgagtccacactgtcctcatctctacccagcacgacgagacagtcaccaacgatgagattgccgctgacctcaaggagcatgtcatcaaacctgtcatc

SEQ ID NO: 35930 - DNA, 648 bp, Panicum virgatum
  misc_feature: Ceres CLONE 1964057
  misc_feature: Encodes the peptide sequence at SEQ ID NO. 35931
agagcattggaatcaatagcaattgcgtgctccgcagaccgcacccgcacgccaaccgccaccgccgccggctcgccgccgattcgagggttcgttccgggagaaggcagatcggttccgcgatggagtgcatcgccgagatgccgcccgcgccgctggaccgccgcccgcgcaagcggcagcgtctggggtgggacgtcggtcccgccgagatgcatcaggttcagcttggactttgtgggcaagaagttgtgaatgccataagtgctgtggcattgggtctctcttcaggtggtattgtctcctctcagctcaaccaagggcagcctcgtgagggttcccctccactgagagatgatgacaaggatgggcattatgtgtttgctgttggagataaccttacacctcgctataagatcaatgcaaaaatgggtgaaggtacctttggtcaggtgttggagtgttgggacaaggaaaggaaagaaatggtggctattaagatcatcagaggcattaagaagtacagagatgctgcaataatagaaattggcatgctcgagcggcttggtaaatacgatgaaagtagatccagttgtgttcaaattcggaactggtttgactatcgtaaccatatctgtattgtctttg

SEQ ID NO: 35931 - protein, 175 aa, Panicum virgatum
  misc_feature: Ceres CLONE 1964057
  misc_feature: SWISSPROT Homolog: EC 2.7.12.1 Dual-specificity kinase
MECIAEMPPAPLDRRPRKRQRLGWDVGPAEMHQVQLGLCGQEVVNAISAVALGLSSGGIVSSQLNQGQPREGSPPLRDDDKDGHYVFAVGDNLTPRYKINAKMGEGTFGQVLECWDKERKEMVAIKIIRGIKKYRDAAIIEIGMLERLGKYDESRSSCVQIRNWFDYRNHICIVF

SEQ ID NO: 35932 - DNA, 695 bp, Panicum virgatum
  misc_feature: Ceres CLONE 1964074
  misc_feature: Encodes the peptide sequence at SEQ ID NO. 35933
tccgagtctcgagcccgtcaccgccgccgccgctccaacccgatcccgccgccccacctgccgccgcatcgcccctagccgtcggactcgctcccggtactcccggaatcaacaagaactagtttttcccttcttgatcctccctgagcagcgagtcccatccccatctcccaccaagaaaccctaagacccccctgctaaggggcgaggaggccatgagggggaagaagccggtgaaggagctaaagctcgacgttccggcgcaggagacccccgtcgacaagttcctgacggcgagtggcacattcaaggacggtgaactgcggcttaatcaaagaggcttgcggcttatctccgaggaaaatggcgatgaaaatcaatcaacaaacctgaaggtggaagatgtacagttatcaatggatgatcttgagatgatccaagtcattggtaaagggagtggtggtgttgtccagctagtgcggcacaaatgggtggggacattgtatgccttgaagggtattcaaatgaacattcaagaatcagtgcgcaaacaaatagtgcaagagctcaaaattaatcaagcaacacagagtccacatatagttctgtgccatcaatctttttaccacaatggtgtcatatatcttgttcttgagtacatggatcgtggatctcttgcggacatcattaaacaa

SEQ ID NO: 35933 - protein, 159 aa, Panicum virgatum
  misc_feature: Ceres CLONE 1964074
  misc_feature: SWISSPROT Homolog: EC 2.7.12.2 Mitogen-activated protein kinase kinase
MRGKKPVKELKLDVPAQETPVDKFLTASGTFKDGELRLNQRGLRLISEENGDENQSTNLKVEDVQLSMDDLEMIQVIGKGSGGVVQLVRHKWVGTLYALKGIQMNIQESVRKQIVQELKINQATQSPHIVLCHQSFYHNGVIYLVLEYMDRGSLADIIK

SEQ ID NO: 35934 - DNA, 1296 bp, Panicum virgatum
  misc_feature: Ceres CLONE 1964089
  misc_feature: Encodes the peptide sequence at SEQ ID NO. 35935
aaaaagaggagagagagagacagagagaggaacaggtggtggtgaagagaggagaggagaggagaggagaggagaagtggtcacagacagaagagaagatcaaaagagatcgagagatgcagcgcgagttcgagctgctgcagcaggagcacagccaagaaagcagcagcagcaaccgcttccactacccctccccctgactctctcagcctgtgcgggcggctcagtccaagcaagctcaggagcgagaccgcagcaaagcaggctgtgctccgtccgtgctggcctccctctctcccctcccctccgatccgccgtctaattcggcagctccgatccaccaccctagctagcagcgacttaaggccgctaggggacggatcaggagatcggcgcggccgggccacggggcggcggccggccatggaggacaccctcaagtcgctgtccatggactacctcaacctgctcatcaacgggcaggccttcagcgacgtcacgttcaacgtcgagggccgcctcgtgcacgcgcaccgctgcatcctcgccgcgcgcagcctcttcttccgcaagttcttctgcggcgccgccgccgccgaccaggccgccgcgccggggcccggcgcgctgctgctggaccacctcagcccgcgctcgccttccggcgcctcggcgtcctccccgcgcggcgcgggcgcctccacggcagcggcggcggcggcggccgcgccgggcgccgtgatacccgtgaactcggtgagctacgaggtgttcctgctgctgctccagttcctgtacagcgggcaggtgtccctggtgccgcagaagggggagccccggccgggctgcggcgagcgcgggtgctggcacacccactgtgccgccgccgtcgacctcgcgctcgacaccctcgccgccgcccgctccttcggcgtcgaggagctcgccctcctcacccagaagcagctggccgggatggtggagaaggcgtcgatcgaggacgtgatgaaggtgctcatggcgtcgcggaagcaggacctgcaccagctctggaccacctgctcccacctcgtcgccaagtccggcctcccgccggaggtgctcgccaagcacctgccaatcgacgtcgtcgccaagatcgacgagctccgcctcaagtcctcgatgtcccgccgctcgccgttcctggcgcaccaccatccgaaccactcggcggcgggcatcgagacctcgtccgcgggggagttcgacgaccaccacaagatccgccgcatgcgccgcgccctcgactcgtcc

SEQ ID NO: 35935 - protein, 290 aa, Panicum virgatum
  misc_feature: Ceres CLONE 1964089
  misc_feature (13)..(175): Pfam Name: BTB Pfam Description: BTB/POZ domain
MEDTLKSLSMDYLNLLINGQAFSDVTFNVEGRLVHAHRCILAARSLFFRKFFCGAAAADQAAAPGPGALLLDHLSPRSPSGASASSPRGAGASTAAAAAAAAPGAVIPVNSVSYEVFLLLLQFLYSGQVSLVPQKGEPRPGCGERGCWHTHCAAAVDLALDTLAAARSFGVEELALLTQKQLAGMVEKASIEDVMKVLMASRKQDLHQLWTTCSHLVAKSGLPPEVLAKHLPIDVVAKIDELRLKSSMSRRSPFLAHHHPNHSAAGIETSSAGEFDDHHKIRRMRRALDS

SEQ ID NO: 35936 - DNA, 669 bp, Panicum virgatum
  misc_feature: Ceres CLONE 1964089-R
ccgcacgctcacctccgatttcctgtcaaagggcgccgtgccggggctcgcgcacatcgagcccaacaagctccggctgtgcctcgagctcgtgcagtcggcggccatggtcatgtcccgggaggacgcgcacactgcggccgcggcggtcaatgccgcgcccatgtacagagagccttccgggggcgccggccccgtgtacaatgcgagcggcaccaactcgagcatggtgaatctgagcttggacaacaggatggtgtatctgaacctagggatggatgcgcagttcggcaagatgagcgacggcggcgacggcgatgacggcgggagcagagggcaaggaggcccgtcttctttgttttccccgcatggctaccattgacaagccggagcgagcggctgctctactatctccttgtaagcttagaactaattaattacatgttattcatatccacattaattacaggagatgatgagacaatccttttgctgccatatatatatcatcctctcatctgactcttggtagagattaatttatatattagagagggacgttcatgcaaatgatacatcacaagagtatctttgtgggctactaatcttaattgtggtgtcttgtagttgaggggtgctgttttggaaatttaagaggtgtcaagaggt

SEQ ID NO: 35937 - DNA, 552 bp, Panicum virgatum
  misc_feature: Ceres CLONE 1964090
  misc_feature: Encodes the peptide sequence at SEQ ID NO. 35938
acctggtccaattcaaaccaattttcccttccggctcggggcacctcccgtccaaccaccaccaaagggaataaccaaccaacctcaaatttcggccggcccgccaatgaaggtcaattgccggcccctgaagggaaaggtggccgcctggacgccttccccccagggaatcggcccccccttccccaaccgtctcggcctgaagggccccccctcctccttctcctcccgaaaccaaaaaaccttgaacaacccgtggaagggcttcaaggcaaagggaatccccgcggtcggccccttctgccacttctccaacccccaccaccccagaaccctcttcaacccggcatccaaaacctttgaaccctttgtttttcttgtctcgaaggcccctgcaattcctcctgtaaatggctttcttgaattgaaaaaggctgttcttgataaactatggaatattaccgccaaggcttctattcttcttcttcagggggccaatttcttcttcttgctttacaccctctccaaataaggttaacttcatttccttcc

SEQ ID NO: 35938 - protein, 141 aa, Panicum virgatum
  misc_feature: Ceres CLONE 1964090
  misc_feature: SWISSPROT Homolog: EC 1.1.1.184 Carbonyl reductase (NADPH)
MKVNCRPLKGKVAAWTPSPQGIGPPFPNRLGLKGPPSSFSSRNQKTLNNPWKGFKAKGIPAVGPFCHFSNPHHPRTLFNPASKTFEPFVFLVSKAPAIPPVNGFLELKKAVLDKLWNITAKASILLLQGANFFFLLYTLSK

SEQ ID NO: 35939 - DNA, 589 bp, Panicum virgatum
  misc_feature: Ceres CLONE 1964109
  misc_feature: Encodes the peptide sequence at SEQ ID NO. 35940
gaaatcctccgggcgggcgcttctcgctctcatccgttggccattccgcccatctctctccctccctccctccctcctaggagggggcgagcgatccccaaccatagccaagctcgccgcatccccaatccctgacccaagcgcagctcgttgttgtatgtcgcagagcgtcgccaatccggccagacccgccggttcgagggttccgatggagaaccaggaggcggcggccgcgcaccagcagaaggacagcgtgaaggtggccgtcaacataaggccgctcatcacggtggagctgcaggacggctgcacggattgcgtcaccgtcacccccggcgaaccgcaggttcaaattgggccgcatgtgttcacctttgatcacgtttatggcaactcggcccctccatcgtcactaatattcgagcaatgtgtgaacccgctgattgacgcattattcagtggatacaatgctactgttctagcatatggacagacgggttcaggcaagacgtacacaatgggtactgattatagtggtgaaggtaactgtggagggataattccacaagttatggagaccattttcaga

SEQ ID NO: 35940 - protein, 126 aa, Panicum virgatum
  misc_feature: Ceres CLONE 1964109
  misc_feature (21)..(126): Pfam Name: Kinesin Pfam Description: Kinesin motor domain
MENQEAAAAHQQKDSVKVAVNIRPLITVELQDGCTDCVTVTPGEPQVQIGPHVFTFDHVYGNSAPPSSLIFEQCVNPLIDALFSGYNATVLAYGQTGSGKTYTMGTDYSGEGNCGGIIPQVMETIF

SEQ ID NO: 35941 - DNA, 399 bp, Panicum virgatum
  misc_feature: Ceres CLONE 1964117
  misc_feature: Encodes the peptide sequence at SEQ ID NO. 35942
acgcacgaccaaccaaagcctcctccaaaccctcgccgactcagcagatccctccgccgccgccgccatgccgttcaccccgggcccctactccggcgtcagcaccctcgccctcgtggcgcgagcgtcggccttcggcgtcggcgtcgtctacgggaccatcaagctctcggtcctcaaggccacaaaacctaaaaaggaggatgctcatgccgctgctcaccactaaggactaggatgcaacatggtggctccaagggaaggatgtgatctggaaatgtacccgtccttgatgcgagcagttggtttatgatttgtgtagacgtcttgtttgaaacccacatgggaggttatcttaattttggttcataataagttttaaattgacttgaaakccgc

SEQ ID NO: 35942 - protein, 53 aa, Panicum virgatum
  misc_feature: Ceres CLONE 1964117
  misc_feature: Functional homolog of the protein sequence given in SEQ ID NO 51508
  misc_feature: Useful for making plants with altered carbohydrate content
  misc_feature: Functional homolog of the protein sequence given in SEQ ID NO 51509
  misc_feature: Useful for making plants with altered cell wall content and/or composition
MPFTPGPYSGVSTLALVARASAFGVGVVYGTIKLSVLKATKPKKEDAHAAAHH

SEQ ID NO: 35943 - DNA, 685 bp, Panicum virgatum
  misc_feature: Ceres CLONE 1964127
  misc_feature: Encodes the peptide sequence at SEQ ID NO. 35944
acaccgcctctctgcagcctctctctctctctctggcgctgctgaatcttgagagagtgagaggtggtagctcccgttgttttcgctgcagattttggctgcggcgccgcgtcctctgcggttctgtcccccatgcttcaccaccaacccaacccaagaggggaggctgataccctgcccggcggctcggttctgagctggactgaactgaactggagagagagcacagtccggaatatgtttggtttctcgcggcgccgggtgaaacttggaaggttgaagggtgaccataatgattctttgaatagctccaggagtcttggtggccccacgaaacagctcagcctacctaatggggatgacgctgctacaacatcagtgagcggccgtgcagatgatctttcctaccgctgctcttcagatactttcaatctcgacagtcgttctttcaatatttctgaaaactggactgtgttgtccacagagggagacaaacctattcctcgtttctatcatgcagcggccattgtaagtagcaagatggtagtgtttggtggtgattctggtcgtcacttattaaatgatacaaagatactgaatttagagaagcttagctgggattctgcaccgcctaaagttcggccctcaccaagtggacgttctaccaagttgccagcttgcagag

SEQ ID NO: 35944 - protein, 184 aa, Panicum virgatum
  misc_feature: Ceres CLONE 1964127
  misc_feature (124)..(169): Pfam Name: Kelch_2 Pfam Description: Kelch motif
MLHHQPNPRGEADTLPGGSVLSWTELNWRESTVRNMFGFSRRRVKLGRLKGDHNDSLNSSRSLGGPTKQLSLPNGDDAATTSVSGRADDLSYRCSSDTFNLDSRSFNISENWTVLSTEGDKPIPRFYHAAAIVSSKMVVFGGDSGRHLLNDTKILNLEKLSWDSAPPKVRPSPSGRSTKLPACR

SEQ ID NO: 35945 - DNA, 370 bp, Panicum virgatum
  misc_feature: Ceres CLONE 1964134
  misc_feature: Encodes the peptide sequence at SEQ ID NO. 35946
gcctgccggagggggaggagaagctggacatggccgagaccttcgggctcgcgctgcccaaggccgtgccgctccgcgccgtcgtcacgccgcgcctcgtgccggaagcctacgcctgagctgctgattgtaagctgtggatacacgcggctgcatatggacatgcgcgcgtgttggtgtacaaggatggtcgtatggtttttggtgttgcctagctacctgcgtacatatatattctgttatacggtcgatgatcgtacactcgattgcctggtagcatttgaactttgggttcggtcacctccggtttcagcaatcagctgatgaagatttgatcactttgagttcaacgtgaaccagcgtggtggcc

SEQ ID NO: 35946 - protein, 38 aa, Panicum virgatum
  misc_feature: Ceres CLONE 1964134
  misc_feature: SWISSPROT Homolog: EC 1.14.13.88 Flavonoid 3',5'-hydroxylase
  misc_feature: Functional homolog of the protein sequence given in SEQ ID NO 51510
  misc_feature: Useful for making plants with modulated cold sensitivity
  misc_feature: Functional homolog of the protein sequence given in SEQ ID NO 50304
  misc_feature: Useful for making plants with altered carbohydrate content
  misc_feature: Functional homolog of the protein sequence given in SEQ ID NO 50717
  misc_feature: Useful for making plants with altered lignin content
LPEGEEKLDMAETFGLALPKAVPLRAVVTPRLVPEAYA

SEQ ID NO: 35947 - DNA, 574 bp, Panicum virgatum
  misc_feature: Ceres CLONE 1964163
  misc_feature: Encodes the peptide sequence at SEQ ID NO. 35948
gaccccaatcaatcaacctagttcccacttgcattcctccgtcccgcccgccgcgcgcgcttcaccttgggttgaaaatccgggagccagggttgctgaaactgttgtcctcaaggtgactatgtcttgcaagggttgcgccggggcggtcaggaaattgctttcaaaaatggaaggatttaaaacctttgacataaacctcaaggagcaaaaggtgacattcaaaggcaaggtcaagcctgaaaatgtcttccaaacggtttccaagtcgggaaaaaaaacctcctacgggaagggcaaacccccacccccgtcggctccggctccattaccaaaaccacctctcaccaccaaggcaaaaccgcctgccgcgaaggctgcaccaaaaatcaccccattcaagcctgacccttgatcatcacatgaaatgctgtgacccctaaaccttactctaaaactagctggaaaaaccaagtcttgtgcaatttgcttcatgttgttgccactctagcaagtgattgcaaattataaaataaatgataaaaccccttatgtccgtacgtttgtgtgattt

SEQ ID NO: 35948 - protein, 137 aa, Panicum virgatum
  misc_feature: Ceres CLONE 1964163
  misc_feature (35)..(96): Pfam Name: HMA Pfam Description: Heavy-metal-associated domain
TPINQPSSHLHSSVPPAARASPWVENPGARVAETVVLKVTMSCKGCAGAVRKLLSKMEGFKTFDINLKEQKVTFKGKVKPENVFQTVSKSGKKTSYGKGKPPPPSAPAPLPKPPLTTKAKPPAAKAAPKITPFKPDP

SEQ ID NO: 35949 - DNA, 703 bp, Panicum virgatum
  misc_feature: Ceres CLONE 1964165
  misc_feature: Encodes the peptide sequence at SEQ ID NO. 35950
atggatagccagcagccagcgggggaggactgaggccgctcgccattgctcccatttgaggttattagactcgaagatcatgttctctgacttggtgcctctcggttttaaggtcgcacagcttgtcctacctggtgtagcttagcaacctgttcagcaaaatgaggccttcagatgacagggcgcagctctcaggctttgaacaatcagaagaatcaacacttgatgtggaggggcattgctaccaccaacagtcattcccttgttctccatcaatgcaaccaattgcttctgggtgcacacacacagagaatagtgcggcatacttcttatggccgacatcaaacctacagcattgtgcggctgaggggcgcgcaaactactttggcaacctttcaaaaggactccttcccaagtctggcaagttgccaaagggccagcaagcaaatagcttgcttgacttgatgactataagagctttccatagcaagatattacgctgttttagccttgggacggcagtgggatttcgcatcaggaaaggggttctgacagatatccctgctattcttgtctttgttgctcgcaaggttcacaagaaatggcttaatccgacccaatgccttcctgcaatcgttgagggtccaggaggtgtttggtgtgatgttgatgttgttgaattctcgtactatggtgcaccagc

SEQ ID NO: 35950 - protein, 180 aa, Panicum virgatum
  misc_feature: Ceres CLONE 1964165
  misc_feature: Functional homolog of the protein sequence given in SEQ ID NO 51147
  misc_feature: Useful for making plants with altered protein content
MRPSDDRAQLSGFEQSEESTLDVEGHCYHQQSFPCSPSMQPIASGCTHTENSAAYFLWPTSNLQHCAAEGRANYFGNLSKGLLPKSGKLPKGQQANSLLDLMTIRAFHSKILRCFSLGTAVGFRIRKGVLTDIPAILVFVARKVHKKWLNPTQCLPAIVEGPGGVWCDVDVVEFSYYGAP

SEQ ID NO: 35951 - DNA, 363 bp, Panicum virgatum
  misc_feature: Ceres CLONE 1964179
  misc_feature: Encodes the peptide sequence at SEQ ID NO. 35952
acttcgtcctctctctcccgcaacaatccacgcatccaccgacgcaacagcagcaggaatcaaccccgccgcacccaatccccagcaaaccgccgccggtgtgggcgccatgggcctccgcgccctgttcctcctctcgctcgccgcggcggcactggcggcggaacagcaacaacagcagcagccgcagccgcagccgcagcggccgcccgcattgccggccgctccggccgcgggcgcgccgggggtgagctccaactcggtgctggtggcgctgctggactcgcgctacacggacctggcggagctggaggagaaggcgctcctgctccaagcgctctaggacgccgtcggccagggcag

SEQ ID NO: 35952 - protein, 77 aa, Panicum virgatum
  misc_feature: Ceres CLONE 1964179
  misc_feature: Functional homolog of the protein sequence given in SEQ ID NO 51244
  misc_feature: Useful for making plants with altered carbohydrate content
MGLRALFLLSLAAAALAAEQQQQQQPQPQPQRPPALPAAPAAGAPGVSSNSVLVALLDSRYTDLAELEEKALLLQAL

SEQ ID NO: 35953 - DNA, 619 bp, Panicum virgatum
  misc_feature: Ceres CLONE 1964181
  misc_feature: Encodes the peptide sequence at SEQ ID NO. 35954
actctccctgccccgaaacaacaccatgtcgtcgtccaaggtcttcaccctcgaggaggtcgctaagcacaacaccaaggacgactgctggctcatcatcgctggcaaggtgtacaatgtgaccaagtttcttgaggatcaccctggaggtgatgatgttctgttgtcctccactgccaaggatgctactgatgactttgaagatgtgggccacagcaccactgctcgtgcgatgatggacgagtacttagtcggtgaaattgatgcaactacaatacccactaaagtgaagtacacgcccccgaagcagccgcactacaaccaggataagacccctgagttcatcatcaagattctccagtttttggcccccttggcgatattgggcttggctgtcgccgtaaggatctacaccaagtcggaatccacctaattattgtcatcacttggccaaagattacaactgaataagttagtgaggattgtacgagcgagcatgacctgtcatgaatttggaaactttagtctctgtgatggtatgattacgtgcaacatctattggtaaattgagactcgagtgaagtggatggatattcagttttatttttccttattcctt

SEQ ID NO: 35954 - protein, 135 aa, Panicum virgatum; identical to SEQ ID NO: 12038
  misc_feature: Ceres CLONE 1964181
  misc_feature: SWISSPROT Homolog: EC 1.7.1.1 Nitrate reductase (NADH)

SEQ ID NO: 35955 - DNA, 704 bp, Panicum virgatum
  misc_feature: Ceres CLONE 1964203
  misc_feature: Encodes the peptide sequence at SEQ ID NO. 35956
ctctcgaaaccctagtcccgctccaccccaccccccccccccccgccgccgcagctcccccgtctcgccccccacctccggccctcgcgaagcgcctcctcgaccgccgggagtgagagaagagatggcgggcaagggcgacgggccggcgatcggcatcgacctcggcaccacctactcgtgcgtcggcgtgtggcagcacgaccgcgtcgagatcatcgccaacgaccaggggaaccgcaccaccccctcgtacgtcgccttcaccgactccgagcgcctcatcggagatgccgccaagaaccaggtcgccatgaaccccatcaacaccgtctttgatgccaagcgtcttatcggcagaaggttcactgatgcttctgtccagagtgatatcaagctctggcccttcaaggtcatttctggacctggtgagaagcccatgattgttgtccagcacaagggtgaggataagcagtttgctgctgaggagatctcctccatggttctgatcaagatgcgtgagattgctgaagcttaccttggcagcactatcaagaacgctgttgtcacagttcctgcctatttcaacgactcacagaggcaggccaccaaggatgctggggtgattgctggcctcaacgtgctgcgtatcatcaatgagccgactgctgctgctattgcctatggtcttgacaagaagggcc

SEQ ID NO: 35956 - protein, 193 aa, Panicum virgatum
  misc_feature: Ceres CLONE 1964203
  misc_feature (9)..(193): Pfam Name: HSP70 Pfam Description: Hsp70 protein
  misc_feature: Functional homolog of the protein sequence given in SEQ ID NO 50336
  misc_feature: Useful for making plants with modulated heat sensitivity
MAGKGDGPAIGIDLGTTYSCVGVWQHDRVEIIANDQGNRTTPSYVAFTDSERLIGDAAKNQVAMNPINTVFDAKRLIGRRFTDASVQSDIKLWPFKVISGPGEKPMIVVQHKGEDKQFAAEEISSMVLIKMREIAEAYLGSTIKNAVVTVPAYFNDSQRQATKDAGVIAGLNVLRIINEPTAAAIAYGLDKKG

SEQ ID NO: 35957 - DNA, 685 bp, Panicum virgatum
  misc_feature: Ceres CLONE 1964214
  misc_feature: Encodes the peptide sequence at SEQ ID NO. 35958
accatcctcgactttctcctcgcacccgatctcgacgacgcgagcttgccgcacgcggaggccagcgccgccctcgccacgtagcgggcaccggcctgccccctctcaatcacccggatccgtcagctattttcgctaggatttcagcatgattgattctgttcatgacaatattgtgctggacaaatgtgtcaaggacatccttgcagtaatcaaaccagcagaggatgatagaagcaaaagactatccacaattcaggagctggaaaattgcatccattctcttgcatccttgacaggtgctgctgtcaaaccttttgggtcctttgtatcagatctttactcaaaatcgggtgacttagatttatccgttcagttcggaaatggttcaaacctccttataaacaagaaaaagaagcagaatgtcttgagagaagttaggagagctttacgaggtgttgctggatatattcagttcattcctcatgcaagagttccggtccttcaatatgtgagcaaccgctatggcatctcctgtgatatatcaatcaacaactttgctggtcgaattaaatccaaaatcttctactgggtgaatactttagatgagcggtttggtgatatggttttgctgatcaaggaatgggcaaaagctcaaaacattaatgatccaaagagtgggtcc

SEQ ID NO: 35958 - protein, 178 aa, Panicum virgatum
  misc_feature: Ceres CLONE 1964214
  misc_feature: SWISSPROT Homolog: EC 2.7.7.19 Polynucleotide adenylyltransferase
MIDSVHDNIVLDKCVKDILAVIKPAEDDRSKRLSTIQELENCIHSLASLTGAAVKPFGSFVSDLYSKSGDLDLSVQFGNGSNLLINKKKKQNVLREVRRALRGVAGYIQFIPHARVPVLQYVSNRYGISCDISINNFAGRIKSKIFYWVNTLDERFGDMVLLIKEWAKAQNINDPKSG

SEQ ID NO: 35959 - DNA, 685 bp, Panicum virgatum
  misc_feature: Ceres CLONE 1964230
  misc_feature: Encodes the peptide sequence at SEQ ID NO. 35960
accacactccttgcgtggcttccgtagtccgtaggcacacttcccttcaaagccactgcttcgtcttcctctacttaagcgcacgccccccgggcccgtgccctgtactcgcgtccgggaccgggagctcgcctcttcttcctgaggaggtgttggatggtggatgcatgacacactcattgcattagttcttacaagggaagcctatgggtttcaaggaagcgtcatctactacaatcttctgcctcttgctcctattctgcctgggctgcagatgcctggcatcagaactagtggccacacaggcagcaactctcaaggttgacgcctcaccgcagtcagcccgaaagatccctgaaacactatttgggatattttttgaggagatcaatcatgcaggagctggtggaatttgggcagagcttgttagtaaccgaggtttcgaagctggaggcccacatactccctcagacattgacccatggtccattattggagatgactcttccgtatttgtggcgactgatcgtacatcatgtttcagtcgaaacattgttgctctgaggatggtggtcctctgtgatgactgtcctactggtggtgttggtatttacaacccggggttctggggcatggtgtgactttaccatatattgcgtgtatgagaaatggatagtttcatcgg

SEQ ID NO: 35960 - protein, 144 aa, Panicum virgatum
  misc_feature: Ceres CLONE 1964230
  misc_feature: SWISSPROT Homolog: EC 3.2.1.55 Alpha-N-arabinofuranosidase
  misc_feature: Functional homolog of the protein sequence given in SEQ ID NO 51312
  misc_feature: Useful for making plants with altered carbohydrate content
  misc_feature: Functional homolog of the protein sequence given in SEQ ID NO 51313
  misc_feature: Useful for making plants with altered cell wall content and/or composition
MGFKEASSTTIFCLLLLFCLGCRCLASELVATQAATLKVDASPQSARKIPETLFGIFFEEINHAGAGGIWAELVSNRGFEAGGPHTPSDIDPWSIIGDDSSVFVATDRTSCFSRNIVALRMVVLCDDCPTGGVGIYNPGFWGMV

SEQ ID NO: 35961 - DNA, 628 bp, Panicum virgatum
  misc_feature: Ceres CLONE 1964238
  misc_feature: Encodes the peptide sequence at SEQ ID NO. 35962
aaagcgctccggctcagaggccaaggcgcagctcggcggccgtggcggaggaggaggcggaggcaaaacccccccgcgccgcattgccccccgggaccctccgattcggcccgcgccgagctcgaatccgcgcaacctcgccggcgacgggctcgatctgctccggcgcgggcggtggggaatggggagcgtggacggcgaggtcgacgggatccacgcagctaatcggcgtgctgagttggtcaaatggctcaatgccttgctcccggaatttaatttgccatcggattcatcggatgaagagctgagagagctgctcagtgacggtgtggtcctgtgccgtattgcgaacaccctcatccctggtgttcttgaggggtcatggggtggttatgcatcgttggatcagaggtcaggcaatgtgaagaagttcctctcagtagttgctgatatggggttgccaggtttcagtgtgacagaacttaatgagggaccaatgtcttcggtagtggaatgcctcctggttttgagggacagtgtcgatcctagattgggtgatgatagtccagcagatgttgccaaaactcctttgaggaaacaatggggagttccggaaatggacaggcct

SEQ ID NO: 35962 - protein, 148 aa, Panicum virgatum
  misc_feature: Ceres CLONE 1964238
  misc_feature (15)..(121): Pfam Name: CH Pfam Description: Calponin homology (CH) domain
MGSVDGEVDGIHAANRRAELVKWLNALLPEFNLPSDSSDEELRELLSDGVVLCRIANTLIPGVLEGSWGGYASLDQRSGNVKKFLSVVADMGLPGFSVTELNEGPMSSVVECLLVLRDSVDPRLGDDSPADVAKTPLRKQWGVPEMDR

SEQ ID NO: 35963 - DNA, 407 bp, Panicum virgatum
  misc_feature: Ceres CLONE 1964243
  misc_feature: Encodes the peptide sequence at SEQ ID NO. 35964
atttcttccccccgccttcctcctctcgcgctctgtcccccctccatatcgagttcgaaccggaaccaccgcggggagcgcaccgccggagtccccagatggccgacgacaaggataccgactcgcagcagccgccggccaagctgccccgcctctccggcgccgacacgagcgccggggaggtgaccatggcggcctcgtcgccgctggttctcgggctggggctggggctcggcgcgggcggcggcgagcgcgacgcggaggcggcgcccaagagggcgtcagcgctgacgttcatgcagcagcaggagctggagcaccaggtgctcatctaccgctacttcgctgcgggcgcgcccgtgccggtgcacctcgtgctccccatctggaagagcgtcgccgcctcc

SEQ ID NO: 35964 - protein, 102 aa, Panicum virgatum
  misc_feature: Ceres CLONE 1964243
  misc_feature (62)..(98): Pfam Name: QLQ Pfam Description: QLQ
MADDKDTDSQQPPAKLPRLSGADTSAGEVTMAASSPLVLGLGLGLGAGGGERDAEAAPKRASALTFMQQQELEHQVLIYRYFAAGAPVPVHLVLPIWKSVAA

SEQ ID NO: 35965 - DNA, 1028 bp, Panicum virgatum
  misc_feature: Ceres CLONE 1964265
  misc_feature: Encodes the peptide sequence at SEQ ID NO. 35966
atcattaagccacctcgagcacagcgaggttttatatgcaagccgactcgcccgcctccaaaaccagccacgcacacagagcgagcgcacgcacggcggcgagccgcggcgcaaccgcaacgcgaggcgcagtagcccgcccggccagccccctcccgcggcgtgcctgctagctcccgctctccgctgcctgcgagacaaccgccgaggcctcggccgccccgcgagccccggtccccccctcccgcgcgctcgcgctcgtcatggcggccgcgccgtcgtcgtcgtcgtccgcgtcgccggccgccggcggcgggccgcggccgtaccggtcgcggttcggcgacacgacgctgacaaaggtgttcgtcggcgggctggcgtgggagacgccgtcggaggggctccggcagcacttcgagcggtacggcgacatcctggaggccgtcgtcatcaccgaccgcgtcaccggccgctccaagggctacggattcgtgacgttccgggagccggaggcggcgcggcgcgcggtgcaagatccgaacccgacgatcgccgggcggcgcgccaactgcaacattgcctcgctggggccgccgcgccccgcccagcctcgagggagggggccctacgccgccggggcccacatgcagcaggtcccgcagccggcggcccagggcccgcacttcgtccccagccgggcgccggcctcgccccagatgatgccccagcacggcggtggcccggcagctgcgatctacccgcctcacttcgggtgctggtacccacctgactttcaatacccacagccgctggccaatccgcaagtgctgcacaactactacccccagctgtacggcatgacctcgccgacggcgtcacccttccacccgtacgtcgggtacatggcgccgcaggctccgagggcactgctcccgccgccaccgccggcggcacagcaggtcgccgtgcagccgctggtgcagcatccgccggcggcacagcaggtggcggtgcaagcgctgctg

SEQ ID NO: 35966 - protein, 254 aa, Panicum virgatum
  misc_feature: Ceres CLONE 1964265
  misc_feature (34)..(104): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50671
  misc_feature: Useful for making plants with modulated biomass
MAAAPSSSSSASPAAGGGPRPYRSRFGDTTLTKVFVGGLAWETPSEGLRQHFERYGDILEAVVITDRVTGRSKGYGFVTFREPEAARRAVQDPNPTIAGRRANCNIASLGPPRPAQPRGRGPYAAGAHMQQVPQPAAQGPHFVPSRAPASPQMMPQHGGGPAAAIYPPHFGCWYPPDFQYPQPLANPQVLHNYYPQLYGMTSPTASPFHPYVGYMAPQAPRALLPPPPPAAQQVAVQPLVQHPPAAQQVAVQAL

SEQ ID NO: 35967 - DNA, 499 bp, Panicum virgatum
  misc_feature: Ceres CLONE 1964279
  misc_feature: Encodes the peptide sequence at SEQ ID NO. 35968
ccgcgcaccggatgagtctcctctgcagtactgcagggagaccccgcgcaccccgtctctgtttccccaagctccagttcctctcgcggtctcgcctcgccgccgtctcgcgaaccgggggggcaagggcagcgcggagatgtcgtacctgctgccgcacctgcactccgggtgggcggtggaccaggccatcctcgccgaggaggagcgcctcgtcatcatccgcttcggccacgactgggacgagacgtgcatgcagatggatgaagtgctggctgcagttgcagagactataaagaactttgcagttatctacctcgttgacatcacggaggttcctgagttcaacacgatgtatgagctgtatgatccgtcaaccgtgatgttcttcttccggaacaagcacatcatgattgatctcgggacaggaaacaacaacaagatcaactgggccttgaaggacaagcaggagttcatcgacattgtggagactgtgtac

SEQ ID NO: 35968 - protein, 119 aa, Panicum virgatum
  misc_feature: Ceres CLONE 1964279
  misc_feature (4)..(119): Pfam Name: DIM1 Pfam Description: Mitosis protein DIM1
MSYLLPHLHSGWAVDQAILAEEERLVIIRFGHDWDETCMQMDEVLAAVAETIKNFAVIYLVDITEVPEFNTMYELYDPSTVMFFFRNKHIMIDLGTGNNNKINWALKDKQEFIDIVETV

SEQ ID NO: 35969 - DNA, 467 bp, Panicum virgatum
  misc_feature: Ceres CLONE 1964285
  misc_feature: Encodes the peptide sequence at SEQ ID NO. 35970
ctaaagtatagtttggcacagggcccatattttttgcgggacggccctgctccatccacccaaccaaccatggagatgcgggtggcgctggccctgctcgtggtcgccgtggcggcgtcgcagctgccgtcggcggtggaggcggccaactacacggtgggcgacgacaagggctggaaccccgacgtggactacacggcctgggtcaagaagcacaagccattctacaagggggactggctcatcttcgagtaccagacggggcgtgcggacgtggtgcaggtgggcgaggtggggtacgacaagtgcgacaaggccggcgccctcagcagctacagcaagggcacctcctacgccttccagctcaaggaggccaaagactacgccgccattgctgccacaggcgccgccctgctccatctccacaggattgttctgtgactctgactctgatccattcagagatc

SEQ ID NO: 35970 - protein, 123 aa, Panicum virgatum
  misc_feature: Ceres CLONE 1964285
  misc_feature (36)..(98): Pfam Name: Cu_bind_like Pfam Description: Plastocyanin-like domain
MEMRVALALLVVAVAASQLPSAVEAANYTVGDDKGWNPDVDYTAWVKKHKPFYKGDWLIFEYQTGRADVVQVGEVGYDKCDKAGALSSYSKGTSYAFQLKEAKDYAAIAATGAALLHLHRIVL

SEQ ID NO: 35971 - DNA, 636 bp, Panicum virgatum
  misc_feature: Ceres CLONE 1964301
  misc_feature: Encodes the peptide sequence at SEQ ID NO. 35972
aacgcttgatcagccctgctctgctcattgctagagacaaaggaggcttgcattggagggaaggtgtagctaccttttttttttatgtgcctgattacacaaactaccagagtccatttgatatttcagccataatctctgttagttgaacacagggttcaccagagatggacttcttcagtgaatatggtgatgctaacagatacaaaatccaagaggtcattggcaaaggaagttatggtgttgtttgctcagctgttgaccagcatacaggcgacaaggtggcaatcaagaaaatacataatatctttgagcacttatctgatgctgcccggatcctccgtgagatcaaactacttcggctattgcgacatcctgatatagttgagatcaagcatataatgctgcctccatcaaggagggacttcaaagatatctatgttgtttttgagctgatggattcagacctgcaccaagtcatcaaggcaaatgatgacttaaccaaagagcatcatcagttctttctatatcagatgctccgtgcactcaaatacattcatactgctaatgtttatcatcgtgatttgaagccaaagaatatattggctaatgctaactgtaaacttaaaatatgtg

SEQ ID NO: 35972 - protein, 156 aa, Panicum virgatum
  misc_feature: Ceres CLONE 1964301
  misc_feature (13)..(156): Pfam Name: Pkinase Pfam Description: Protein kinase domain
  misc_feature: SWISSPROT Homolog: EC 2.7.11.24 Mitogen-activated protein kinase
  misc_feature: Functional homolog of the protein sequence given in SEQ ID NO 50346
  misc_feature: Useful for making plants with altered cell wall content and/or composition
MDFFSEYGDANRYKIQEVIGKGSYGVVCSAVDQHTGDKVAIKKIHNIFEHLSDAARILREIKLLRLLRHPDIVEIKHIMLPPSRRDFKDIYVVFELMDSDLHQVIKANDDLTKEHHQFFLYQMLRALKYIHTANVYHRDLKPKNILANANCKLKIC

SEQ ID NO: 35973 - DNA, 881 bp, Panicum virgatum
  misc_feature: Ceres CLONE 1964329
  misc_feature: Encodes the peptide sequence at SEQ ID NO. 35974
cccatccgctccactctgcacccctctcctcgcggcgagcacccatggcggcttcctccgcctccctcctcgcccgccgcctcctcctctcccgccgcctcctctcctccccactccgccccttctcagccactacgacaccctcctccccctccccctcgcttaacgggtccgacgcggagtccgaccccgagctcgagcacgaccagcccctcggggatcaggaccgccagcaggcgcgcaaccgcccgcgcccgcccaacaccacccgccccctcgagaacggcctcgaccccggcatctataaggcgataatggtggggaaggtcgggcaggagccgatactgaagcggctgcggaacgggaggaccgtcgtgctcttctcgcttggcaccggtggcatccgcaacaaccgccgcccgctggaccgcgaggagccgcaccagtacgccgaccgctgctccgtccagtggcaccgcgtctccgtctacccggagcgcctcggcaccctcgctctaaaccacgtcaagaccggcactgttctgtatttggaaggaaatcttgagaccaaagtgttctgtgatccaattactgggctggttagacgcataagagaaatagctgtgcgtgcaaatggtcgcctcttatttctgggtaatgatgccaatgctcccaagttaggtgaagtcaagggtgtgggctacttctgatactgatttatgtttaactgatgataccagttgcctatgtcaactgggatgcatgtatcacaatggtgcggcactttctctgtcattgaaatctgagagtgaaccaacaaatattggcagcgatttcaagtcttttgctgcattgaattttatcagattcctgttttcgtc

SEQ ID NO: 35974 - protein, 221 aa, Panicum virgatum
  misc_feature: Ceres CLONE 1964329
  misc_feature (86)..(203): Pfam Name: SSB Pfam Description: Single-strand binding protein family
  misc_feature: Functional homolog of the protein sequence given in SEQ ID NO 51198
  misc_feature: Useful for making plants with altered alkaloid content
  misc_feature: Useful for making plants with altered terpenoid content
MAASSASLLARRLLLSRRLLSSPLRPFSATTTPSSPSPSLNGSDAESDPELEHDQPLGDQDRQQARNRPRPPNTTRPLENGLDPGIYKAIMVGKVGQEPILKRLRNGRTVVLFSLGTGGIRNNRRPLDREEPHQYADRCSVQWHRVSVYPERLGTLALNHVKTGTVLYLEGNLETKVFCDPITGLVRRIREIAVRANGRLLFLGNDANAPKLGEVKGVGYF

SEQ ID NO: 35975 - DNA, 1341 bp, Panicum virgatum
  misc_feature: Ceres CLONE 1964334
  misc_feature: Encodes the peptide sequence at SEQ ID NO. 35976
atctcctcttcttctcaccccccctccccctccccccttctctctctctcgaccccctcgccgtccacacgcgactgcgcgagacactggtcaacggcagggtggcagccggcgcccgttgggggtgggtctagctccgtcgatcgccccggaggaacgcggcgcggtgctgcctccggcgcgcgggttcgccatggggaggaacgggagcgtgaagcgctcggggtccactggcggctcgggggccgccgcggggccgccgacgttcacggtgaaccccggcgactaccggctgatggaggaagttgggtacggcgcgcacgccgtcgtgtaccgcgcgatcttcgtgcccagggacgaggtcgtggcggtcaagtgcctggatctcgatcagctgaataacaacatcgatgaagtacaaagggaggctcaaataatgagcttgatcgatcatcctaatgtcatcagggcttactgctcatttgttgtggagcacagcctttgggtgataatgccattcatgacagagggttcatgtttacacttaatgaagatctcataccaggatggttttgatgagccagtcatcggttccatcctaaaggaaactcttaaggctctggaataccttcacaggcaaggtcaaatacatcgtgatgtcaaggctggtaatatccttatcgacagtgctggtatagtgaagcttggagactttggcgtttctgcttgcatgtttgatagaggtgataggcaaagatctaggaatacatttgtaggaacaccatgctggatggctccagaagtgctccagcctggcactggatataatttcaaagctgatatatggtcatttggaatcactgcgcttgaactagcgcatggccatgctccattttccaaatacccccctatgaaggttcttctcatgaccctccagaacgcaccacctggtcttgactatgaacgtgacaaaagattctcgaagtcatttaaagagatggttgccatgtgcttggtcaaagatcaaacaaagaggccaacagcagagaagttgctaaagcattcatttttcaaaaatgcaaagcctccagaattgaccatcaagagtatcttatctgatttacctcctctctgggaccgtgtaaaggctctccagcttaaagatgcagcacaattggctttgaagaaaatgccttcttctgaacaggaggccctctccctgagtgaataccaacgaggtgttagtgcgtggaattttgatatcgaggatctcaaggctcaagcatcattgattcgtgatgatgagccaccagaaataagagaagacgaggacactgcaag

SEQ ID NO: 35976 - protein, 382 aa, Panicum virgatum
  misc_feature: Ceres CLONE 1964334
  misc_feature (32)..(293): Pfam Name: Pkinase Pfam Description: Protein kinase domain
  misc_feature: SWISSPROT Homolog: EC 2.7.11.1 Non-specific serine/threonine protein kinase
MGRNGSVKRSGSTGGSGAAAGPPTFTVNPGDYRLMEEVGYGAHAVVYRAIFVPRDEVVAVKCLDLDQLNNNIDEVQREAQIMSLIDHPNVIRAYCSFVVEHSLWVIMPFMTEGSCLHLMKISYQDGFDEPVIGSILKETLKALEYLHRQGQIHRDVKAGNILIDSAGIVKLGDFGVSACMFDRGDRQRSRNTFVGTPCWMAPEVLQPGTGYNFKADIWSFGITALELAHGHAPFSKYPPMKVLLMTLQNAPPGLDYERDKRFSKSFKEMVAMCLVKDQTKRPTAEKLLKHSFFKNAKPPELTIKSILSDLPPLWDRVKALQLKDAAQLALKKMPSSEQEALSLSEYQRGVSAWNFDIEDLKAQASLIRDDEPPEIREDEDTA

SEQ ID NO: 35977 - DNA, 601 bp, Panicum virgatum
  misc_feature: Ceres CLONE 1964345
  misc_feature: Encodes the peptide sequence at SEQ ID NO. 35978
agcatgcacagacgagagcgagccaagtgtactactcccagtgaagccacactagctagccacaccagcagtttgacaagctagctagctagctaggccgcagccatgtcggaggagaagcaccaccacttcttccaccaccacaagaaggacgaagaggagcagcccgccggcgggtactcggaggccgtggccgccgaggtggtggccgccggcgagagcgagtacgagaggtacaagaaggaggagaaggagcacaagcacaagaagcacctcggcgaggccggcgccgtcgccgccggtgccttcgcgctctacgagaagcacgaggcgaagaaggacccggagcacgcgcaccggcacaagatcacggaggagatcgccgccacggcggccgtcggcgccggcggctacgccttccacgagcaccacgagaagaaaaaggaccacaaggacgccgaggaggccagcggcgagaagaagcaccaccacctcttcggctgacccgccggcgagcgagctccggcccggccgccgcgcacccgcctgcttgctcccataattgtgggcatgatttcgcaataaagtcccttcccgaccc

SEQ ID NO: 35978 - protein, 132 aa, Panicum virgatum
  misc_feature: Ceres CLONE 1964345
  misc_feature (42)..(121): Pfam Name: ABA_WDS Pfam Description: ABA/WDS induced protein
MSEEKHHHFFHHHKKDEEEQPAGGYSEAVAAEVVAAGESEYERYKKEEKEHKHKKHLGEAGAVAAGAFALYEKHEAKKDPEHAHRHKITEEIAATAAVGAGGYAFHEHHEKKKDHKDAEEASGEKKHHHLFG

SEQ ID NO: 35979 - DNA, 339 bp, Panicum virgatum
  misc_feature: Ceres CLONE 1964346
  misc_feature: Encodes the peptide sequence at SEQ ID NO. 35980
aagaagagcatcctctcctccggctcttcttctccaccaccaccagtccaccacctcctcctcctagcgctgccgcgcgccgctcccctgagcaccaccacaccgcggcaatggcgggcaacgggctgatcgtggagaacgacccgctcaactggggcgcggcggcggcggagctggccgggagccacctggacgaggtgaagcggatggtggcgcaggcgcgggagcccgtggtgcaagatcgacggctccaccaaccgcgacagccaggtggccgatgaggcaaacgacttagagccttgcggcacctccaccccgataaaccaagctagggtaatg

SEQ ID NO: 35980 - protein, 56 aa, Panicum virgatum
  misc_feature: Ceres CLONE 1964346
  misc_feature: SWISSPROT Homolog: EC 4.3.1.5 Phenylalanine ammonia-lyase
MAGNGLIVENDPLNWGAAAAELAGSHLDEVKRMVAQAREPVVQDRRLHQPRQPGGR

SEQ ID NO: 35981 - DNA, 377 bp, Panicum virgatum
  misc_feature: Ceres CLONE 1964353
  misc_feature: Encodes the peptide sequence at SEQ ID NO. 35982
cgtgctctctcagaggtgggttggcttctcctccccctcttactcggtcctcggctctagggttttagtgggaagggagatggcggcggcggatgtggagtaccgctgcttcttcggcggcctcgcctgggccaccgacaacgcgtccctccagcaggccttcgcctcctacggagacgtcctcgactccaaggtcatcaccgaccgtgagacggggaggtcccgcggtttcggcttcgtcaccttctcctccgagcagtcgatgctggacgccctcgaagccatgaacggcaaggatctcgactggcgcaacatcaccgtcaaccatgctcattccctcggcggcggcggcggcggctacggcggcggtcgtcagg

SEQ ID NO: 35982 - protein, 99 aa, Panicum virgatum
  misc_feature: Ceres CLONE 1964353
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MAAADVEYRCFFGGLAWATDNASLQQAFASYGDVLDSKVITDRETGRSRGFGFVTFSSEQSMLDALEAMNGKDLDWRNITVNHAHSLGGGGGGYGGGRQ

SEQ ID NO: 35983 - DNA, 423 bp, Panicum virgatum
  misc_feature: Ceres CLONE 1964369
  misc_feature: Encodes the peptide sequence at SEQ ID NO. 35984
agagcgcccagcaggccagcagccaccgcgttcccctccccgaccggcagaatccggtccacgcccgcccaccattcatccgtttcccactgtgcgtccccgcggcctctgctccgccgctgctctgctccccgcgccccgggacgagccccgccgcgaggagggagagcgagccgcgagcgcggacgcaggaggggggatctccggcatggggatcgtggaggaggcgcacaacctgcgggtggtgggggaggggaagcgcggggtgatcgtgctggcgcacggcttcggcacggaccagtccgtgtggaagcacctggtgccgcacctcgtcgccgactaccgcgtcgtgctcttcgacaccatgggcgcggggcccaccaacccggactacttcgacttcgcccgctacgccacgctcga

SEQ ID NO: 35984 - protein, 71 aa, Panicum virgatum
  misc_feature: Ceres CLONE 1964369
  misc_feature: SWISSPROT Homolog: EC 3.1.1.1 Carboxylesterase
MGIVEEAHNLRVVGEGKRGVIVLAHGFGTDQSVWKHLVPHLVADYRVVLFDTMGAGPTNPDYFDFARYATL

SEQ ID NO: 35985 - DNA, 1163 bp, Panicum virgatum
  misc_feature: Ceres CLONE 1964398
  misc_feature: Encodes the peptide sequence at SEQ ID NO. 35986
ataaaaatttgcaatgcaagaattcgaaatttgagcggaagggaattgagtatcacgttgtatggagatattgcttgtggttttgctgaggatatgcacgagaaaggccaagaagcctcagttgttgctgtttttgcagggatgcgcgttgaatcctcacattcagtttgctctacaacgtgttcatattactatctagatttggaaataccagaggtgcaagaattctgtgcgaatttgcgcattcagcaggaaaacccagttccgaaaaaaagtccagctcagaagttagccgagagttggcgaacaattgaacagctaaaaagcctcgatccagaggagtatgacgaggatacctcatttttgtgcagagtctccctgatagatatagattgcagcaacggctggtgttatcttggatgcgacacctgccaaaagtcaatgtacagggccccaaggaaatacaagtgcagccgatgtggcccgattaagagaccaattcaatggtacaagctgaagacgaaggtgcaagatgccaccggcacaatggacttgatgatcttctgtgaggtggctgaagagctggtcggtgtctccgcggaggagctcgttgatgagattgaggatgatgatgagtggtacaccctgccagaagaratcgaggatcttcttggatcgacccacactttccaagtatttgacaagtatgggagcaggagctggtcggtgaggtcaatcatggatgacgttagtgtcccagtccctgctggaaccactgcccaatgcaaggaggaacctgtccctgagggcagcattaacatggcaatccctactccaatcactactcaatgcaaggaggagcctgtccatgagggcagcatcaacgtggcgatctgtactccagtcactactcaatgcaaggaggagcttgtccatgggggcagcatcaacttggcgatctgtaatccagtcactactcaatgcaaggaggagcctgtccctgagggcaacattaacatggcaatccctgctccgactgcttctcgatggcacgttgagcctgtaaatgaagatatcactactccaccgactgataaatgagccgagaattctatacctgatgaatgcactaccaccctagatccaaaggaggatgtacgagc

SEQ ID NO: 35986 - protein, 366 aa, Panicum virgatum
  misc_feature: Ceres CLONE 1964398
  misc_feature (120)..(250): Pfam Name: Rep_fac-A_C Pfam Description: Replication factor-A C terminal domain
IKICNARIRNLSGRELSITLYGDIACGFAEDMHEKGQEASVVAVFAGMRVESSHSVCSTTCSYYYLDLEIPEVQEFCANLRIQQENPVPKKSPAQKLAESWRTIEQLKSLDPEEYDEDTSFLCRVSLIDIDCSNGWCYLGCDTCQKSMYRAPRKYKCSRCGPIKRPIQWYKLKTKVQDATGTMDLMIFCEVAEELVGVSAEELVDEIEDDDEWYTLPEEIEDLLGSTHTFQVFDKYGSRSWSVRSIMDDVSVPVPAGTTAQCKEEPVPEGSINMAIPTPITTQCKEEPVHEGSINVAICTPVTTQCKEELVHGGSINLAICNPVTTQCKEEPVPEGNINMAIPAPTASRWHVEPVNEDITTPPTDK

SEQ ID NO: 35987 - DNA, 708 bp, Panicum virgatum
  misc_feature: Ceres CLONE 1964400
  misc_feature: Encodes the peptide sequence at SEQ ID NO. 35988
ctggctcccctacccctcgggatatccgcctcgcctccactccgcccggcgcctcctccccactcctcctctgctccgccccgccgccgcaacgatccaaccccggcgcgtcgccttctccgcagcctccccctttcttcccgagatttccaaggagttttccctctggtttaatggcactctgcctttgagaaaatctttaattgtgctgtctgggctacggaacgacaatgttgcaacttggattagctgcagctgcctcaaaggtgctgccactactccctaatcaccagaggagttcagctggaaccacattcccatccgcatcatcgaggccctcaaaccgaaggaaaaaccgcactcgttcacttcgtgatggaggagatggggtatctgatgccaaaaagcacaaccagtctgttcgtcaaggtcttgctggcatcattgacctcccaaatgaggcaacatcggaagtggacatttcgcatggatctgaggatcccagggggccaccagagtcatatcaaatgaatgggattataaatgaaacacataacggtagacatgcctcagtgtccaaggttgttgaattttgtacagcgttaggtggcaaaacaccaattcacagtatattagtggccaacaacggaatggcagcagcaaagttcatgaggagtgttcgtacatgggctaatgatacttttggat

SEQ ID NO: 35988 - protein, 159 aa, Panicum virgatum
  misc_feature: Ceres CLONE 1964400
  misc_feature: Functional homolog of the protein sequence given in SEQ ID NO 51511
  misc_feature: Useful for making plants with altered oil content
  misc_feature: Useful for making plants with modulated herbicide sensitivity
MLQLGLAAAASKVLPLLPNHQRSSAGTTFPSASSRPSNRRKNRTRSLRDGGDGVSDAKKHNQSVRQGLAGIIDLPNEATSEVDISHGSEDPRGPPESYQMNGIINETHNGRHASVSKVVEFCTALGGKTPIHSILVANNGMAAAKFMRSVRTWANDTFG

SEQ ID NO: 35989 - DNA, 570 bp, Panicum virgatum
  misc_feature: Ceres CLONE 1964400-R
  misc_feature: Encodes the peptide sequence at SEQ ID NO. 35990
caccctgcaaactacttcggttcttggttgctgatggtgctcatgttgatgccgatgcaccatatgcggaagttgaggttatgaagatgtgcatgcctctcttgtcgcctgcttctggtgtcattcatgttatgatgtctgaaggccaggcattgcaggctggtgatcttatagcaaggctggatcttgatgacccttctgctgtgaaaagagctgaaccatttgatggaatgtttccacaaatgggccttcctgttgcttcctctagtcaagtacacaaaagatatgctgcaagtttgaatgctgctcaaatggtccttgcaggatatgagcataacatcagcgaagttgtacaagatctggtatgctgtctggacgatcttgagcttcctttcctacaatgggatgaacttatgtcagttctagcaactaggcttccaagaaaccttaagagtgagttagaggataaatacaaggaatacaagttgaacttttaccgtggggaaaacaaggacttcccatccaagctgctgagagacacaattgaggcaaatcttgcttatggttcag

SEQ ID NO: 35990 - protein, 189 aa, Panicum virgatum
  misc_feature: Ceres CLONE 1964400-R
  misc_feature (1)..(60): Pfam Name: Biotin_lipoyl Pfam Description: Biotin-requiring enzyme
  misc_feature: Functional homolog of the protein sequence given in SEQ ID NO 51511
  misc_feature: Useful for making plants with altered oil content
  misc_feature: Useful for making plants with modulated herbicide sensitivity
PCKLLRFLVADGAHVDADAPYAEVEVMKMCMPLLSPASGVIHVMMSEGQALQAGDLIARLDLDDPSAVKRAEPFDGMFPQMGLPVASSSQVHKRYAASLNAAQMVLAGYEHNISEVVQDLVCCLDDLELPFLQWDELMSVLATRLPRNLKSELEDKYKEYKLNFYRGENKDFPSKLLRDTIEANLAYGS

SEQ ID NO: 35991 - DNA, 1421 bp, Panicum virgatum
  misc_feature: Ceres CLONE 1964404
  misc_feature: Encodes the peptide sequence at SEQ ID NO. 35992
gctaccaagtttcacaaaaccccaagcggtgctcaagtcatctcctggctcttgccatctccaacctgcctctgaatctgaaacgctctcccggggaggtgagtgaagtgactgttgggagtggcgtaggctgcagagcaagccagccatggggcttcctctgctggccgcggtgtgctgcgccctcctggcgagcgctgcccggccgcattgcgccgcggcggcgaaggcccggcacttcaagtgggagatcagcaacatgttctggtcgccggactgcgaggagaaggtggtgatcggcatcaacgggcagttccccggcccgaccatccgcgcccgcgccggcgacaccatccacgtcgagctcaagaacgcgctccacaccgagggcgtcgtcatccactggcacggcatcagacagatcgggacgccgtggatggacggcacggcggcgatctcccagtgcgccatcaaccctgaagaaaccttcacctaccgctttgtcgtcgacaagccggggacgtacttctaccacgggcactacgggatgcagagggcggcggggctgtacgggtcgctgatcgttgacgtggccgaaggggaagaggagccgttcaagtacgacagcgagctcarcctgctgctcagcgactggtaccasgagagcatccacacccagatggtcgccctctcctccaagcccttcaggtggatcggcgagccgcagtctctgctgatcaatggcaggggacagttcaactgctccatggccgcggcgcacacgccgggcgccacgcagtgcgccgccgtcaaccggcagtgcccgccggtggtcctccccgtgcagccgaacaagacctacaggctccgggtggcgagcaccacctcgctggcttctctcaacctggcaatcggtaatcacaagatgacggtagtggaggccgacggcaactacgtggacccgttcgccgtcgacgacatcgacatctactccggcgacagctactccgtcctcctgacgacggaccaggacccgtcgtccaactactgggtcatcgtcggcgtgcgcggccggccgccgaggacggcgccggcgctggccgtgctcaactaccgcccgaaccgcgcgtccaagctgccggcgctcgcgccgccggccaccccggcgtgggacgactacgagcacagcaaggcgttcacgtaccgcatccgcgcgcgcgccgggacgccgccgccgccggcgacggcggaccggcgcatcgagctgctcaacacgcagaaccggatggacgggggcaccaggtggtccatcaacaacgtgtccatggtgctgccggcgacgccgtacctgggttccctgaagctggggctcaagtcggcgctcgcggcggcgcggccggcggagacgttcagccgggggt

SEQ ID NO: 35992 - protein, 424 aa, Panicum virgatum
  misc_feature: Ceres CLONE 1964404
  misc_feature (34)..(151): Pfam Name: Cu-oxidase_3 Pfam Description: Multicopper oxidase
  misc_feature (161)..(325): Pfam Name: Cu-oxidase Pfam Description: Multicopper oxidase
  misc_feature: SWISSPROT Homolog: EC 1.10.3.3 L-ascorbate oxidase
  misc_feature (163)..(163): Xaa is any aa, unknown, or other
  misc_feature (171)..(171): Xaa is any aa, unknown, or other
MGLPLLAAVCCALLASAARPHCAAAAKARHFKWEISNMFWSPDCEEKVVIGINGQFPGPTIRARAGDTIHVELKNALHTEGVVIHWHGIRQIGTPWMDGTAAISQCAINPEETFTYRFVVDKPGTYFYHGHYGMQRAAGLYGSLIVDVAEGEEEPFKYDSELXLLLSDWYXESIHTQMVALSSKPFRWIGEPQSLLINGRGQFNCSMAAAHTPGATQCAAVNRQCPPVVLPVQPNKTYRLRVASTTSLASLNLAIGNHKMTVVEADGNYVDPFAVDDIDIYSGDSYSVLLTTDQDPSSNYWVIVGVRGRPPRTAPALAVLNYRPNRASKLPALAPPATPAWDDYEHSKAFTYRIRARAGTPPPPATADRRIELLNTQNRMDGGTRWSINNVSMVLPATPYLGSLKLGLKSALAAARPAETFSRG

SEQ ID NO: 35993 - DNA, 510 bp, Panicum virgatum
  misc_feature: Ceres CLONE 1964409
  misc_feature: Encodes the peptide sequence at SEQ ID NO. 35994
aaaaaaaaaaatgaagaacagtgcaattgtctgcaacatcggtcactttgacaatgagattgacatgcatggtcttgagacctaccctggtgtgaaacgcatcaccatcaagcctcagacggaccgctgggtgttccctgagaccaagactggcatcattgtccttgctgagggtcgtctgatgaaccttggatgcgctactggtcaccccagctttgtcatgtcctgctcattcactaaccaggtcattgctcagcttgagctgtggaaggagaagagctctggcaagtatgagaagaaggtgtacgtgctccccaagcaccttgatgagaaggttgctgctctccacttgggcaagcttggtgccaagctcaccaagctcaccaagtctcaggccgactacatcagcgtcccgattgagggtccctacaagcccgctcactaccggtactaggctgcccagcacaactagaacacccactttgctggctggctgtgtaatgtgcccat

SEQ ID NO: 35994 - protein, 150 aa, Panicum virgatum
  misc_feature: Ceres CLONE 1964409
  misc_feature (6)..(149): Pfam Name: AdoHcyase Pfam Description: S-adenosyl-L-homocysteine hydrolase
  misc_feature: SWISSPROT Homolog: EC 3.3.1.1 Adenosylhomocysteinase
KKKMKNSAIVCNIGHFDNEIDMHGLETYPGVKRITIKPQTDRWVFPETKTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 35995 - DNA, 1464 bp, Panicum virgatum
  misc_feature: Ceres CLONE 1964422
  misc_feature: Encodes the peptide sequence at SEQ ID NO. 35996
atcgatcgcttccttgcctgcagccattgagctgccccgtaattgaattgaatagctgtagctatgacgtggttggggtttgcctcgccatgtctgtccctctttgggttctaccgaccctcccctgcccatcgactgggagtagagcgggtagtgccactgccactgccactgccacggaggcgccaaacgtcgtgtcccaaacctcatgaactactgttcgcgcaaccacgaacgcgacgtgccgtgcacgacgccgcgctcaacggcggcagcagcatggatgtgagagagctggaggacaggataaggataagggagcagctcgtgagcgccgagcctccgccgccgcctccgtcagcatacgacacggcatgggtcgccatggtgccggcgccggggtcccttcaggttccgcacttcccgcagtgcgtggactggatcctgcggaaccagcgcggcgacggctcgtgggggccgcaggctggctccggcgacggcccgtggtcgctggggaaggactcgctctcgtcgacgatggcgtgcgtcctcgcgctccggacgtggggcgtcggcaacgagcacgtcggcaaagggctccgcttcattgggaacaacgcgtcctttgtgacggacgacagaagcgacacgccggcagggttcaacgttatcttccccggcatggtcgcgcacggcatcggcatggggctggagatccctctgaccccagccgacgttgacgccatccttcgactacgtgacattgaactaaaaagcatgccttctggaagtaaagctttcatggcctacgtagccgaaggtttggggaacttgttagattgggatctggtgacggcgtaccaaaggaggaacggatcgttcttcgcctcacctgcgacaacggcagcagctgtcatccacaacaacaacaggagagcactcgactacttggattccctcgtcagcaagtgcggcagctcagtgccgaccgtgtatccgcgtgacatgtacatccatcttcgcatggtggacaccttggaaaagatggggatctcttcgagcttttccggtgaaatttacaccaggcttgacatgatatacagctcctggctggccaacgacgaggagataatgctggacatgacgacgtgcacaatggcattccgccttctacgtttacacggatatgacatcccgtccgaagggttggcccagttcagtgaagaatccagttttcatgaatccgtccaagggcatctgaatgatacagaggcattgctggaattgtacaaagcttcacaggttcatattatggaggaggagccgatccttgaaaatatatgttcttggtcagctgaacttctgaagcaacaactatgttccaacaagatatcaagatctgtagacccagcagaggtggagcatgtactgaagttcccccactacgccactctagaccggctg

SEQ ID NO: 35996 - protein, 394 aa, Panicum virgatum
  misc_feature: Ceres CLONE 1964422
  misc_feature (188)..(393): Pfam Name: Terpene_synth Pfam Description: Terpene synthase, N-terminal domain
  misc_feature: SWISSPROT Homolog: EC 4.2.3.19 Ent-kaurene synthase
MDVRELEDRIRIREQLVSAEPPPPPPSAYDTAWVAMVPAPGSLQVPHFPQCVDWILRNQRGDGSWGPQAGSGDGPWSLGKDSLSSTMACVLALRTWGVGNEHVGKGLRFIGNNASFVTDDRSDTPAGFNVIFPGMVAHGIGMGLEIPLTPADVDAILRLRDIELKSMPSGSKAFMAYVAEGLGNLLDWDLVTAYQRRNGSFFASPATTAAAVIHNNNRRALDYLDSLVSKCGSSVPTVYPRDMYIHLRMVDTLEKMGISSSFSGEIYTRLDMIYSSWLANDEEIMLDMTTCTMAFRLLRLHGYDIPSEGLAQFSEESSFHESVQGHLNDTEALLELYKASQVHIMEEEPILENICSWSAELLKQQLCSNKISRSVDPAEVEHVLKFPHYATLDR

SEQ ID NO: 35997 - DNA, 1425 bp, Panicum virgatum
  misc_feature: Ceres CLONE 1964431
  misc_feature: Encodes the peptide sequence at SEQ ID NO. 35998
aatcaccctaccgccccgcacggagaacctctcctcccgcatagcaccccaacccgacctcgccggcggcgagcgtgtgcccatggcggacggcggcgatatggacgaggaggcgatgcgggccttcttcccgctctcctttggcaagaccgccgcgcgccccacctccgcggcctcctcctccgcccattcctccaccctccgcaagccccaaaaccctagtaaccccaagccctcctcctccaccgccgctgacgacgacggaggcgccatgattggtccccctcggccgccgccggcgcccgtgggggacgacgacgatgaggaggagggcggcggcatgatcgggccgcctcggcccccaccgctctccgctcacggcgagggggaggatgacgagggcggcggcatgattggaccgcctaggccaccgacagcggaggaggacgaagaggaggaggagaacgacgacgacgacgacgatatggaggacgacggtgatggcgggttcaataggatccctctcagcaacgaaattgttctgcgggggcacaccaaggttgtctcagcccttgccgttgaccatacaggatccagagtgctctctggtagctatgattatacagtgcgcatgtacgatttccagggtatgaattcaaaactgcaatcattcagacaattggaaccctttgagggccatcaagttcgtagcctaagttggagcccaacgtccgaccgattcttatgtgttaccggttctgctcaggccaagatttatgaccgtgatggcctcacgcttggcgagttcgttaagggtgatatgtatattcgtgatctaaagaatacaaagggacacatttctgggctgacaggtggggagtggaatccaaagtcaaaagagactattctgacctcatctgaagatggttcaatacgtctctgggatgtgtcagactttaaaagtcaaaagcaggtcatcaaaccaaagctagtaagaccaatgcggatccctgttacatcatgtgcatgggaccatgaaggaaaacgaatcgtgggtggcataggagatggttcgatacagctctggactataaaaactggatggagtagcagaccagatatccatgttgagaaaacacatacagaggatattaccggagttaagttttcaacagatggacagattcttctgtcaagaagtatggatagtactctgaagatatgggatctgagaagaatgaaaactcctttgaaagtgtttgaagatttgccaaatcactatgctgagacaaatgcagcttttagcccagatgagcaacttatttttacaggaacctctattgaaaaggatggtgacaatgggggactactctgtttctttgatagaaagaaacttgagcttgtatcaaaggtggggatttcacc

SEQ ID NO: 35998 - protein, 447 aa, Panicum virgatum
  misc_feature: Ceres CLONE 1964431
  misc_feature (148)..(186): Pfam Name: WD40 Pfam Description: WD domain, G-beta repeat
  misc_feature (344)..(382): Pfam Name: WD40 Pfam Description: WD domain, G-beta repeat
  misc_feature (249)..(288): Pfam Name: WD40 Pfam Description: WD domain, G-beta repeat
  misc_feature: SWISSPROT Homolog: EC 2.3.1.48 Histone acetyltransferase
MADGGDMDEEAMRAFFPLSFGKTAARPTSAASSSAHSSTLRKPQNPSNPKPSSSTAADDDGGAMIGPPRPPPAPVGDDDDEEEGGGMIGPPRPPPLSAHGEGEDDEGGGMIGPPRPPTAEEDEEEEENDDDDDDMEDDGDGGFNRIPLSNEIVLRGHTKVVSALAVDHTGSRVLSGSYDYTVRMYDFQGMNSKLQSFRQLEPFEGHQVRSLSWSPTSDRFLCVTGSAQAKIYDRDGLTLGEFVKGDMYIRDLKNTKGHISGLTGGEWNPKSKETILTSSEDGSIRLWDVSDFKSQKQVIKPKLVRPMRIPVTSCAWDHEGKRIVGGIGDGSIQLWTIKTGWSSRPDIHVEKTHTEDITGVKFSTDGQILLSRSMDSTLKIWDLRRMKTPLKVFEDLPNHYAETNAAFSPDEQLIFTGTSIEKDGDNGGLLCFFDRKKLELVSKVGIS

SEQ ID NO: 35999 - DNA, 635 bp, Panicum virgatum
  misc_feature: Ceres CLONE 1964431-R
tcatacacaatccacatgcattgccacttttcagagatcaaccaagtcgtaaacgtcaaagagagaagatactaaaggacccgctcaaatcacacaaaccagaagcacctgttaatggtccgggttatggtggaagagttggtacttcaaaaggcagcttactgacacagtacctcttgaaggaaggtggtttaattaaggagacctggatggatgaagatccaagagaagcaattttgaagtatgctgatgctgcagagaaagatccaaagtttattgcgccagcttattctcaaacccagccaaaacctgtctttgcagagtctgattcagacaatgaagagaaataaccatgtgtctggttacctaagctagcatacaacctgtattcgattttctgacagctgtcaacttattgcgcaagtcctgtaacctgtttcctaacagtggagaaacaaaagagtatgtatatggatcttgaagacaaaggtacaacaagacttttcagtaccatgtttattttttcagcacttcagcattataccttctttggtttgttggatgttggatattgtacccaatgtatgcacttaagtaagaaagaggggcaaatttattatattggacttgcatgt

SEQ ID NO: 36000 - DNA, 1394 bp, Panicum virgatum
  misc_feature: Ceres CLONE 1964526
  misc_feature: Encodes the peptide sequence at SEQ ID NO. 36001
aacccatcccggaatcccccccaattccccattcctgcaaccaaatccttggaccgacgatgcctgccgcgccgacgctggtgcccgcgtgcgacgccgaggagtcgctgctggcggagtcctcggaccgcttctccatgttcccgatacggttcccgcagatctgggagttctacaagaaggcggtggcgtccttctggacgaccgaggaggtggacctctccgccgacgcgcggcactgggacgaggcgctgtcccccgacgagcgccacttcatctcccacgtgctcgcctttttcgccgcctccgacggcatcgtgctcgagaacctcgcgtcgcgcttcatgtccgacgtgcaggtcgccgaggcgcgggccttctacggcttccagatcgccatcgagaacatccactcggagatgtactcgctgctgctcgagacctacatccgcgacggcgccgagaaggaccgcctcttccgcgccatcgacaccgtgcccgccgtccgccgcaaggccgactgggccatgcgctggatcgacggcggcgagcgcctcgtcgccttcgcctgcgtcgagggcatcttcttctcgggctccttctgcgccatcttctggctcaagaagcgcggcctcatgccgggcctcaccttctccaacgagctcatctcccgcgacgagggcctgcactgcgacttcgcctgcctcctctacgacctcctccgcagcaagctcgacgaggcccgcgtccgcgagatcgtcgccgacgccgtcgacatcgagcgcgagttcgtctgcgacgcgctccccgtcgcgctcgtcggcatgaacggcgccctcatgggccagtacatcgagttcgtcgccgaccgcctgctcatggcgctcgggtgcaggaagatgtacaacgccgccaaccccttcgactggatggagctcatctcgctgcagggcaagactaacttcttcgagaagcgcgtcggcgactaccagaaggcctccgtcatgaacagcctcaacggcggtgccgcggccaaccacgtcttcagcatcgacgaggatttctgagctgtgattccctggctaccctgataatcttatttgctttcgccgcttgctagttctatctggtagctctgtaatacatgtactccgcgacggcgcggtggtgtttgggtgctgtattactggttcctgttcgtgatgtaatgtataatcgattcctcaaaaaaaactgtctcctcctccctttcccctcccaaggccaggccaggcttgccctctccgcgtccaggaatccgccatgaagggggccaaatccaagggcgccgccaaggccgatgccaagttggcggtgaagagtaagggggcggagaagccggccaagggcaggag

SEQ ID NO: 36001 - protein, 335 aa, Panicum virgatum
  misc_feature: Ceres CLONE 1964526
  misc_feature (15)..(292): Pfam Name: Ribonuc_red_sm Pfam Description: Ribonucleotide reductase, small chain
  misc_feature: SWISSPROT Homolog: EC 1.17.4.1 Ribonucleoside-diphosphate reductase
MPAAPTLVPACDAEESLLAESSDRFSMFPIRFPQIWEFYKKAVASFWTTEEVDLSADARHWDEALSPDERHFISHVLAFFAASDGIVLENLASRFMSDVQVAEARAFYGFQIAIENIHSEMYSLLLETYIRDGAEKDRLFRAIDTVPAVRRKADWAMRWIDGGERLVAFACVEGIFFSGSFCAIFWLKKRGLMPGLTFSNELISRDEGLHCDFACLLYDLLRSKLDEARVREIVADAVDIEREFVCDALPVALVGMNGALMGQYIEFVADRLLMALGCRKMYNAANPFDWMELISLQGKTNFFEKRVGDYQKASVMNSLNGGAAANHVFSIDEDF

SEQ ID NO: 36002 - DNA, 669 bp, Panicum virgatum
  misc_feature: Ceres CLONE 1964526-R
  misc_feature: Encodes the peptide sequence at SEQ ID NO. 36003
aggccggcaaggaccccaacaagcccaagagggcgcccagcgccttcttcgtcttcatggagcaattccgcaaggagttcaaggagaagaaccctaaaaacaagtctgttgctgcggtggggaaagctgccggtgacaggtggaaatccctgacagaagcggacaaggctccttatgtagccaaggccaataaactcaagcttgagtacaacaaggccattgcggcctacaacaagggcgagagcactgctgccaagaaggcacctgccaaggaggaagaggaggaggatgaagaggagtctgacaagtcaaagtctgaggtcaacgacgaggatgatgaagagggtagtgaggaggatgaagacgatgacgagtaagcttatgtcaagttgatgctccattcaacaatggagtgccagaatgcaaaggccctgtggcaggaattaaaaggagcctatccagtctactagaattattcagtttcacttcacatcgtgatgttttacttttgtctgtcctataatggatatcgctccttgttggcgccaccggcgggctagtgtttgcacggtgggcacaccggcaatacctgcttgtacctagattaccgtttccattgtcatcagctaacattgtgataatatcagtctgggtaatgttagattaagt

SEQ ID NO: 36003 - protein, 124 aa, Panicum virgatum
  misc_feature: Ceres CLONE 1964526-R
  misc_feature (8)..(77): Pfam Name: HMG_box Pfam Description: HMG (high mobility group) box
  misc_feature: Functional homolog of the protein sequence given in SEQ ID NO 50396
  misc_feature: Useful for making plants with altered alkaloid content
  misc_feature: Functional homolog of the protein sequence given in SEQ ID NO 51462
  misc_feature: Useful for making plants with altered terpenoid content
  misc_feature: Functional homolog of the protein sequence given in SEQ ID NO 50397
  misc_feature: Useful for making plants with altered lignin content
AGKDPNKPKRAPSAFFVFMEQFRKEFKEKNPKNKSVAAVGKAAGDRWKSLTEADKAPYVAKANKLKLEYNKAIAAYNKGESTAAKKAPAKEEEEEDEEESDKSKSEVNDEDDEEGSEEDEDDDE

SEQ ID NO: 36004 - DNA, 287 bp, Panicum virgatum
  misc_feature: Ceres CLONE 1964542
  misc_feature: Encodes the peptide sequence at SEQ ID NO. 36005
cctttcaccatccttactatgaaccgacggagaccctcgatgactcagtcgtgtgaacctgagcccagcggcaaagaccgtacctagctcctgcctcgaagtactagctagctagccgagcaagacaggaggagaggaagaatattcgatggtctctgctgctaccctgcggcagtcgtccgtccttcccacgacgtccgaatggggcgtcagacggcctgtcccggcgcccccgccagacaccttgtccctggcgctcttcccctccagcccctacgccgatgaac

SEQ ID NO: 36005 - protein, 46 aa, Panicum virgatum
  misc_feature: Ceres CLONE 1964542
  misc_feature: SWISSPROT Homolog: EC 4.1.2.13 Fructose-bisphosphate aldolase
MVSAATLRQSSVLPTTSEWGVRRPVPAPPPDTLSLALFPSSPYADE

SEQ ID NO: 36006 - DNA, 925 bp, Panicum virgatum
  misc_feature: Ceres CLONE 1964548
  misc_feature: Encodes the peptide sequence at SEQ ID NO. 36007
aaaactcccgtaaattaccaaacacgcgcggccaccgaccgatcaggcgaccccccctcctccccgaggaaatccaccaccgcggccggggcctccagatctcgccggaggcagcggcagcggcggcggcggggggcgatggcgctcaacatgaagaccctgacgcaggcgctggccaaggcgtcggcggtgatcgagaagacggtgtcgacgacggtgcaggaggtgacgggcccgcgcccgctgcaggactacgagctgctggaccaggccgggtccggtggccccgggctcgcgtggcggatctacacggcgcggccgcgggacggcgccccctcggcgccctacccggtcgtctccgtctgggtgctcgacaagcgcgcgctcgccgaggcgcgggcgcgggcggggctgtccaaggccgccgaggacgccttcctcgacctagtccgcgccgacgcggcgcggctcgtgcgcctgcgccacccgggcgtgctccacgtcctgcaggcgctcgacgagaccaaggccgccatggccatggccaccgagcccgtcttcgcctccgtatctaacgcgctcgggtgcctggacaatgtcggcaaggttcccaaggagctcaagggaatggaaatggggctacttgagattaaacatggactgctgcaggttgcagagacgttagattttcttcacaacaatgcccatcttgcccaccgagctatatcgcccgagacagtttttataacttctagcggatcttggaagcttggtgggtttggttttgctctttcgattgaccaagctacaggaggtttgacttcatcaccgcaattccattattcggactatgacgttgaggatacagctttacctcttcaaccatcgttgaattacactgcaccggaattggtccgaagtggag

SEQ ID NO: 36007 - protein, 262 aa, Panicum virgatum
  misc_feature: Ceres CLONE 1964548
  misc_feature: SWISSPROT Homolog: EC 2.7.11.22 Cyclin-dependent kinase
MALNMKTLTQALAKASAVIEKTVSTTVQEVTGPRPLQDYELLDQAGSGGPGLAWRIYTARPRDGAPSAPYPVVSVWVLDKRALAEARARAGLSKAAEDAFLDLVRADAARLVRLRHPGVLHVLQALDETKAAMAMATEPVFASVSNALGCLDNVGKVPKELKGMEMGLLEIKHGLLQVAETLDFLHNNAHLAHRAISPETVFITSSGSWKLGGFGFALSIDQATGGLTSSPQFHYSDYDVEDTALPLQPSLNYTAPELVRSG

SEQ ID NO: 36008 - DNA, 691 bp, Panicum virgatum
  misc_feature: Ceres CLONE 1964548-R
ggtctctcaaattcaagtagttccagtgcaggccagagtatgatgcagccaaaatctgattttggatcactgtccatgacaaccaataatgccgctcatggcccacccaggcttgcccctcctccatccgctgctgttggaagaggccgtggtagaaatcaaggacagtcagcactctcacgagcatcacggccccctcattccaactcttcatcaggacaacaacctatccttgatttactttagtaagagaaggtcgcctttgttcttcctttcccaaatgtcaatgtgtacatcttcaaaccttttggatgctgagcatgatacagttcttggtcatgtatgtggtgaaagtgtattctcttgtcagttcgaagctgggtttatggttcgaagaaagctgcttcgggatcttgcagaggttacattttctctagcttcgggtttttatttcagcatggaggccatctccatattggcgagacaagaaatgttgttgtgtatatctctgtccaaaactcggctgtagcttgtagagttggtgaatatagtcagacatgtttatctgggatatgaagttttgaatgcttatagtgtaccaccatgtttaatgggccttatagatggaccctgctcatgtgtactccacactgcccagcttgatataattcatttgttctgtaaaggggtc

SEQ ID NO: 36009 - DNA, 679 bp, Panicum virgatum
  misc_feature: Ceres CLONE 1964551
  misc_feature: Encodes the peptide sequence at SEQ ID NO. 36010
atcccccattccgcccgcgcaaaaccctagctccaggctccagcgtcccccgcgaaccctctccctcgcagccgccgccacctctccaccatgccggacctcccctgcgacggcgatggtgtctgcatggtctgccgcgtcgcctccccgcccgaggtcgatctgctccgctgctccacctgcgccaccccgtggcactccccgtgcctctccaagccccccgccctcgccgacgccgccagctggagctgccccgactgctcccccgactcctccccggccccggctcccgccggccccgggaacgacctcgtcgccgccatccgcgccatcgaggccgaccacaccctctccgaccaggagaaagcgcggcgccgccaggccctcctcgccggctccgcccccgcggccgccgatgacgacgaggacgacaacgcggcggacgacgccctcgagatcgtggggaagaacttcagctgcgtcttctgtatgaagcttcctgaacgtcccgttacgacaccttgtggccataacttctgcttgaaatgcttccagaagtggattcagaatgggaaaaggacgtgtgggaaatgtcgggcgcagatcccggccaaaatggctgagcaaccaagaattaactctgcactagttgaagttatccggatggctaagatttcaa

SEQ ID NO: 36010 - protein, 196 aa, Panicum virgatum
  misc_feature: Ceres CLONE 1964551
  misc_feature (130)..(168): Pfam Name: zf-C3HC4 Pfam Description: Zinc finger, C3HC4 type (RING finger)
  misc_feature (11)..(60): Pfam Name: PHD Pfam Description: PHD-finger
  misc_feature: The sequence is a functional homolog of SEQ ID NO 2314 in the 10/374,780 US patent application
  misc_feature: The sequence is a functional homolog of SEQ ID NO 522 in the 10/225,066 US patent application
MPDLPCDGDGVCMVCRVASPPEVDLLRCSTCATPWHSPCLSKPPALADAASWSCPDCSPDSSPAPAPAGPGNDLVAAIRAIEADHTLSDQEKARRRQALLAGSAPAAADDDEDDNAADDALEIVGKNFSCVFCMKLPERPVTTPCGHNFCLKCFQKWIQNGKRTCGKCRAQIPAKMAEQPRINSALVEVIRMAKIS

SEQ ID NO: 36011 - DNA, 1332 bp, Panicum virgatum
  misc_feature: Ceres CLONE 1964553
  misc_feature: Encodes the peptide sequence at SEQ ID NO. 36012
gccgtcgtggaccgaacaaacctttccccaaaatttcccctacccctcaccgaacgaactctcgatccgatcccgatccctgcagggcgccgcctcggctccccgatccggacccggatctgctcgccgctcgacgggggctctcgattggacaagcatgctgcatcaggaaaacagtgagccttttgtcaggcgccactctgaacaacttgcatgctgcaacatgaggggagcagataacggtcgtccaaatttccttcctgagaaatgccagatagcagtctgtcagagggatgaaaaggttggcctattcgatgaagacttggtgcatggtgttctcctagccaatgctgcagttcagtcaccgatggtggccagtggtgtggaagaagcacctacagtggatcataacaagagacctgcatccagtgacattgcggacatagttgaatgcaaacggcagaagcaggaagatcaaattatacctaaggaggacaactatacaacaagtgctgatgtcactgttcatcagtatcccacatacacatcatatgaaagaggcttcaactcaccgacatatgagagtgaggaaagtgaagatgagggtgtagattcacctgtgcatttttcacttgctcatgcctatgttgaagatgatctatggtctgccagctttcatcaatcagtgggtccttgccccacaaggaaacctgttcctattggggcaaatcatcaggctgaattacctgagtgtaggccagttggtgggaaaacagaagatgagagcaacaagtggatcagaaacagtgtcatgccgatgctgggtactgatgctttgtctttgatgctgacacctgttcactgcaaggcaggctgtgattgtcttgatgaagattccatcgattgtgtgaggaaacatgtgagggaagcaagagaaaagctgaagatttcaattggagcagataccttcagggagttgggtttctatgatatgggagaggatgttgcctcaaggtggactgcagaggaggaacatctgttccaggaagtggtctcgtcaaatcctgcttctctgcgcagaaacttttgggatgaactccctcttgccttcccatccaaatccagcaaagaactagtgagctactacttcaatgtgttcatgttgaggaagagggctgagcagaacagatttgatcccatgaatgttgacagtgatgatgacgaatggcaggcaggtggtgatagcgagtttgcagtcactagaagaactgatgaatacttgccaactgagtcccttactgatcaagatgatgtcacatgtaatcaagttct

SEQ ID NO: 36012 - protein, 391 aa, Panicum virgatum
  misc_feature: Ceres CLONE 1964553
  misc_feature (284)..(334): Pfam Name: Myb_DNA-binding Pfam Description: Myb-like DNA-binding domain
MLHQENSEPFVRRHSEQLACCNMRGADNGRPNFLPEKCQIAVCQRDEKVGLFDEDLVHGVLLANAAVQSPMVASGVEEAPTVDHNKRPASSDIADIVECKRQKQEDQIIPKEDNYTTSADVTVHQYPTYTSYERGFNSPTYESEESEDEGVDSPVHFSLAHAYVEDDLWSASFHQSVGPCPTRKPVPIGANHQAELPECRPVGGKTEDESNKWIRNSVMPMLGTDALSLMLTPVHCKAGCDCLDEDSIDCVRKHVREAREKLKISIGADTFRELGFYDMGEDVASRWTAEEEHLFQEVVSSNPASLRRNFWDELPLAFPSKSSKELVSYYFNVFMLRKRAEQNRFDPMNVDSDDDEWQAGGDSEFAVTRRTDEYLPTESLTDQDDVTCNQV

SEQ ID NO: 36013 - DNA, 711 bp, Panicum virgatum
  misc_feature: Ceres CLONE 1964553-R
tttgaggctcatcaggttggcgctgaagctggggggacgcatactgatattgctgaagaccactacaggagtcatgggtttggtgctgttccagaatatggcttctttggagatcactgcgacacaaaaggttgggagtttggtttcactaccgggtgggacaagcatgattttctgtcgacaaataatgtcattgaagaggtgtttggaaaaggttctagcgaagatgggagtgacactgctagtggccaggaccttatctgagccaggggcggaggcttcttttcaactgcaaaagctttggcagtttcccttgtcgctcagaatttgtacagcagtagtttaccattttgatttgatgccttgttctttataggaatctctcatccctatccttgaacaatatctgcttgagaaacgtgatctcggtctcatgattaatgtaaattcgtagatgatatccgccatgtcgatgttctgctgtagcctgtagcatgtacgtaatgttgttatcactgtttcgggcctgagcattttttccatgtgccagcgagggtcatgtaataaaagctgtttattgttccttgagccgagatatccttctcattgagatttgccgtgttgatgacagcgtgattctgttcttgtgtgatgtaacccctttacccagtgcagcatttttaatctgaaattagttgtcagttggctgcg

SEQ ID NO: 36014 - DNA, 1261 bp, Panicum virgatum
  misc_feature: Ceres CLONE 1964610
  misc_feature: Encodes the peptide sequence at SEQ ID NO. 36015
attgcccccttgccccctctggaactaggggtttcgctgcctcttcttcgtcctccactcgtcttggcgtcctccaggctccactgctctgccttcctgagctggcttcttgctcgcaggagccatgccgaaggagtacccagcttctcccaaagcccaacagctgcaggaatccaagaagcagcgcctaacatacatccttgtggtgagcgccctctgcgtcgccttttatgtccttggtgcatggcagaacaccacgcttccaaagcccgtgagcaactctgcggacatcactcgggttgggtgtgaccctaccaccgccacggcacagtcctccggctctgtgccatccttcggaccaggttccggtgaggcactcgacttcgacgcacaccaccggctcatcatcaatgacacagatgccgccgcgggactgcagcagtttccggcttgcccgctcaacttcagcgagtacacaccgtgcgaggaccgtacacgtgggcgccggttcgaccgcgccatgatggtgtaccgggagcggcactgccctggcaaggacgagcagatacgatgcctcattcccgcaccgcctggttacatgacccccttcaagtggcctaaaagcagggactatgcctatttcaacaacatcccccacaaagagctcagcatcgagaaggctgtgcagaactggatccaggtggagggcgacaagttcaggttccctggtggcggcaccatgttcccacgtggcgctgatgcctacatcaatgatatcaataagctcatctcgttgtcagatgggacgatcaggactgcggtcgacacaggctgcggggttgctagctggggggcttacttgctgaagagaaacatcattgccatgtcttttgcgccaagggacacgcatgaagcgcaggtgcaattcgctctggaaagaggtgtccctgccatcatcggtgtgatggggaagcacaggttgccttacccatctagggcatttgatatggcacattgctcacgctgtctaattccttggtatgaacatgatggattataccttgctgaagtcgatagaattctaaggccaggaggatattggattctctcgggtcctccaatcaattggaagacacactacaaggggtgggagaggaccgaggacgacctcaagcaagagcaagacaagattgaggatgttgcgaggagtctttgctggaagaaggttgttgagaagggagatctctccatctggcagaag

SEQ ID NO: 36015 - protein, 378 aa, Panicum virgatum
  misc_feature: Ceres CLONE 1964610
  misc_feature (233)..(328): Pfam Name: Methyltransf_11 Pfam Description: Methyltransferase domain
  misc_feature: The sequence is a functional homolog of SEQ ID NO 758 in the 10/412,699 US patent application
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: The sequence is a functional homolog of SEQ ID NO 1593 in the 11/479,226 US patent application
  misc_feature: Functional homolog of the protein sequence given in SEQ ID NO 51175
  misc_feature: Useful for making plants with altered cell wall content and/or composition
  misc_feature: The sequence is a functional homolog of SEQ ID NO 2546 in the 10/374,780 US patent application
  misc_feature: The sequence is a functional homolog of SEQ ID NO 760 in the 10/412,699 US patent application
  misc_feature: The sequence is a functional homolog of SEQ ID NO 824 in the 10/225,066 US patent application
  misc_feature: The sequence is a functional homolog of SEQ ID NO 560 in the 10/412,699 US patent application
MPKEYPASPKAQQLQESKKQRLTYILVVSALCVAFYVLGAWQNTTLPKPVSNSADITRVGCDPTTATAQSSGSVPSFGPGSGEALDFDAHHRLIINDTDAAAGLQQFPACPLNFSEYTPCEDRTRGRRFDRAMMVYRERHCPGKDEQIRCLIPAPPGYMTPFKWPKSRDYAYFNNIPHKELSIEKAVQNWIQVEGDKFRFPGGGTMFPRGADAYINDINKLISLSDGTIRTAVDTGCGVASWGAYLLKRNIIAMSFAPRDTHEAQVQFALERGVPAIIGVMGKHRLPYPSRAFDMAHCSRCLIPWYEHDGLYLAEVDRILRPGGYWILSGPPINWKTHYKGWERTEDDLKQEQDKIEDVARSLCWKKVVEKGDLSIWQ

SEQ ID NO: 36016 - DNA, 752 bp, Panicum virgatum
  misc_feature: Ceres CLONE 1964610-R
  misc_feature: Encodes the peptide sequence at SEQ ID NO. 36017
agggttcattggcacataccagggactggtgtgaagctttctcaacatatccaagaacctatgacctcctgcatgctgacaatttgtttagcatctaccaagacaggtgcgatataacagatatcctcttggagatggataggatactaaggcccgagggcacagctatcatccgtgacacggttgacgtgctcacaaaagttcaggcaataaccaagcgaatgcggtgggagagccgcattatggaccatgaggacggccccttcaacccagagaaggtcctcatggcagtcaagacgtactggactgccaaagcatcggaagaacagaattagcacatacgcagtcgctgaagtctgaatcaggcttgttccacaagctgtgatgatggtgtgagggtttcaccatctcagagtagtatgagaccacttggtcacatgattcctttcgcttttctcaaattctttgtagttccagtcagatgagaaggttgaggaaggttttggggtgtggttgagcatctagcgatacaagaactggttctgtagcaggggaaaaatgctgatcttgcataggttcctggcccagtttctcatgaggggaagagcatagcttttagtttgtaatgtgatggcaccgagcaggccttttaggaatattgcgttaactgaaataggtatttattcagtttgcctctaaactctgaactttctagtgcttgaatattgaggtgggcagttcagttctcgtgc

SEQ ID NO: 36017 - protein, 110 aa, Panicum virgatum
  misc_feature: Ceres CLONE 1964610-R
  misc_feature: SWISSPROT Homolog: EC 2.4.2.7 Adenine phosphoribosyltransferase
  misc_feature: The sequence is a functional homolog of SEQ ID NO 758 in the 10/412,699 US patent application
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 1593 in the 11/479,226 US patent application
  misc_feature: Functional homolog of the protein sequence given in SEQ ID NO 51175
  misc_feature: Useful for making plants with altered cell wall content and/or composition
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: The sequence is a functional homolog of SEQ ID NO 560 in the 10/412,699 US patent application
  misc_feature: The sequence is a functional homolog of SEQ ID NO 64 in the 10/666,642 US patent application
  misc_feature: The sequence is a functional homolog of SEQ ID NO 556 in the 10/412,699 US patent application
GSLAHTRDWCEAFSTYPRTYDLLHADNLFSIYQDRCDITDILLEMDRILRPEGTAIIRDTVDVLTKVQAITKRMRWESRIMDHEDGPFNPEKVLMAVKTYWTAKASEEQN

SEQ ID NO: 36018 - DNA, 957 bp, Panicum virgatum
  misc_feature: Ceres CLONE 1964615
  misc_feature: Encodes the peptide sequence at SEQ ID NO. 36019
agacgcaggtgcagcttccccccgcccctcatctccgccagccacctgccgccggcgagccccgctgcgcgcatctccgccgccgccgccgcccccgccgccgccgctgccccatagcaaaatcctccctccctcttgctccctctccccgcccctcgcattgattcaatttccctcccacttggagccaccgaattcaagcgtagaaagcaattaaatcctgccaaaactagcagcggcaataccctaggcggctctcccctctcccccgagctcgaggcagccgaccagcgcagccgccgccctctgtttctgcgcagtggcggccgcgccgtcctctgcctccgccaccaccagctgctggggcgccgccgcacctctcacctgtcctggtcggggtggagcggagccggtttcgccttccccttggtaggagattgctgcgggccattgtcccgccccaatccatccgtccatggcccgcgcgggctcgtcttcctcagggcgcagtgcggatatgcccacgcaagttgagaacgtctttgagcaattgatcagcaagatagaagctgcggattttgatccgcgacccttattgaaacaatgtaatgcgttaggccgctatgaaccaatcaagcggaatgtataccgcattaagagacgcactgaagattatggcattttctgttcctgtaagccttcgtctggttcatcagttgcatgtggcaaagactgccattgtgggatgctgttctcttgttgttcatcaagctgtgaatgtgataacacttgtgccaacaaaccattccagcacagacctctgaagaataccaaattgattacaacagagaaatgtggatttggattggtagctgaggatgaaataaagaaaggagaatttgttgtagaatatgtgggggaagttattgatgacagaacatgcgagaaaagattatg

SEQ ID NO: 36019 - protein, 160 aa, Panicum virgatum
  misc_feature: Ceres CLONE 1964615
  misc_feature: SWISSPROT Homolog: EC 2.1.1.43 Histone-lysine N-methyltransferase
MARAGSSSSGRSADMPTQVENVFEQLISKIEAADFDPRPLLKQCNALGRYEPIKRNVYRIKRRTEDYGIFCSCKPSSGSSVACGKDCHCGMLFSCCSSSCECDNTCANKPFQHRPLKNTKLITTEKCGFGLVAEDEIKKGEFVVEYVGEVIDDRTCEKRL

SEQ ID NO: 36020 - DNA, 657 bp, Panicum virgatum
  misc_feature: Ceres CLONE 1964616
  misc_feature: Encodes the peptide sequence at SEQ ID NO. 36021
acaccctcgccccgaccgccgggccgtcgtcgccgatctcgacgccgccgcccgccatggccgccgccgccacttcgcctccggttcctttaggacccgaggccttctctctcccgggcctccttcccagcactacgcagccatgcagaaagaagcgagatggagtccaaggcgtgtgttattgatcctgctctgcttccaactctagagggtttactgctggaaacgtatgcatcattgcaaccaaagccagtcgactatgagaaccgacaggttatgatcaatgtcttcaacaaaatagcggaagagatttttggtaaaaagaacgggcttcctgttgcagaagcattcggattattcacaatggatctatttactcctgaaagtgaccttgacctctcgatcaactttaatactgataccaaggatctgtatcctcgcaaggacaagattaatgctattaggaagcttacaaaaatcctatattctcatcagaggcatggtcgttgttatggggttttacctatttcaactgctagagttcctgtattgaaggttactgatcagggaactggtgtagagtgtgatatttcaatagaaaacaaagatggcatgtcaagatcaatgataattaaatttatctcatcaattgatgaa

SEQ ID NO: 36021 - protein, 165 aa, Panicum virgatum
  misc_feature: Ceres CLONE 1964616
  misc_feature: SWISSPROT Homolog: EC 2.7.7.19 Polynucleotide adenylyltransferase
MESKACVIDPALLPTLEGLLLETYASLQPKPVDYENRQVMINVFNKIAEEIFGKKNGLPVAEAFGLFTMDLFTPESDLDLSINFNTDTKDLYPRKDKINAIRKLTKILYSHQRHGRCYGVLPISTARVPVLKVTDQGTGVECDISIENKDGMSRSMIIKFISSID

SEQ ID NO: 36022 - DNA, 1360 bp, Panicum virgatum
  misc_feature: Ceres CLONE 1964624
  misc_feature: Encodes the peptide sequence at SEQ ID NO. 36023
aaacggcgacgcgtgttccggccaccgccgccggttagcgaccgccgggggccggggccccgagacctttcgagattgttcccggcctctctcttcttctccccccttgcaacatgccttcgtcttccccgcgtctcacgccccacaagtcaatattctagagcttatccacacacgcgggaccgggacggcgggagttccccgtcgcctttcctacatggcgctgacgaggctggtcatcatgtcctcgctcccgcttccttctccgtcgtataagatgtcgcgctgctgccgcgaccgcggccgccggctcctcctccgcagagcaatgtcggtagcctccgatcacctcagcaccgtcgcgccgacgccgcggcggcagcagcagcagatgatggcgcggctcgagcacgggtccctgctggtcggcgggcgcgagctcctcgcccgcgccccgcccaacgtcaccctccgccccgccggcgtccccggcgccgcgttcctgggagccagggcggcggagccgtccagccgccacgttttctcggtcggcaccctggctagtgggtggaggtggatgtccctgttcagattcaagatctggtggatggccccggccacgggcgccggcgcggcggccgtgccggcggagacgcagatgctgctcttggagtccaggggtgaggcgggttctgccgccgcggaggggaggagcgcggtgtacgcgctgatgctgccggttcttgacggcgatttcagggccagcctccaggggagcccccagaacgagctccagttctgctttgagagcggtgatcctgaggtccagacgatggaagcggttgatgcggtattcatcaactcaggggataacccattcaagctaatgaaggaatccatcaagctgctatcgaagatcaaaggaactttcaggcatatagaggataaggagattcctgcaaatttggactggtttgggtggtgcacatgggatgcattttacaaagctgttaacccaacagggatcgaggagggccttcagagtctgcgcgaaggtggtgcgccaccgaggtttctgattatagatgatggttggcaagaaacagtggacgaattcaaggaagtggatgaaaccctccgtgagcagactgtgtttgcacagaggctgactgatctgaaggagaatcataagttcaggggagaaacctgcaagaatcttggggacctcatcaagaagatcaaagaaaaacatggagtcaagtttgtttacatgtggcatgctttacttgggtattgggggagtgtcttagcaacatctgatgccatgaaaaaatacagcccaaagccttgcttcccagtc

SEQ ID NO: 36023 - protein, 343 aa, Panicum virgatum
  misc_feature: Ceres CLONE 1964624
  misc_feature (24)..(342): Pfam Name: Raffinose_syn Pfam Description: Raffinose synthase or seed imbibition protein Sip1
  misc_feature: SWISSPROT Homolog: EC 2.4.1.67 Galactinol--raffinose galactosyltransferase
MSVASDHLSTVAPTPRRQQQQMMARLEHGSLLVGGRELLARAPPNVTLRPAGVPGAAFLGARAAEPSSRHVFSVGTLASGWRWMSLFRFKIWWMAPATGAGAAAVPAETQMLLLESRGEAGSAAAEGRSAVYALMLPVLDGDFRASLQGSPQNELQFCFESGDPEVQTMEAVDAVFINSGDNPFKLMKESIKLLSKIKGTFRHIEDKEIPANLDWFGWCTWDAFYKAVNPTGIEEGLQSLREGGAPPRFLIIDDGWQETVDEFKEVDETLREQTVFAQRLTDLKENHKFRGETCKNLGDLIKKIKEKHGVKFVYMWHALLGYWGSVLATSDAMKKYSPKPCFP

SEQ ID NO: 36024 - DNA, 789 bp, Panicum virgatum
  misc_feature: Ceres CLONE 1964624-R
  misc_feature: Encodes the peptide sequence at SEQ ID NO. 36025
ttcaattgtcaaggagccgggcaatgggtttggccagtgaaagacattgcttatgttcccaccagcattaacatcaccggccatctctccctttcagatgtagaatctcttgatgagattgccggtgatagttggagtggagagactgcagtatatgctttcaattcatgttctctttcaaggcttcagaagcaccaaaatttggaggtttcactgtctaccatggcatgtgagatctacactatttcaccgataaaggttttcagcgaagccgttcagttcgcacctctgggactgatcaacatgttcaactctggcggcgcacttgatgatgtctcgagcaccgctgattcttcagctaccacaattcacgtcagatgccgagggccagggcggttcggggcgtattcagccacccggccggagctctgcagagtcgatggacagcaagtggagttcagtcatacagaggatggcctgctagcctttgaccttcctcaccgttcatcccacgacggcgaccggtggcacattgagattctctacagaactctctgaacgtttaccgtcccaacaggcgatttcctgccattctctatggtaactgcaacgcgtgcacatgttcagaggaagttttcagagaagccaatgttcagttggttctgctagattgtgctgcattttgcaatggccacacgtgtgtaattttttattcacaatgcgattgttgtgttgtattggtatactgtgatttggtatgaaagagagcaccagcgccaattctgtggc

SEQ ID NO: 36025 - protein, 185 aa, Panicum virgatum
  misc_feature: Ceres CLONE 1964624-R
  misc_feature: SWISSPROT Homolog: EC 2.4.1.67 Galactinol--raffinose galactosyltransferase
FNCQGAGQWVWPVKDIAYVPTSINITGHLSLSDVESLDEIAGDSWSGETAVYAFNSCSLSRLQKHQNLEVSLSTMACEIYTISPIKVFSEAVQFAPLGLINMFNSGGALDDVSSTADSSATTIHVRCRGPGRFGAYSATRPELCRVDGQQVEFSHTEDGLLAFDLPHRSSHDGDRWHIEILYRTL

SEQ ID NO: 36026 - DNA, 679 bp, Panicum virgatum
  misc_feature: Ceres CLONE 1964642
  misc_feature: Encodes the peptide sequence at SEQ ID NO. 36027
aaagctactcgctgtcctgaggcagcggcgcaagtgcgcaaagccgagcgcgagaacccacgaaaccaaccaagagctccgcccccattaaggcaggcaggcaggcaggcaggctcgctgcagcactccatcgtcgttgtcctctccctgtaatgtcactcccccgaagcttgcccgcagctcaatggccatgaggacgacggccgcgcccacctcccgtgccctcgtcgccctcctcctcctcgccgtcgccgtcgccgacgacggttcgacgctgctggagatcaagaagtccttccgcaatgtcggcaacgtactgtacgattggtccggcgacgactactgctcctggcgcggcgttctgtgcgacaacgttaccttcgccgtcgctgctctcaacctctctggactcaaccttgggggcgagatctccccagccgttggcagcctcaagagcctcgtctcgatcgatctgaagtcaaatgggctgtccgggcagatccctgatgagattggtgaatgttcatcacttaagacgctggacttgtctttcaataacttggatggggacataccattttcgatatcaaagttgaaactccttgagaacttgatattgaagaacaatcagctgattggtgcaattccatcaacactgtcacagctcccgaatttgaag

SEQ ID NO: 36027 - protein, 164 aa, Panicum virgatum
  misc_feature: Ceres CLONE 1964642
  misc_feature (24)..(62): Pfam Name: LRRNT_2 Pfam Description: Leucine rich repeat N-terminal domain
  misc_feature: SWISSPROT Homolog: EC 2.7.11.1 Non-specific serine/threonine protein kinase
MAMRTTAAPTSRALVALLLLAVAVADDGSTLLEIKKSFRNVGNVLYDWSGDDYCSWRGVLCDNVTFAVAALNLSGLNLGGEISPAVGSLKSLVSIDLKSNGLSGQIPDEIGECSSLKTLDLSFNNLDGDIPFSISKLKLLENLILKNNQLIGAIPSTLSQLPNL

SEQ ID NO: 36028 - DNA, 1114 bp, Panicum virgatum
  misc_feature: Ceres CLONE 1964645
  misc_feature: Encodes the peptide sequence at SEQ ID NO. 36029
gaaagaaaaggcatcatatttctcctactctgcctccaatccctcccctgccagagccaagggcaccatcagctcatcccatttgggcattacctccaccaccacctaattcagattgcaattcattatcatgccctgagcctctaacagatccacctgcgggagccccatgtgcctgtgttctaccaatcagagtcggaattcgtctaagtgttgacctttattcattctttccgttggtctctgattttgctgaggaggtatcttctggggtaaacatggcacaaaggcaggttcgtgtgatgggtgcaaatgttgccagtgatcaacctgacaaaacaatggttcttgttgatctagtaccaatgcaagcgaagtttgacaatgctacagaattttcagcatttgaaagcttgtggagcaaaaaagtttctttaaaatcatcagtctttggggactatgagattctctatgttgtatatccagggcttcctccttcaccaccttcagcaccagaaggtgttggtgatggggcatttggcaacaacagaaatgcaagggcaatgaagcctctaggggtcgatataagaagacccaagagaaaagtgaacggcagcctaatcgctattgctgttttgtctaccattatagcattgattatttgctgtctggctgcatggttgctgatactcaggttcaggggtccaagtgacacagctcaaggattcgcacatagtgtacttccaaaattttctaggtcatctggcactggtcacatgcttttagctggtgctggtcgccatagttcaccttctggtccgtcaggttccctgggctcaagtatcgcaacatacacagggcaagcaaaaacattcaaatttgctgagattgacaaggccacaaatggctttgatgattcaaaagtacttggcgaaggtggctttggatgtgtctaccagggcacacttgaagatggaacgacggttgcggtgaaggttctgcagagatatgatggccagggtgagcgagagttcttggctgaggttgagatgctgggccgtttgcaccaccggaatttggtcaagttgttaggcatatgcatcgaggagaatgc

SEQ ID NO: 36029 - protein, 370 aa, Panicum virgatum
  misc_feature: Ceres CLONE 1964645
  misc_feature: SWISSPROT Homolog: EC 2.7.11.1 Non-specific serine/threonine protein kinase
KKRHHISPTLPPIPPLPEPRAPSAHPIWALPPPPPNSDCNSLSCPEPLTDPPAGAPCACVLPIRVGIRLSVDLYSFFPLVSDFAEEVSSGVNMAQRQVRVMGANVASDQPDKTMVLVDLVPMQAKFDNATEFSAFESLWSKKVSLKSSVFGDYEILYVVYPGLPPSPPSAPEGVGDGAFGNNRNARAMKPLGVDIRRPKRKVNGSLIAIAVLSTIIALIICCLAAWLLILRFRGPSDTAQGFAHSVLPKFSRSSGTGHMLLAGAGRHSSPSGPSGSLGSSIATYTGQAKTFKFAEIDKATNGFDDSKVLGEGGFGCVYQGTLEDGTTVAVKVLQRYDGQGEREFLAEVEMLGRLHHRNLVKLLGICIEEN

SEQ ID NO: 36030 - DNA, 628 bp, Panicum virgatum
  misc_feature: Ceres CLONE 1964655
  misc_feature: Encodes the peptide sequence at SEQ ID NO. 36031
aaaccctagtgctcactccaccgcggcgcccaccaccgcgatcggggctcgattccgatggacttcgcggagctggaggcggtggagggcctccggtggccgtggcactcgtggccgccgactcccgccgcggccgcgtcgctcgtcgtccccaccgccgtcctctgctcgccgctgcagcaccccacggcgcccgacctcctcccgctgctcccctacgcgccgctccgctgcgccacccccggatgcggcgccgcgctcaacccgttctcccgcgtgcaccacggctccgcgcgctggtcctgccccttctgcggcgccggcgccaacccgttcccgcgccgtctggcgcccgacgcgctcccagccgagctcttccccacccactccagcgtcgagtacgcgctgcccgttgaccccgcagaggcaggcgggccggggccgcccgcgctcgtgttcgtggtggacgcggccacggagccggcggagctcgccgtgctcaagggcgaggtgcgcagggtcgtacaggggctgcccgagggtgtcagggtggcgctcgtcactttcgctgcgtcggtgtgggtgcatgatctcggatttgaagggtgcgttcgggtggttgtgatca

SEQ ID NO: 36031 - protein, 190 aa, Panicum virgatum
  misc_feature: Ceres CLONE 1964655
  misc_feature (55)..(97): Pfam Name: zf-Sec23_Sec24 Pfam Description: Sec23/Sec24 zinc finger
MDFAELEAVEGLRWPWHSWPPTPAAAASLVVPTAVLCSPLQHPTAPDLLPLLPYAPLRCATPGCGAALNPFSRVHHGSARWSCPFCGAGANPFPRRLAPDALPAELFPTHSSVEYALPVDPAEAGGPGPPALVFVVDAATEPAELAVLKGEVRRVVQGLPEGVRVALVTFAASVWVHDLGFEGCVRVVVI

SEQ ID NO: 36032 - DNA, 746 bp, Panicum virgatum
  misc_feature: Ceres CLONE 1964656
  misc_feature: Encodes the peptide sequence at SEQ ID NO. 36033
ctaccaacttagctggcaatgtttctgtcttgccaatttttggcattggcgggattgggaagaccaccctagctcagctcatctacaatgacgaaagggtgagagcccactttacggtgaggatatgggtctgcgtttctgacctctttgacgatgaacgaatgacaaaggagatcgtcaagcccatctctgagccaaagattgaattaccgtgtgatataggtgatcttcgagtacaactgaaggagcagctgaagagccaaaagttccttttggtactagatgatatttggcagatttcccaacagcaatgggagtatttttatgcaccgttgaggtgtggccttgaaggtagcatgatcttagtgactacaagacaccaaaacatcgcccatcttgttgctacgagcaattgtgagcctgtccaactcaaaggattgccagatgatacattttgggaattcttcaaggaatgtgcatttggcagaaagctcccagagtcatatcctcgcttgcaagagattggccggaaaatttgctttaagttgcgcggcactcctttggctgccaaaactctcggacgcttgttgaatagtaagctgtctgaggaccattggagctacatcgagggcagtgaattatgggagcaatcccaaaaggatggcgatatattaccagccctttgtctgagctacctgtatctcccaattgaacttaggagatgctttgcattttgctccatgttt

SEQ ID NO: 36033 - protein, 247 aa, Panicum virgatum
  misc_feature: Ceres CLONE 1964656
  misc_feature (1)..(247): Pfam Name: NB-ARC Pfam Description: NB-ARC domain
TNLAGNVSVLPIFGIGGIGKTTLAQLIYNDERVRAHFTVRIWVCVSDLFDDERMTKEIVKPISEPKIELPCDIGDLRVQLKEQLKSQKFLLVLDDIWQISQQQWEYFYAPLRCGLEGSMILVTTRHQNIAHLVATSNCEPVQLKGLPDDTFWEFFKECAFGRKLPESYPRLQEIGRKICFKLRGTPLAAKTLGRLLNSKLSEDHWSYIEGSELWEQSQKDGDILPALCLSYLYLPIELRRCFAFCSM

SEQ ID NO: 36034 - DNA, 1113 bp, Panicum virgatum
  misc_feature: Ceres CLONE 1964659
  misc_feature: Encodes the peptide sequence at SEQ ID NO. 36035
acgaataccgccgccccccttccgcctctcctcatcctcctcctcctcccttctcccccgttgttgccgtgggtatcggatttctccacctgctggaggtcgctcgatcggcaagagcagagatggcggcggtgagggtggacaaggccaccaacgagctgctgctgggccccgactggaccctcaacatcgacatctgcgacgccgtcaactccgatcacgggcaagcaaaagaagtgattaaagctctgaaaaaacgtcttcagcacaagaatgcgaatgttcaatttcttgctttgacgcttttagagactctaataaagaactgtggggatcacgtgcatgttcaagtcatagagcgcaatatactggaggaaatgatgaaaattgtgaagaaaaaggcagatatgcaagtgagggacaaaattctaacactcctggattcttggcaagaagcatttggcgggcctggtggaaagcaccctcattattactgggcatatgctgaattgaagcgatctggtgtggaatttcctaagcgctcacctgatgctgcaccgatatttactcctccggtcacacgtccagcatctttgccatcatatcttcaagcagggtatggaatgccagtcgattctttgtcaaggcttgatgtggcaatgtcatctaatggagcttctctgagcatgctagacttggaacatatgctgggagctgtggaactattaaatgagatgttgagagctgtggatcccaatgatcaggatgctgtcaacgaggaaattatcgcggaacttgtgaaccaatgtaggtcggaccaaaaaaagatcttgagcttggtaagttcactaaggtatgtgactgcatcacacttttggttttcatctatgatccgtttcttgagtagacgttgtaccaataccatcagttttggccactacactgttgttgtgaaatttgatttgcatctgaatgttacagttacaagctactgagattattcaataaatctatgaggctagggacaaagattatcgccatcaattagttacatcttgcatcaattagttacatccttgctaagtgagcacgtccgtttgaaagcttgggtcc

SEQ ID NO: 36035 - protein, 290 aa, Panicum virgatum
  misc_feature: Ceres CLONE 1964659
  misc_feature (1)..(134): Pfam Name: VHS Pfam Description: VHS domain
  misc_feature (180)..(287): Pfam Name: GAT Pfam Description: GAT domain
MAAVRVDKATNELLLGPDWTLNIDICDAVNSDHGQAKEVIKALKKRLQHKNANVQFLALTLLETLIKNCGDHVHVQVIERNILEEMMKIVKKKADMQVRDKILTLLDSWQEAFGGPGGKHPHYYWAYAELKRSGVEFPKRSPDAAPIFTPPVTRPASLPSYLQAGYGMPVDSLSRLDVAMSSNGASLSMLDLEHMLGAVELLNEMLRAVDPNDQDAVNEEIIAELVNQCRSDQKKILSLVSSLRYVTASHFWFSSMIRFLSRRCTNTISFGHYTVVVKFDLHLNVTVTSY

SEQ ID NO: 36036 - DNA, 1104 bp, Panicum virgatum
  misc_feature: Ceres CLONE 1964661
  misc_feature: Encodes the peptide sequence at SEQ ID NO. 36037
aaagaaaggcgagagccgcccaccaggaaaggaacgcggccaatctggtgcggcggtggcggtggtggtggtggtttcgcatcaccaccaggaaaggaggcctcccgctgctcgcgcctccgatcccaatccgcccagtggccgccttccccctgcctaggaaggtagggctgctcggcggaggccatggcgggcgccatggtggaccgggccaccaccgaccacctcatcggccccgactgggctaagaacatggagatctgcgacatctgcaaccgcgaccccgggcaatcgaaagatgtcgtgaaggcactcaaaaagaggatagggcataaaaatccaaaagttcaactacttgcactaactctgttggaaactgttataaagaactgtggggatatactccacatgcatgttgcagagagagatgtattgcatgagatggttaaaatagtaaagaaaaagtctgatccacgtgtcaaagagaaagtcttggtgctaatagatacatggcaagaatcttttgggggcccacgtgcaagatatccacaatactatgcagcataccatgagttggcgcgtgccggagctgaatttcccaagagacctgatagacccgcacccttatttaatggacagtctcaagcagcaaaaaatatacgtagtcctgatcaacaggatgaagctgaatcttcagctgccaatgactttcctgccttgagtgtgtcagagattcagaatgctcgtggtattatggatgtactagcagagatgctgaatgctttagaccctggtaacagagagggactaaggcaggaggttattgtggaacttgtcgaccagtgtcgcacttacaagcagagagcggtgcagctggttaatagtacctcggatgaggaacttatgtcactggggcttgcactgaatgatgatttgcagcgtgttctagcgaaacatgatgcaatagcagcaggaattgcagttcgagtggagaaaaaaccgaagtctctgcaagcacttgtagatactgaggattctgcaaaccaagaggctagcaaagaaaacacactcatagattttgaggatcccacaccccaggatact

SEQ ID NO: 36037 - protein, 305 aa, Panicum virgatum
  misc_feature: Ceres CLONE 1964661
  misc_feature (1)..(134): Pfam Name: VHS Pfam Description: VHS domain
  misc_feature (173)..(271): Pfam Name: GAT Pfam Description: GAT domain
MAGAMVDRATTDHLIGPDWAKNMEICDICNRDPGQSKDVVKALKKRIGHKNPKVQLLALTLLETVIKNCGDILHMHVAERDVLHEMVKIVKKKSDPRVKEKVLVLIDTWQESFGGPRARYPQYYAAYHELARAGAEFPKRPDRPAPLFNGQSQAAKNIRSPDQQDEAESSAANDFPALSVSEIQNARGIMDVLAEMLNALDPGNREGLRQEVIVELVDQCRTYKQRAVQLVNSTSDEELMSLGLALNDDLQRVLAKHDAIAAGIAVRVEKKPKSLQALVDTEDSANQEASKENTLIDFEDPTPQD

SEQ ID NO: 36038 - DNA, 437 bp, Panicum virgatum
  misc_feature: Ceres CLONE 1964661-R
cctatctcagaagatgtatggtctttctatgcagggcagttcgtacatgggtacaaactcgtcctaccagaaccagacagtgccctccgcttcaccttccatggggcaacccatcaagccaacgaagccggaagacaagcttttcggtgaccttcttaacattgccaagaaacgatgaatgggagtagtgtgtggtgcatgctctaatatatcctctcctgtatttttttttgttgcaaattttcatgtggcttgattatctcaattacacctgtagcattgtgtggaatgtataagtttttgtttatccttgttattgtggcccgattgatttaatttgattcttattatgccggccgtgtgtactgatcaccagacaggaaaagctggtaaatgatgattttcaataaagaggtgtgcagtactctttttggttt

SEQ ID NO: 36039 - DNA, 736 bp, Panicum virgatum
  misc_feature: Ceres CLONE 1964664
  misc_feature: Encodes the peptide sequence at SEQ ID NO. 36040
cccatcgagagcggcggctcggctcccccgacccgcacccctcgccggcgccgctgcctcagtcccagtcctccggatcggctcgctcctcgcctctctcccaaatcaatctcgtcagcggcaggccagcatggagagctcgaccctcaccgatatgacgctcctgcccggcgtcgagacgatcgtggcggggctggccgccggctcctcctccccgggtccggatggcaaggtcaagaagaagcccatgaagtccctctacctcaagttcttcgacacggcgcccgacggcaagtcccgcatctgcaggctctgcaggaagagctactgcatgaccactgccacggggaatttgggaaagcatcttaataaccgccaccctggttatcaccaacttcctgaaggccccagcttcactgctcagagtaccgtacagactaccatggttactagaagcaagaaacctcatgttccggtgcgagctcgggcccaagcacagcctcaagttcaaagtcaatctcaaattcaagatcaacctcaagctaaagttcattctcaacctaagatgaaaccagctgttgatattgaccatgtcaactggttacttcttaggtggcttattggctcctcccttccaccttccaccctcgaagataatatgcttattgacagttgcaagtacctgagctcgtctgtcaggctttggccaaaaagaaagggttcagaaattacccta

SEQ ID NO: 36040 - protein, 201 aa, Panicum virgatum
  misc_feature: Ceres CLONE 1964664
  misc_feature (42)..(84): Pfam Name: zf-BED Pfam Description: BED zinc finger
MESSTLTDMTLLPGVETIVAGLAAGSSSPGPDGKVKKKPMKSLYLKFFDTAPDGKSRICRLCRKSYCMTTATGNLGKHLNNRHPGYHQLPEGPSFTAQSTVQTTMVTRSKKPHVPVRARAQAQPQVQSQSQIQDQPQAKVHSQPKMKPAVDIDHVNWLLLRWLIGSSLPPSTLEDNMLIDSCKYLSSSVRLWPKRKGSEIT

SEQ ID NO: 36041 - DNA, 719 bp, Panicum virgatum
  misc_feature: Ceres CLONE 1964673
  misc_feature: Encodes the peptide sequence at SEQ ID NO. 36042
aaaaaaatatcatgactgtggaaattcgctcgaaaaattcagagtttgttggctgcactttggttcagactctagctaatttagtttccaactacatgggtggaccagtcattgatccagaaagcatgctgttgaagtaccggaaaatgagcagtgcattgagagctgatataagaagtgcagttatacctcttgggcagctaaaagttggtttggctcagcaccgtgcactgctttttaaggtgttggcagacagcattgctgttccttgtcgactagttaaaggaaggcagtacactggatcagatgatggagctttgaacatcgtgaaatttaatgatggaagggaatgtattgttgatctcatgatagatcctggtactcttattccatcagatggtgccgacctgtgtagagaaatggaagactgtttattcgtagatgatcaacatgacagtaacactcagttgatttcttctttcagtgaagcttcaagttccattcatggttcacttgaacacgaatcacttgaaaaagaattcacacctagcaatgctgggaattctggtccatatggagcaacaaatgcccagactgacaatgacgtatctgggtctggggtctcaagttcatttgaggaactatcatttagcacatatgcgagtgaaaatgtgcctattatccatgaatcttatgcagatcataccgtgacttcaaaa

SEQ ID NO: 36042 - protein, 238 aa, Panicum virgatum
  misc_feature: Ceres CLONE 1964673
  misc_feature: SWISSPROT Homolog: EC 2.7.11.1 Non-specific serine/threonine protein kinase
KNIMTVEIRSKNSEFVGCTLVQTLANLVSNYMGGPVIDPESMLLKYRKMSSALRADIRSAVIPLGQLKVGLAQHRALLFKVLADSIAVPCRLVKGRQYTGSDDGALNIVKFNDGRECIVDLMIDPGTLIPSDGADLCREMEDCLFVDDQHDSNTQLISSFSEASSSIHGSLEHESLEKEFTPSNAGNSGPYGATNAQTDNDVSGSGVSSSFEELSFSTYASENVPIIHESYADHTVTS

SEQ ID NO: 36043 - DNA, 952 bp, Panicum virgatum
  misc_feature: Ceres CLONE 1964683
  misc_feature: Encodes the peptide sequence at SEQ ID NO. 36044
gcaccgtacctgcttacccatcccacctccagcccccctctagctcctcgcattgccgccgcgccacccggtagagagtgggaggctagatagctagctgcgagtacttacgctcgccggcgctgggcgttcgtgccgtgcgcggctgctccggtaaatgactggcggccttgccggcgtcgtcgaggtcgtggtgctggctccgctctcgttcgtggcgtgcctgtcgtccccatcgccggagccgtcgtcgtcgtcgtcgctgcgcgctcgcgccggagggtttatcaacgaaggctaaatcttgctggcaatacgatcttccaacgcctccttacagaaagactgaagaaattcctgaacaagctgcagagaatagattaagcaagcaagcagcctgaaagtgaaggttcataaagcccattgaacaaggtgatggatcccaccactgttgagtcgaaatgggtgtctcccaccactgaagatgggtcaatggacaggcgaggaaacccagctgtcaaagcagcaaccggaagatggagatctgccatcctgctgctagctaactacgggctcgtgacgtgcggcttcttcggcgtcggtgtgaacctggtggtgttcctgcggcgggtgctccaccaggacaacgccgaggcggccaacaacatcagcaagtggaccggcaccgtctacatcttctcgctcatcggcgccttcctcagcgactcctactggggccgatacgtcacctgcgccatcttccagatcatctacgtgacgggcctggtgatcctgtcgcttgcgtcatggttcttgctagtgaagccttccggctgcggcggcgtcgatgcgcactgcgacgagccgtcggcgcccggcgtggcgctcttctacctgtccacctacatgatcgcgttcggcaacggcgggtaccagccttcgatcgccacgt

SEQ ID NO: 36044 - protein, 172 aa, Panicum virgatum
  misc_feature: Ceres CLONE 1964683
  misc_feature: Functional homolog of the protein sequence given in SEQ ID NO 51119
  misc_feature: Useful for making plants with altered carbon content
  misc_feature: Useful for making plants with altered nitrogen content
MDPTTVESKWVSPTTEDGSMDRRGNPAVKAATGRWRSAILLLANYGLVTCGFFGVGVNLVVFLRRVLHQDNAEAANNISKWTGTVYIFSLIGAFLSDSYWGRYVTCAIFQIIYVTGLVILSLASWFLLVKPSGCGGVDAHCDEPSAPGVALFYLSTYMIAFGNGGYQPSIAT

SEQ ID NO: 36045 - DNA, 782 bp, Panicum virgatum
  misc_feature: Ceres CLONE 1964683-R
  misc_feature: Encodes the peptide sequence at SEQ ID NO. 36046
gcccgggtgctggtccccgtgacggcgcggctgtcgggcaacccgcagggcctgacggagctgcagcggatgggcgtcgggctcgtgatcggcatggcggccatggtggtggcgggcctgatggaggtggagcggctgcggcgcgtgtcggccccggaccagccgagctccctgagcgtgctgtggcaggtgccgcagtacgcgctgatcggggcgtcggaggtgttcatgtacgtggggcagctggagttcttcaacgggcaggcgcccgacggcgtgaagagcttgggcagcgcgctgtgcatggcgtccatctcgctggggaactacgtgagcatcatgctggtgagcgcggtcaccagcctcaccgccggggagaggcggccagggtggatcccggggaacctcaactccggccacctcgataggttctacttcctcctcgccgcgctctcgctcgtggacctcgccgtgtacatcgcctgcgcggcgtggtaccagggaatcaagctcgacggcgccggcggcgagacgaggaaggcccccgcgcacgtttaaacactgggcctgggcctttcttttttgggtgttctggtttggagacgtgccgggctggtccgtagaaaataaaatgtcaaagagctggcagttctgtgttggatggcccatgttgttctgtgtctttggtcgagttccaagaatccataaaaaaatatagtacatgtaatgctactatttatgtatatatgtaataaatatagtatatgtatggatgtcggctg

SEQ ID NO: 36046 - protein, 185 aa, Panicum virgatum
  misc_feature: Ceres CLONE 1964683-R
  misc_feature: Functional homolog of the protein sequence given in SEQ ID NO 51119
  misc_feature: Useful for making plants with altered carbon content
  misc_feature: Useful for making plants with altered nitrogen content
ARVLVPVTARLSGNPQGLTELQRMGVGLVIGMAAMVVAGLMEVERLRRVSAPDQPSSLSVLWQVPQYALIGASEVFMYVGQLEFFNGQAPDGVKSLGSALCMASISLGNYVSIMLVSAVTSLTAGERRPGWIPGNLNSGHLDRFYFLLAALSLVDLAVYIACAAWYQGIKLDGAGGETRKAPAHV

SEQ ID NO: 36047 - DNA, 1288 bp, Panicum virgatum
  misc_feature: Ceres CLONE 1964721
  misc_feature: Encodes the peptide sequence at SEQ ID NO. 36048
accacaatagcgaacagcagcagtagcacagaaccatggcgctcgcaagccaggccttgcttgaggcgcagcttgacctctggcaaaacacatttgcctatgtcaagtccatggccctcaaatctgccatagatctctgcatcgccgagaccatccaacaccatggaggcagcgcgaccctctcccaaatagccaccagagctatggtccctccggccaagatcccctgcttgagccgcctcatgcgcgtgctcacggccactggtgtcttcaatgcccaaaagacacgatcgggcattagcagctgcgagcagctcctgtactcgctcacaccgatgtcccgcctccttgtcggctcacggaaccagatccccatcatcaccgcatcactccaatcaaccgtcgtctcctccttgtttgagcttggtgggtggctccggcacgagctgcccgaaccatgcatgttccagctgaggaacgatcacacaatttgggagctaaccgacactgacccagcgtccaacgcgctcttcaacaacgcgatggactcagacaccaaattcatcatggacattgttgtcaacgaattcggggaggtattccacggggtagratcaatgatcgacgtcgctgggggacatggcgctgcggcacatgccatcgtgaaggcattcccgcatctgaaatgcagtgtgctagaccttggccatgttgttgcagatgctcccaacgacaacaacgtgcactatatcgctggcaacatgtttgagactgtgccaccagcgagcatgatatttctcaaggtatgtggtcgtttagcatgttgtcttattatttatcttgaatatgtattaattcaagctctattttttaagcaccaataactaattaatctcccattagtgtaattgaggatatgtcgtaaagccaccagtctatctctcgtcccctctcgtttccaacctaggtgttgatcaggttggcgcactactgcagaacaggattttgatacaggctatttgtcccggctgacgttgtgcccggcaccaaagggggcttttatcccaagtccaatggcctggcagtccaaccggaacaaattagcttttctgtagtagtggcgaaatcaaggtggaatccatcatggatgggatagcggatccgctgatgaggcgcaaatatagggcacatggtggctctttgtggctggttgttggcaaaagcagaatcacaagaaagcatagaactatagaagcaatctcaatttttgatttctcaaacacgccct

SEQ ID NO: 36048 - protein, 282 aa, Panicum virgatum
  misc_feature: Ceres CLONE 1964721
  misc_feature (26)..(74): Pfam Name: Dimerisation Pfam Description: Dimerisation domain
  misc_feature (84)..(280): Pfam Name: Methyltransf_2 Pfam Description: O-methyltransferase
  misc_feature: SWISSPROT Homolog: EC 2.1.1.146 (Iso)eugenol O-methyltransferase
  misc_feature (193)..(193): Xaa is any aa, unknown, or other
MALASQALLEAQLDLWQNTFAYVKSMALKSAIDLCIAETIQHHGGSATLSQIATRAMVPPAKIPCLSRLMRVLTATGVFNAQKTRSGISSCEQLLYSLTPMSRLLVGSRNQIPIITASLQSTVVSSLFELGGWLRHELPEPCMFQLRNDHTIWELTDTDPASNALFNNAMDSDTKFIMDIVVNEFGEVFHGVXSMIDVAGGHGAAAHAIVKAFPHLKCSVLDLGHVVADAPNDNNVHYIAGNMFETVPPASMIFLKVCGRLACCLIIYLEYVLIQALFFKHQ

SEQ ID NO: 36049 - DNA, 702 bp, Panicum virgatum
  misc_feature: Ceres CLONE 1964721-R
ttttgaaatgcttctaaatattaatatgataaatatgttccttttcaatttttagcttatctccacttaactaaaaacataatttttataagataatatgatttttttatttttatcgtagtcggtcttgcatgactggagcgaccaagaatgtgtcaagatattgaagaactgcaaagaggctattcctccaagagacgaaggaggaaaggtggtaatcatagatattgtgattggcgctgggcaatctgacaagcagagagagatgcaggtcgtctttgatctattcatcatgtctatcaacggcattgagagagatgagaaccaatggaaaaagatcttcttcgaagcaggattccacgactacaagataacaccagttctgggctttcggtcagtcatcgagctctacccatgatgacgtccattcaatatatcagcatcttctccaatatataccatgcatggtgaaccagagcagagcttatgtggttgtgcattagccgtgcgaaataagtttgcgtgttcgcagatagtgtggttgtcgctaccaatatcgcgtatggcttcgtgcatgatatacagccatgcatatgttatactcccttccacgcaaccacataattggagtagcttatgtgtgtatgtatttcccttcaattatgaaacagcgacagcgtgcctaccacgcacattacatgg

SEQ ID NO: 36050 - DNA, 1203 bp, Panicum virgatum
  misc_feature: Ceres CLONE 1964744
  misc_feature: Encodes the peptide sequence at SEQ ID NO. 36051
ctcggctccggttcccccaaacttttttgcctcccctccccaccaccaccaccactgcctccccgtccctcctccccgacgaacgcggcaccacgagccccctcccggatttagccatcctcccaccgcagctgcattcctctcctttggtaggtggtggtcgtcgttcccgtcaacccctcggccctgcgtgctgatttcgtccccgtttgtgctgtttgcatacagtatttcaatgaaggcaaatatgggtacaaaagctcgtcctccaccagctgatgcagacaaaggggagattggcgaaatagatacaagggctccttttgaatctgttaaagctgcagttagtttatttggtgaagtccggttttcatctgacaaatcagctgcgagaaaacccaaggctcctcaagcagagagggtgttagctaaggagacagagctgcacctagcccagaaagagttgaataaatacaaggaacagctgaataatgctgagacaacaagactacaggccctctctgagcttgagaaagctaaaaaaactgttgaggagctaaccaccaagcttgatgcaatcaacaagtctaaagagctagccattcaagcaacagcggatgcgaagactcgaaccaaacagcttgaaggtggcagctcaaatgaaggtcttggcacagatggtcctctgaagcaggaactggaaagtgcaagggagcagtatgctgttgctttggcagaccttgatgcagcaaaacaggagcttagaaagctcaagaaagattttgaaacctcattggatatgaggttgtctgctgctcagcaggaagaggaatcactgcacactactgaagccaacaaggaaaaagctaatcaacttcgtagtgagattgcagaaattcaagagtcgcttatgcacgttaaggcagctacacagcaagcacatgaggaggaggcacagatccgtactgagaaggatgttgctaggaccacatacaaacaagctttggaagaaacacagaagaagttgtcatctttgaggaatgattttgatcctgctgcttatgaaagtctcaaggagaagttagaccaaaccaattctgagattgcatctatgcagaaaaagatagaagatgctcgggctcgggatttagagtctgttgctattgtcagcacagagttggatgatgctaaggaaatgttgca

SEQ ID NO: 36051 - protein, 322 aa, Panicum virgatum
  misc_feature: Ceres CLONE 1964744
  misc_feature: SWISSPROT Homolog: EC 2.7.11.1 Non-specific serine/threonine protein kinase
MKANMGTKARPPPADADKGEIGEIDTRAPFESVKAAVSLFGEVRFSSDKSAARKPKAPQAERVLAKETELHLAQKELNKYKEQLNNAETTRLQALSELEKAKKTVEELTTKLDAINKSKELAIQATADAKTRTKQLEGGSSNEGLGTDGPLKQELESAREQYAVALADLDAAKQELRKLKKDFETSLDMRLSAAQQEEESLHTTEANKEKANQLRSEIAEIQESLMHVKAATQQAHEEEAQIRTEKDVARTTYKQALEETQKKLSSLRNDFDPAAYESLKEKLDQTNSEIASMQKKIEDARARDLESVAIVSTELDDAKEML

SEQ ID NO: 36052 - DNA, 708 bp, Panicum virgatum
  misc_feature: Ceres CLONE 1964744-R
gggcccttgatcagatcaaggaactctcagatcgagcaagtgctgcacgagcctcaacttcagagtctgcagcaaatatcacaatctcaaaagatgagtttgattctctaagccgaaaggtcgaggagtcagagaaactgagtgagatgaaagttgctgcagctatggctcaagtggaagccgtcagagccagtgagaacgaggcaatcaagaaactggaagctgcccgtaaggagatggaggacatggaattggcaacagaagaggcactgaagagggcagagatggcagaggcagccaaaaaggctgtagaaggcgagcttaagagatggcgcgagaaggagcagaagaaaactgcagagatgcagccttccacaggagcacaagaagttgcaggtgcatctccacctgtaccacagggttctgctgggaaagcgactgagaagagcgagggccaccaaaggaataccaggacgctattgaggaagagctttatgctgccaaacatcacgagcatgttccacaagaagagccatgctggcagcagttctccgtcgtaccttcctggcgaaaaatccgtgtaatctatctgaagctcttgtttgagttgaaatttccaaactagaatgcatggtcagatactataatctgtataatatgctcgtagttgcttgcgccttgcagtaaattactgacataattttatac

SEQ ID NO: 36053 - DNA, 1305 bp, Panicum virgatum
  misc_feature: Ceres CLONE 1964749
  misc_feature: Encodes the peptide sequence at SEQ ID NO. 36054
cttccccaagtcccaaccccctcgcctcgcctctcccctccccaaaccctacacctcgtcccgccgggggcttcgccgtccccgccgcccagccccatcgcgccgccccggcccggcccgcccgcgcggaccagtgaccgcctcccccaccgaacggaaccgcgccgtgcggctggtcgcgcggacgaccaccccccacactcggcgccgcccgccgccgccgccgcctttgatgtctcccacctgcgacctcggcttcctctggccccggtcgcagaagagctcccaagaggttccccgagcgtccacttgcggcgcccagagattggcctccccaccgcagccgagatgagcggcggcggcagcggcagcggcagcagcgacaagatgctgctgttcgggtcctttacagaggatgagacgaagttgttccagggtcagcctctcaaaagtccgactaaaagtgcgaccaaatcatgggaacatccagagatccagtttggctcgctgaacttttcagttctcagtctacagaaagcatcaagtcctattgctaaaggtgttgttcttcctgcaaaatcagcagatgctcagagcagtgtcattacaaaggagaatgcgtgcagtaataaaaaggaagctgtaggatctasctttccaaatggtggaccagttctggctaatggatgcacccctgtgaatgtctttcctaacaatggtgtattcgagaatgtgagaaagacggaggctgttgttcctccagctatgcctgttgttgctccagttgttactgccaaaagcatcagcaatgcagtaccacatgcagtgtcagaggtggacaaggacactaccaaatccactcaaaacagaaagttaaataaggaaaaggaaataactgaaaatggaagcccagttgttgatacacctatttttgcagcttcagcagatgaggcggtcacaagcttaaacaagaaagcctctcaaaacatgcccttgcttcctcatggtttgaggaacacaggaaatatttgcttcttgaacgcaactttgcaggcgttgctttcatgcccgccttttgtccaccttttacaggatttgagaaaccgaagtatacctaaggttggctacccaactctgagtgcatttgttgagttcctctctcaatttgatgtgcatgacgaatcaattatgaagaaaaatgagaaggctgttacagttgctgcaaaaccacttaatcctgccatgttcgatactgttctcagaaactttactccagatgtgccggctggaacatctgctcggcca

SEQ ID NO: 36054 - protein, 318 aa, Panicum virgatum
  misc_feature: Ceres CLONE 1964749
  misc_feature: SWISSPROT Homolog: EC 3.1.2.15 Ubiquitin thiolesterase
  misc_feature (102)..(102): Xaa is any aa, unknown, or other
MSGGGSGSGSSDKMLLFGSFTEDETKLFQGQPLKSPTKSATKSWEHPEIQFGSLNFSVLSLQKASSPIAKGVVLPAKSADAQSSVITKENACSNKKEAVGSXFPNGGPVLANGCTPVNVFPNNGVFENVRKTEAVVPPAMPVVAPVVTAKSISNAVPHAVSEVDKDTTKSTQNRKLNKEKEITENGSPVVDTPIFAASADEAVTSLNKKASQNMPLLPHGLRNTGNICFLNATLQALLSCPPFVHLLQDLRNRSIPKVGYPTLSAFVEFLSQFDVHDESIMKKNEKAVTVAAKPLNPAMFDTVLRNFTPDVPAGTSAR

SEQ ID NO: 36055 - DNA, 133 bp, Panicum virgatum
  misc_feature: Ceres CLONE 1964749-R
cctgtgtttattatttatatatgcttggttgcatagcgagagggggatggatttttcttcagcccattttgaggtcctgtaaaatttaactgcgtatcattgtaatgatccgcaaagtaatcatgcgatgtcg

SEQ ID NO: 36056 - DNA, 751 bp, Panicum virgatum
  misc_feature: Ceres CLONE 1964752
  misc_feature: Encodes the peptide sequence at SEQ ID NO. 36057
acaacccgacatgtatatgatgttgcagctcaacatgtcattagtggtgccatggagggagtaaatggtacaatatttgcatatggtgttacaagcagtgggaagacacacacgatgcatggagaccaaagatccccggggattatacctttggctgtcaaagatgcatttagcattatacaagagacaccgaatcgtgagtttctcctacgtgtgtcgtacttggaaatttataatgaggttgtcaatgatctactaaaccctgctggtcaaaatttgcgaattagagaagatcctcagggaacgtttgttgagggtatcaaggaagaagttgtattatctcctgcacatgcactgtcccttattgcagctggagaagagcatagacatgttggatccaccaacttcaatctactaagtagcagaagtcatactattttcacactgactatagagagcagcccttgtggcgaggctaatgaaggggaagctgtcaccttctcacagctgaacctcatcgatctggcaggttcggagagctcaagggcagaaaccactggactacggcggaaagaaggatcttatatcaacaaaagcttgctaactcttggaacggtgatatcaaagctgactgatggaaaggctacacatgttccgtatcgagattcaaaattaacacgactacttcagtcatccctcagtggtcaagggcgtgtttccctaattttgccagtgacaccagcatcaaagt

SEQ ID NO: 36057 - protein, 250 aa, Panicum virgatum
  misc_feature: Ceres CLONE 1964752
  misc_feature (1)..(250): Pfam Name: Kinesin Pfam Description: Kinesin motor domain
TTRHVYDVAAQHVISGAMEGVNGTIFAYGVTSSGKTHTMHGDQRSPGIIPLAVKDAFSIIQETPNREFLLRVSYLEIYNEVVNDLLNPAGQNLRIREDPQGTFVEGIKEEVVLSPAHALSLIAAGEEHRHVGSTNFNLLSSRSHTIFTLTIESSPCGEANEGEAVTFSQLNLIDLAGSESSRAETTGLRRKEGSYINKSLLTLGTVISKLTDGKATHVPYRDSKLTRLLQSSLSGQGRVSLILPVTPASK

SEQ ID NO: 36058 - DNA, 596 bp, Panicum virgatum
  misc_feature: Ceres CLONE 1964775
  misc_feature: Encodes the peptide sequence at SEQ ID NO. 36059
gcatcagcttctttctctccctcggcggctgcccgtctcctcgtcctcctccgcttcgccggcgcccgcgcccgcgccgtccggccatgggggtgctcacggcggcggagctcaacttcctcgtcttccgctacctccaggagtccggtttcattcatgcagcattcactctagggtatgaagcagggatccataagggtggcattgatggaaatgcagtcccacctggtgctctcatcactattgtgcagaaaggcctccagtacatagaactggaagcaaataccgaagaggtaagcctgtttacctttcagtatttgttactactgctgattgatgtgacaccatccactgttcttgtttcagaatgatgaagaaattgagaaggattttgcccttctggaaccaattgaaatcatcacaaaggatgttgaagagttgcaacagcttgtaaagaagagaaaaagggagagatctcaaactgaccgcgagaaggataggggaaaagagaaagaacgtaatgaggagcatgaacggcgtcctggaggcgaacgtgagagggatcgccatgacaaagaaaaagagcaggtgaggga

SEQ ID NO: 36059 - protein, 94 aa, Panicum virgatum
  misc_feature: Ceres CLONE 1964775
  misc_feature (7)..(33): Pfam Name: LisH Pfam Description: LisH
MGVLTAAELNFLVFRYLQESGFIHAAFTLGYEAGIHKGGIDGNAVPPGALITIVQKGLQYIELEANTEEVSLFTFQYLLLLLIDVTPSTVLVSE

SEQ ID NO: 36060 - DNA, 691 bp, Panicum virgatum
  misc_feature: Ceres CLONE 1964775-R
tgcaacatgctcaaccgacagcatgatctatgtttgcaagattggggaacagcgtccagttaaatcatttattggtcatcaggtttgtttctcagtgattatattcttaaaattcatgctacaaactgcatggtgctatttttgtgtgtatctttctttttggatgacttatacaatccaaaagtaacactgaacattctcttgttatcagatactatatgtcattcctcaaaagttgaaaaatgtgcaacatggtttgttgttacttcctggtatattaaatggatatgattattgatcaataattcattatatgacatggcattgtatggacacccatgttttcaaatcgtctagtcggacctagtcgccatgggaccgatcagacgactagtcgcgattagtcgtcgatcaggccgattagtcgagcctagtcgatccctagtcgtcttatagtcgtcctatgtgtcccatgaccgatatgatatatatgctatatattacttaatgccaagctcaagaaggcgtccacggcttagattatcttttggtggatggcatgttgagtttttggtaccttattatatcagtgattcgtttgagtgttgttaagccagaattagcactcctgtttcctatgaactcttttcaaaccttaatcaagcatggctgtgctctggaggattttgtc

SEQ ID NO: 36061 - DNA, 654 bp, Panicum virgatum
  misc_feature: Ceres CLONE 1964803
  misc_feature: Encodes the peptide sequence at SEQ ID NO. 36062
ggcccgcaccgcaccgcaggtccgcagtttctgcttcccgttaggcttcctgtctttttcttctccggctccggctccggcgaccggcggcgatgggggtcaagaacctctgggacatcctcgactcctgcaagaagaagctcccgctccagcacctccagaacaagaaggtgtgcgtggatctttcctgctggctcgtgcagctctgcagcgcccaccgctccccagccttcctcaaggacaaggtctacctcaagaacctcttccaccgcatccgagccctcctcgccctcaattgcagcctcgtcttcgtcacagatggggcgattccgtctgtcaaattggcaacttacaggcgccgcctcggagctgctcgagaggaggacaactcacaacccctgacttctttgcgccggaacaagagctctgaattctcgcgcatgataaaagaggccaagcatcttgggatggccctgggaatcccctgcttggatggagtggaagaagcggaagcacagtgcgcattgctcaattttgcctccttgtgcgatggctgttttacatcagattcagattcattccttttcggtgcaaggacagtttatagagatgttttcataggagagggtggctatgtaatttgctatgagatgg

SEQ ID NO: 36062 - protein, 187 aa, Panicum virgatum
  misc_feature: Ceres CLONE 1964803
  misc_feature (1)..(97): Pfam Name: XPG_N Pfam Description: XPG N-terminal domain
MGVKNLWDILDSCKKKLPLQHLQNKKVCVDLSCWLVQLCSAHRSPAFLKDKVYLKNLFHRIRALLALNCSLVFVTDGAIPSVKLATYRRRLGAAREEDNSQPLTSLRRNKSSEFSRMIKEAKHLGMALGIPCLDGVEEAEAQCALLNFASLCDGCFTSDSDSFLFGARTVYRDVFIGEGGYVICYEM

SEQ ID NO: 36063 - DNA, 594 bp, Panicum virgatum
  misc_feature: Ceres CLONE 1964872
  misc_feature: Encodes the peptide sequence at SEQ ID NO. 36064
gctggaacgcgagcacacaagtcatctcctccctcttgtctggctcgggtgagcgagtgagcagctttgcttctgcgtcttcctcatctccggcgctccggtggccgagatcctggtctagcaggtctgaccggaaaggctgcgttcgttttgttctctgcaggtggttggcgcgcgacctgagaacacaggggagcgagaagatgaccggagcagcggcggtcgacgtgccggcgccggcggcggccaacggcggggcgtgctgccacgccgcgaaggggcccgggtacgcgacgccgctggaggccatggagaagggccccagggagaagctcatctacgtcacctgcgtctacaacggcactggcattaacaagccagattaccttgcgacggtggatttggaccccagctctcctacatactcccaagtgatccacaggctcccagtgacccacatcggcgacgagttgcatcactctggctggaactcttgcagctcctgccatggcgatccatcagcgaagcgccgtttcttgatcctgccttcattgctgtcaggtcgtgtgtatgttgtggacactgcaacagacc

SEQ ID NO: 36064 - protein, 130 aa, Panicum virgatum
  misc_feature: Ceres CLONE 1964872
  misc_feature (23)..(130): Pfam Name: SBP56 Pfam Description: 56kDa selenium binding protein (SBP56)
MTGAAAVDVPAPAAANGGACCHAAKGPGYATPLEAMEKGPREKLIYVTCVYNGTGINKPDYLATVDLDPSSPTYSQVIHRLPVTHIGDELHHSGWNSCSSCHGDPSAKRRFLILPSLLSGRVYVVDTATD

SEQ ID NO: 36065 - DNA, 690 bp, Panicum virgatum
  misc_feature: Ceres CLONE 1964889
  misc_feature: Encodes the peptide sequence at SEQ ID NO. 36066
gagcctgctgctcacctgagcctgtggggaggcaaacgcttcagagctctcgcagtcgcagagaggaggagggagggggaagaactgtgccggttttgccccccggtttgccgttacccttgctttggagggatctgagctgagctgcagctgctgccaaagccttttttcagctgcaggctatgccgatcatgatggtggtggtggtgatggcggctgtgcagcggaaaagcttctcttgctagtggaggaggcgtaaaatttcacccacaaaggctgtcgcggtgggtggggggctgctcaattccgctgagattcttgccggtgtgcagcggctgtgggcggtgaagatgatcactttcgtggactcggcggccatggagcgggagcgggagagcgacaagtgcctggacccacagctgtggcacgcctgcgccggcggcatggtccagatgccgccggtgcactccaaggtgtactacttcccgcagggccacgcggagcacgcgcagggccccgtcgacctcctcgccggccgggtcccggccctcgtcctctgccgcatcgccgccgtccgcttcatggccgatccggacaccgacgaggtcttcgccaagatccgcctcgcccccgtccgccccagcgagccgggctacgccgccgacgccgacgaccccattggcgcgggcg

SEQ ID NO: 36066 - protein, 113 aa, Panicum virgatum
  misc_feature: Ceres CLONE 1964889
  misc_feature: The sequence is a functional homolog of SEQ ID NO 1185 in the 10/666,642 US patent application
  misc_feature: The sequence is a functional homolog of SEQ ID NO 1184 in the 10/666,642 US patent application
  misc_feature: The sequence is a functional homolog of SEQ ID NO 1186 in the 10/666,642 US patent application
  misc_feature: The sequence is a functional homolog of SEQ ID NO 442 in the 10/666,642 US patent application
  misc_feature: The sequence is a functional homolog of SEQ ID NO 1428 in the 10/666,642 US patent application
  misc_feature: The sequence is a functional homolog of SEQ ID NO 1431 in the 11/479,226 US patent application
  misc_feature: The sequence is a functional homolog of SEQ ID NO 168 in the 10/666,642 US patent application
MITFVDSAAMERERESDKCLDPQLWHACAGGMVQMPPVHSKVYYFPQGHAEHAQGPVDLLAGRVPALVLCRIAAVRFMADPDTDEVFAKIRLAPVRPSEPGYAADADDPIGAG

SEQ ID NO: 36067 - DNA, 655 bp, Panicum virgatum
  misc_feature: Ceres CLONE 1964909
  misc_feature: Encodes the peptide sequence at SEQ ID NO. 36068
acgagtccgcttccaatttctccgcacccgctccgcaccgcacctccccaatccccaagccaaccacccccgagatctcccagaccgtcctcgagatccctgcggccatgtcgtcgtcggcagccatggaggccatcgacgagctcgtccagctctccgagtccatgcggcaggccgcctccctcctcgccgacgatgacccatccgacgagaccgcctcgcgccgcccatccaccttcctcaacgccgtcgcgctcggcaacgtcggcgctggcaagtccgccgtgctcaacagcctcatcggccaccccgtgctgcccacgggggagaacggggcgacgcgggcgccgatagtggtcgacctggcgagggatccggggctcagcagcaagtccatcgtcctgcagatcgacagcaagtcacagcaggtgtcggcaagtgcactacggcattcgctgcaggataggcttagcaaaggggcatccggtggatctgggagaggccgaagtgatgaaatttaccttaagatgcggacaaatacagctcctcccctgaaattgattgatttacctggcatagaccaacgtgttatggatgattcaacgatcagtgaatatgctggacacaatgatgcaatactgattgttgtgatacc

SEQ ID NO: 36068 - protein, 176 aa, Panicum virgatum
  misc_feature: Ceres CLONE 1964909
  misc_feature (41)..(176): Pfam Name: Dynamin_N Pfam Description: Dynamin family
  misc_feature: SWISSPROT Homolog: EC 3.6.5.5 Dynamin GTPase
MEAIDELVQLSESMRQAASLLADDDPSDETASRRPSTFLNAVALGNVGAGKSAVLNSLIGHPVLPTGENGATRAPIVVDLARDPGLSSKSIVLQIDSKSQQVSASALRHSLQDRLSKGASGGSGRGRSDEIYLKMRTNTAPPLKLIDLPGIDQRVMDDSTISEYAGHNDAILIVVI

SEQ ID NO: 36069 - DNA, 1318 bp, Panicum virgatum
  misc_feature: Ceres CLONE 1964932
  misc_feature: Encodes the peptide sequence at SEQ ID NO. 36070
ggtctccacgcgaaatgggcaccaccacctgctgctcatcataagcgcaacaagcatccaggcgggcgagtggaggaagaagacgagacgacggcatcctgcagattccagagagagagagagagagagagagcaaagcaagatggggagctacgcgtacaagtactgtatgtgcttcacccgcaagttccgatcccccgacgcgcagccgccgcccgacgtccgcgccgcccacctctcctactgcggcccttcttcttctgatccgcagggcgcccacggccatggcctccgccgcttcctctcccaagtccaggccgagtcacccgccgacgtcgaccgcatcctcgccatcctcgcacccatttcggcgagtcacggaatcgcccgcctcgtcaacaggtcgccggcgccggcgccgcccacgctcgacgacttcttcggattcctcttctcccccgatctcaacccgccaatcactaaccaggttcaccaggacatgtcagccccgttctctcattatttcatattcactggccataattcctaccttaccgggaaccagctgaatagtgactccagcgacatcccaattataaaatcactagagagaggtgttagagtcattgaacttgatatgtggccaaattcttcaaagaacaatgttgacattcttcatggagggacattgactgcccctgtagaaatgatcagatgtttaaagtctattaaagaatacgccttttgtgcgtccaattatcctcttgttattactcttgaggatcacctcacagcagacctccaagccaaagtagctgagatgctcaccgaaacgttcggggatcttcttttcatccctagttctgacccaatgaaagagtttccttctccagaagctctaatgaagaggataataatctcaactaaacccccacaagaatacaaggagtttctgaaagctaaggataatcagaatggtagtggaaacatagctgatttaccagaccaaggaagcctgaggagaatagattcaaatgctgatgaatctgatggaaaggatgaactagatgagcaagatgaggaagattctgatgaggatgaccccaaatttcagcaggatgctgcctgtgagtataggaaactgatcactatccaagctggcaaaccaaaaggccatttacgggatgctctaaaggtagaccctgacaaagtcaggcggctctctttgagcgagacacagttagctaaagcgacagtttctcatggcgctgaagtcataaggttcactcagaggaatatactgagggtatatccgaag

SEQ ID NO: 36070 - protein, 391 aa, Panicum virgatum
  misc_feature: Ceres CLONE 1964932
  misc_feature (120)..(263): Pfam Name: PI-PLC-X Pfam Description: Phosphatidylinositol-specific phospholipase C, X domain
  misc_feature: SWISSPROT Homolog: EC 3.1.4.11 Phosphoinositide phospholipase C
  misc_feature: Functional homolog of the protein sequence given in SEQ ID NO 51197
  misc_feature: Useful for making plants with modulated water use efficiency
MGSYAYKYCMCFTRKFRSPDAQPPPDVRAAHLSYCGPSSSDPQGAHGHGLRRFLSQVQAESPADVDRILAILAPISASHGIARLVNRSPAPAPPTLDDFFGFLFSPDLNPPITNQVHQDMSAPFSHYFIFTGHNSYLTGNQLNSDSSDIPIIKSLERGVRVIELDMWPNSSKNNVDILHGGTLTAPVEMIRCLKSIKEYAFCASNYPLVITLEDHLTADLQAKVAEMLTETFGDLLFIPSSDPMKEFPSPEALMKRIIISTKPPQEYKEFLKAKDNQNGSGNIADLPDQGSLRRIDSNADESDGKDELDEQDEEDSDEDDPKFQQDAACEYRKLITIQAGKPKGHLRDALKVDPDKVRRLSLSETQLAKATVSHGAEVIRFTQRNILRVYP

SEQ ID NO: 36071 - DNA, 743 bp, Panicum virgatum
  misc_feature: Ceres CLONE 1964932-R
  misc_feature: Encodes the peptide sequence at SEQ ID NO. 36072
aaatggcgaggtatttgaccctaaagctagtttgccggtgaagacaactctcaaggtaaaagtatatatgggagatgggtggcgcatggatttcagtaaaactcattttgacgccttctcgcctccagatttctataccagggtagggatcgctggagtgaaggcagatagtgtgatgaagaaaacgcgggtcctggaagaccagtgggtgccggtgtgggacgaggaattcacgttcccgctgacggtgccggagctagccctgctgaggatagaggtgcaggagtacgatatgtcggagaagcacgacttcggcgggcagacggtgctgccggtgtgggagctgaagcagggcattcgtgctgtgcccctgcacgatcgcaagggcgtcaggtacaagtccgtcaggctcctcatgcgcttcgattttgtctaggctaggcatcagcagcagtccatactctctagttgcgccagccagtcagtgagagattgcgtttctctttctttttttttcttctaaaaaaaaattcttgtgcatctagtgtgattatgttgtgtctacgtaaaagttatgaaatactaggaattattgttactagtagagtatacttccatctccatgtgagttgtgattagtgtagactagaaccagagtagggggtgttacttccatcttgcgatcatgaatgtacgtatgtactattgattttgtcggaataaaggttgtatggaagggctgt

SEQ ID NO: 36072 - protein, 144 aa, Panicum virgatum
  misc_feature: Ceres CLONE 1964932-R
  misc_feature (17)..(109): Pfam Name: C2 Pfam Description: C2 domain
  misc_feature: SWISSPROT Homolog: EC 3.1.4.11 Phosphoinositide phospholipase C
  misc_feature: Functional homolog of the protein sequence given in SEQ ID NO 51197
  misc_feature: Useful for making plants with modulated water use efficiency
NGEVFDPKASLPVKTTLKVKVYMGDGWRMDFSKTHFDAFSPPDFYTRVGIAGVKADSVMKKTRVLEDQWVPVWDEEFTFPLTVPELALLRIEVQEYDMSEKHDFGGQTVLPVWELKQGIRAVPLHDRKGVRYKSVRLLMRFDFV

SEQ ID NO: 36073 - DNA, 1103 bp, Panicum virgatum
  misc_feature: Ceres CLONE 1964933
  misc_feature: Encodes the peptide sequence at SEQ ID NO. 36074
aaatgcccgccgcgccgcccactcgtccccagctgcggcggcgggtccgagcactctagccccgcgcgtcctcctgtttccgccgctccaactccccgcgggctcctcgccggcgtccgctccccgcggtcagtcacccagccgcgcatcgctgttgctgctgctcctttcctgttcccctttgcagcagggcagggcagggcagcgtggaggagaggagatattatcgctgccgccgccgccgccgccgccgctgtcccactcgcgcgccacgaagcctcggcctcggcctcggatcggaggcgtgcttatccgcggcggaatccaatcccctctctcgcgtccttctccccagcaaaggccacccgcccgcttttggcgaattaccccccgctgccgcgcccatgattcccggcgattcatccgcccatttgctcctgctcccctcgccgcagctgcagtgcggccgcagctgctagttcggtagcggggggaaggggggcttttgattggggggcggcggcgatgtcgtcgtcgcggtccacaaccgggggacgtgctcccggagcagctcggcgcggtccaagcacagcgcgcgggtggtggcgcagacgcccgtggacgcgcagctgcacgccgagttcgagggctcccagcgccacttcgactactcctcctcggtgagcgcggccaatcgcccgtccgccagcaccagcaccgtctccgcctacctccagaacttgcagcggggccgcttcatccagcccttcggctgcctgctcgccgtccacccggacaccttcgcgctgctcgcctacagcgagaacgcgcccgagatgctcgacctcacgccgcacgcggtccccaccattgaccagcgggacgcgctcgccctcggcaccgacgtgcgcacgctcttccgcacgcagagctccgtcgcgctgcacaaggccgccatcttcggggaggtcaacctgctcaaccccatcctcgtgcacgccaggacgtcggggaagcccttctacgccattatgcaccgcatcgacgtcggcctcgtcatcgatctcgagccggtcaaccccgccgacgtgccagtcaccgcc

SEQ ID NO: 36074 - protein, 88 aa, Panicum virgatum
  misc_feature: Ceres CLONE 1964933
  misc_feature (1)..(80): Pfam Name: PAS_2 Pfam Description: PAS fold
  misc_feature: SWISSPROT Homolog: EC 2.7.11.1 Non-specific serine/threonine protein kinase
  misc_feature: Functional homolog of the protein sequence given in SEQ ID NO 51315
  misc_feature: Useful for making plants with modulated biomass
  misc_feature: Useful for making plants with modulated light quality response
  misc_feature: Useful for making plants with modulated light quality sensitivity
  misc_feature: Functional homolog of the protein sequence given in SEQ ID NO 51512
  misc_feature: Useful for making plants with altered low light response
  misc_feature: Useful for making plants with modulated flowering time
  misc_feature: Useful for making plants with modulated nitrogen use efficiency
MLDLTPHAVPTIDQRDALALGTDVRTLFRTQSSVALHKAAIFGEVNLLNPILVHARTSGKPFYAIMHRIDVGLVIDLEPVNPADVPVT

SEQ ID NO: 36075 - DNA, 1113 bp, Panicum virgatum
  misc_feature: Ceres CLONE 1964935
  misc_feature: Encodes the peptide sequence at SEQ ID NO. 36076
gttttgcatcgcattcccctcctctccccccgcgcctctcctcgcctcgcttatccccccacgtcccctgctcgccctgttggcagaacctcctcctagtcctcttcccccaacgcaaaagagaggccgtttgctgtcgcgcggagcggcggaagcttctcgacctctccaccgctgccccgccgtcggcaggttccgcgccgcgccggtgggatccgagccccgagctgccgcgcggcgatcctcgtcacatcggattccactgaattcaactactaaagaaagccaaggaaggtggcggtggtagtgggagtgagcagcttgtggaatctttcccaaatactgcccaggatcatggctaccctttgtgatttctgtgggaaacaaaggtcgatgatttactgtagatcagatgcggcatccttgtgcttatcatgcgatcgtaatgttcattcagctaatgcgctgtcccgccgtcacacaaggacccttctttgtgatcgttgttgctcacagcctgcagctgttcgctgtattgaggagaacacatcactttgccaaaattgcgattggaatgggcatgatgcagcatcaggggctactgggcataaaaggcaggccataaactgttactccgggtgcccatcatcggcagagctttcgagaatctggtcatttgttatggatatccctactgtagctgctgagcccaactatgaggatggaatgagcatgatgacaattgatgacggtgatgtgactgatcattgtggtgcttcagatgataaaagattgttggaaatagctagcacaacactcatgagtgatccacccactagcgataagcttaaacctctgataggctcttcttcaggtgatggattcaatgttctgccactagccattgatcagcctgctggacaagtttcaatgatgcaaaaggtaccttatgccgcagacgatgataagttcaatgatggtagcatgtatgaggacttatgtgtggatgatactgacctgacattcgagaattatgaagaactgtttggtacctctcatattcaaacagagcaactctttgacgatgctggaattgacagttactttgaaatg

SEQ ID NO: 36076 - protein, 252 aa, Panicum virgatum
  misc_feature: Ceres CLONE 1964935
  misc_feature (1)..(47): Pfam Name: zf-B_box Pfam Description: B-box zinc finger
MATLCDFCGKQRSMIYCRSDAASLCLSCDRNVHSANALSRRHTRTLLCDRCCSQPAAVRCIEENTSLCQNCDWNGHDAASGATGHKRQAINCYSGCPSSAELSRIWSFVMDIPTVAAEPNYEDGMSMMTIDDGDVTDHCGASDDKRLLEIASTTLMSDPPTSDKLKPLIGSSSGDGFNVLPLAIDQPAGQVSMMQKVPYAADDDKFNDGSMYEDLCVDDTDLTFENYEELFGTSHIQTEQLFDDAGIDSYFE

SEQ ID NO: 36077 - DNA, 564 bp, Panicum virgatum
  misc_feature: Ceres CLONE 1964935-R
aagatcactggagagcacaagcaattgcatgcagcagagcctgcaattgaaatatggggaaaagggataaaaagagataccaaattttgggacgaaaatgccaaaaaaagaaagatgcacacatgccggaagatgctgctgctaccgctccattttctttggaccgaacgtgcatcttcagttgcttgtggatgagtggtctgaatcgcgctctgcccctctgtgcatcggtcagatgcagtcatgggcgatcgtactccagctccaccgctccatgcatggcgaccacacctgcttctgctatggtgttctgcggtgagctgccaggttgtacattctgggtgacagcctaacaggatacactgtacctctcaagtttcttcctgtaatattattttgcgaagcgcaatcttctgctgcgaggggattgtttttcggttgtgtatgtttgtagattgacctaacatttgtaaagaaaaaaaataccgtggtgattgtaaagcttgttcttgttaggacacgttctggacactgaacccctgtaagttcttttttttttgtgcc

SEQ ID NO: 36078 - DNA, 374 bp, Panicum virgatum
  misc_feature: Ceres CLONE 1964962
  misc_feature: Encodes the peptide sequence at SEQ ID NO. 36079
atactactactctagaaccaactactactcggctcggatcctccccccgtcttctttcctctgcccccaacagctccggcgattcactcggattgatccactccccgcgccggcagggaggagatcagacacccatggcgttcgatgccttcaccgacaagaacgccgtcttccgccgtctcaaggccaagccagagaacaagatgtgcttcgactgcaacgccaagaaccccacctgggcctccgtcacctacggcatcttcctctgcctcgactgctccgccgtccaccgcagcctcggagtacacatcaccttcgtcaggtcaacgaaccttgactcatggactccggatcagctcaagatgatggctttc

SEQ ID NO: 36079 - protein, 79 aa, Panicum virgatum; identical to SEQ ID NO: 31331
  misc_feature: Ceres CLONE 1964962
  misc_feature (10)..(79): Pfam Name: ArfGap Pfam Description: Putative GTPase activating protein for Arf
  misc_feature: SWISSPROT Homolog: EC 3.2.1.8 Endo-1,4-beta-xylanase
  misc_feature: Functional homolog of the protein sequence given in SEQ ID NO 51347
  misc_feature: Useful for making plants with altered terpenoid content
  misc_feature: Useful for making plants with modulated nitrogen use efficiency

SEQ ID NO: 36080 - DNA, 652 bp, Panicum virgatum
  misc_feature: Ceres CLONE 1964967
  misc_feature: Encodes the peptide sequence at SEQ ID NO. 36081
aggcgatgggtggcgcggtggcgccgggcgcgaggccagggctcctcctcctgcgccgcacggacgccaccttctccgcggcgctgcgcgcgcgctaccgcgtcttggacttctacgggtcaggggcgcccctcggcgccttcctcgccgccgccgccgcggaaccggacccctcgcgcgccgcgctcgtcgtcgccggcggcgccgtcctcgtcgacgcggcgttcatggacgccctgccctccctccgctgcgtcgtcaccacgggcgcgggagtggaccacattgacctcgccgcctgcgcgcgccgcggcgtcgccgtcgcgggcgcgggcaagatcttctccgtggacgtcgccgaccacgccgtcgggctcctcatcgccgtgctccgccgcgtctccgccgccgaacgctacgtccgcgccgggctctggccggcgcaaggggactacccacttacctccaaactgaacggcaagcgcgtgggcatcatcggcctcggcagcatcgggtggctgatcgccaagcgcctcgaggcattcggctgcgtcgtctcctaccactcgagggcgcccaaggccacctccgtcccctaccgctacttcccggacgcgcacgccctcgccgcggactgcgaagctctggtcgt

SEQ ID NO: 36081 - protein, 215 aa, Panicum virgatum
  misc_feature: Ceres CLONE 1964967
  misc_feature (13)..(197): Pfam Name: 2-Hacid_dh Pfam Description: D-isomer specific 2-hydroxyacid dehydrogenase, catalytic domain
  misc_feature: SWISSPROT Homolog: EC 1.1.1.95 Phosphoglycerate dehydrogenase
MGGAVAPGARPGLLLLRRTDATFSAALRARYRVLDFYGSGAPLGAFLAAAAAEPDPSRAALVVAGGAVLVDAAFMDALPSLRCVVTTGAGVDHIDLAACARRGVAVAGAGKIFSVDVADHAVGLLIAVLRRVSAAERYVRAGLWPAQGDYPLTSKLNGKRVGIIGLGSIGWLIAKRLEAFGCVVSYHSRAPKATSVPYRYFPDAHALAADCEALV

SEQ ID NO: 36082 - DNA, 1015 bp, Panicum virgatum
  misc_feature: Ceres CLONE 1964971
  misc_feature: Encodes the peptide sequence at SEQ ID NO. 36083
acctaaacccgcccacctggcgcgcccgtgcccctaattaagcgcggcctcccccgccgtttccctccaagaagagcaccctctcctccggctcttcttccccaccaccaccaccacctcctcccgaccaccgcgtcgcagcaatggcgggcaacggcctgatcgtggagaacgacccgctcaactggggcgcggcggcggcggagctggccggtagccacctggacgaggtgaagcggatggtggcgcaggcccggcagcccgtggtgaagatcgagggctccaccctccgcgtcggccaggtggccgccgtcgccgccgcccgcgacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcgcaccgccgcaccaaggacgggcccgcgctccaggtcgagctgctcaggcatctcaacgccggcatcttcggcaacgaccgcgacggccacacgctgccgtcggagacggtccgcgcggcgatgctcgtgcgcatcaacaccctcctccagggctactccggcatccgcttcgagatcctcgaggccctcgccaagctgctcaacaccggcgtcagcccgtgcctgccgctccggggcaccatcaccgcctcgggcgacctcgtgccgctctcctacatcgccggcctcatcacgggccgccccaacgcgcaggccgtcaccgccgacggcaggaaggtggacgccgccgaggccttcaagctcgccggcatcgacggcggcttcttccgcctcaaccccaaggaggggctcgccatcgtcaacggcacctccgtcggctccgcactcgccgccaccgtgctctacgacgccaacgtcctcgccgtggtctccgagggcctctcccccgtcttctgcgaggtcatgaacagcaagcccgagtacacccaccacct

SEQ ID NO: 36083 - protein, 290 aa, Panicum virgatum
  misc_feature: Ceres CLONE 1964971
  misc_feature (41)..(290): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature: Functional homolog of the protein sequence given in SEQ ID NO 51139
  misc_feature: Useful for making plants with altered cell wall content and/or composition
  misc_feature: Functional homolog of the protein sequence given in SEQ ID NO 50787
  misc_feature: Useful for making plants with altered lignin content
MAGNGLIVENDPLNWGAAAAELAGSHLDEVKRMVAQARQPVVKIEGSTLRVGQVAAVAAARDASGVAVELDEEARPRVKASSEWILDCIAHGGDIYGVTTGFGGTSHRRTKDGPALQVELLRHLNAGIFGNDRDGHTLPSETVRAAMLVRINTLLQGYSGIRFEILEALAKLLNTGVSPCLPLRGTITASGDLVPLSYIAGLITGRPNAQAVTADGRKVDAAEAFKLAGIDGGFFRLNPKEGLAIVNGTSVGSALAATVLYDANVLAVVSEGLSPVFCEVMNSKPEYTHH

SEQ ID NO: 36084 - DNA, 702 bp, Panicum virgatum
  misc_feature: Ceres CLONE 1964971-R
  misc_feature: Encodes the peptide sequence at SEQ ID NO. 36085
cgtcgacatcttcaagctcatgtcctccacctacatcgtcgcgctctgccaggccgtcgacctgcgccacctcgaggagaacatcaagacctccgtcaagaacaccgtcacccaggtggccaagaaggtgctcaccatgaaccccaccggcgacctctccaccgcgcgcttcagcgagaaggacctcatcaccgccatcgaccgcgaggccgtcttcacctacgccgaggacgcggccagcgccagcctcccgctcatgcagaagctgcgcgccgtgctggtggaccacgccctcagcagcggcgatgccgagcgcgagccctccgtgttctccaagatcaccaagttcgaggaggagctccgcgcggtgctgccccgggaggtggaggccgcccgcgtcgccgtcgccgagggcgccgccgccgtgcccaaccggatcaaggacagccgctcgttcccgctgtaccgcttcgtccgcgaggagctcggctgcgtcttcctcaccggcgagaagctcaagtcccccggcgaggagtgcaacaaggtcttcatcggcatcagcgagggcaagctcgtcgaccccatgctcgagtgcctcaaggagtgggacggcaagcccctgcccatcaactaagcacgccaggcgccgccatccgtgcaccggtggtgcatggccggaggaggaggagaagaagaggagac

SEQ ID NO: 36085 - protein, 210 aa, Panicum virgatum
  misc_feature: Ceres CLONE 1964971-R
  misc_feature: SWISSPROT Homolog: EC 4.3.1.5 Phenylalanine ammonia-lyase
  misc_feature: Functional homolog of the protein sequence given in SEQ ID NO 50787
  misc_feature: Useful for making plants with altered cell wall content and/or composition
  misc_feature: Useful for making plants with altered lignin content
VDIFKLMSSTYIVALCQAVDLRHLEENIKTSVKNTVTQVAKKVLTMNPTGDLSTARFSEKDLITAIDREAVFTYAEDAASASLPLMQKLRAVLVDHALSSGDAEREPSVFSKITKFEEELRAVLPREVEAARVAVAEGAAAVPNRIKDSRSFPLYRFVREELGCVFLTGEKLKSPGEECNKVFIGISEGKLVDPMLECLKEWDGKPLPIN

SEQ ID NO: 36086 - DNA, 1339 bp, Panicum virgatum
  misc_feature: Ceres CLONE 1964977
  misc_feature: Encodes the peptide sequence at SEQ ID NO. 36087
acagtccacacgacgcagctcgctcactccgctgtcagagcatgcaagctagggcactgttagagcagcggcgtacataacggcagggccgcaggcttctccacattgctgtcctgaaatttgcctccatccatccatctcggacctcggtcagcttcggctcgtcctccatgggttttggcagcgcgagatggagggctctgccgctgtgcctagcgctcgtggctctgcaagcattcctcccggcgtgcgcggcggcgcccaagacgtacatcgttcagatggcggcgtctgagatgccgagctcgttcgatttccaccacgaatggtacacctccactgtgaaatccgtgagttctgtgcagctgcaaggcgaggaggacgacccgtacgcgaggaggatcgtctacaactacgagacggcgttccacggcttcgcggcgaggctggacgaggacgaggccgagcggatggccgaggcggacggagtggtgaccgtgctcccggagacggtcctgcagctgcacaccacccggagcccggacttcctgggcatcggcccggagatcagcgacagcatctggtcggcggggctcgccgaccacgacgtcgtcgtgggcgtgctcgacactggcatatggcccgagagccccagcttcagcgacaagggcctcggccccgtgccggccaagtggaagggcctgtgccagacggggcgcggcttcaccacggccaactgcaaccgcaaggtcatcggcgcgcgcatcttctacaacggctacgaggcctcgtcggggcccatcaacgagaccaccgagctcaagtccccgcgggaccaggacggccacggcacccacaccgcggccaccgccgcaggcgcgcccgtgccggacgccaacctcttcggctacgcccgcggcgtcgcccggggcatggcgccccgcgcacgcgtcgcggcgtacaaggtgtgctgggcgggcggctgcttcagctccgacatcctggcggccgtcgaccgcgccgtggcggacggcgtcgacgtgctctccatctctctcggcggcggctcctccccctactaccacgacagcctggccatcgcgtcgttcgccgccatgcagatgggcgtgttcgtcgcctgctcgggcggcaacgccggcccggaccccataagcctcaccaacctttcgccgtggataaccacggtgggcgcgagcaccatggaccgagacttcccggccacggtgacgctcggcaatggcgcgaacatcaccggcgtttcgctctacaaaggcgggcgaaatctctcttcccaggagcaatacccgttggtgtacat

SEQ ID NO: 36087 - protein, 389 aa, Panicum virgatum
  misc_feature: Ceres CLONE 1964977
  misc_feature (32)..(119): Pfam Name: Subtilisin_N Pfam Description: Subtilisin N-terminal Region
  misc_feature (128)..(388): Pfam Name: Peptidase_S8 Pfam Description: Subtilase family
  misc_feature: SWISSPROT Homolog: EC 3.4.21.25 Cucumisin
  misc_feature: Functional homolog of the protein sequence given in SEQ ID NO 51144
  misc_feature: Useful for making plants with modulated flowering time
MGFGSARWRALPLCLALVALQAFLPACAAAPKTYIVQMAASEMPSSFDFHHEWYTSTVKSVSSVQLQGEEDDPYARRIVYNYETAFHGFAARLDEDEAERMAEADGVVTVLPETVLQLHTTRSPDFLGIGPEISDSIWSAGLADHDVVVGVLDTGIWPESPSFSDKGLGPVPAKWKGLCQTGRGFTTANCNRKVIGARIFYNGYEASSGPINETTELKSPRDQDGHGTHTAATAAGAPVPDANLFGYARGVARGMAPRARVAAYKVCWAGGCFSSDILAAVDRAVADGVDVLSISLGGGSSPYYHDSLAIASFAAMQMGVFVACSGGNAGPDPISLTNLSPWITTVGASTMDRDFPATVTLGNGANITGVSLYKGGRNLSSQEQYPLVY

SEQ ID NO: 36088 - DNA, 745 bp, Panicum virgatum
  misc_feature: Ceres CLONE 1964977-R
  misc_feature: Encodes the peptide sequence at SEQ ID NO. 36089
gtttacgacatcggccagggcgactacctggagttcctttgcgtggagaacctgacgccgatgcagctcagggccttcaccaagaactcgagcaagacatgcaagcacaccttcagctcgccgggtgacctgaactacccggccatctccgccgtcttcgccgagcagccgtctgcagcgctgacggttcgccgcaccgtgacgaacgtcggccctccgtcttcggcataccatgtgaaggtctctgagttcaaaggcgccgacattgtcgtcgaaccgagcaccctgcacttcacaagctcgaaccagcagctgacctacaaggtgacgatgacaaccaaggctgcgcagaagacaccggagttcggagcgctgtcctggagcgacggcatccacatcgtccgaagccccctcgttctcacatggctgccaccaatgtgagcttgctttgtctactgtgcatgcgccgctagtcaagcaatggagaaggaacctccgcggctccgcggccagggtaaccaagagtccaagacatatcggttgtgtttgtgtagcagaatgccagaatccactaaccgacgcaaacactgtcaagctccagggaaaacaggctttattcctcaatgttgtattctgcttattccagatgttcagttgctggtttaattttttctaaattaatgtgtgtacaacaacatatgcgagcaaacattatggaaaattcgatggcagcagatttaacttg

SEQ ID NO: 36089 - protein, 146 aa, Panicum virgatum
  misc_feature: Ceres CLONE 1964977-R
  misc_feature: SWISSPROT Homolog: EC 3.4.21.25 Cucumisin
VYDIGQGDYLEFLCVENLTPMQLRAFTKNSSKTCKHTFSSPGDLNYPAISAVFAEQPSAALTVRRTVTNVGPPSSAYHVKVSEFKGADIVVEPSTLHFTSSNQQLTYKVTMTTKAAQKTPEFGALSWSDGIHIVRSPLVLTWLPPM

SEQ ID NO: 36090 - DNA, 1310 bp, Panicum virgatum
  misc_feature: Ceres CLONE 1964978
  misc_feature: Encodes the peptide sequence at SEQ ID NO. 36091
acaccatctccctcctcttctcaccgaatcgcacgaagaggggctcccccttcatcaagacctcacctctctcccggtctccccccgtcccccctcacctacgagtgatagcccacgcctgctgcgcgtgccccctccctcctatagcccctcgccattactcccttcctcataaaggaagagcagagcagagcagggtcgaggaagaagcagcgccggggaagggcccggccgtagcctctccgcgacgccggctcggcgcctgccaaccgcgcggcgcggccaccccgctagaccccgtcttgcaggcgaacagagcctcgccgtcgatagcacaccagcggccggagacgggaaggccgggggcttcaggatggcgcgcgagcagctggaggaggccatcgtggccgacggcaacggcaaggaggaggaggtcggcgtcatgggcatcgccggcgcgggcgacggcgacgagcagcacggcggcggcaagttcagcatgaagagcttcctctggcacggcggctccgtctgggacgcgtggttcagctgcgcctccaaccaggtggcgcaggtgctgctgaccctgccgtactccttctcgcagctggggatgctgtccggcgtgctgctgcagatcttctacggcttcctgggcagctggacggcctacctcatcagtgtcctctacgttgagtaccgctcccgcaaggagaaggagggcgtcagcttcaagaaccacgtcatccagtggttcgaagtgctggacgggctgctgggcccgtactggaaggctgccgccctggccttcaactgcacgttcctgctcttcggctccgtcatccagctgatcgcctgcgccagcaacatctactacatcaacgaccggctggacaagcggacatggacgtacatcttcggcgcctgctgcgccaccacggtgttcatcccctccttccacaactaccggatctggtccttcctggggctcggcatgaccacctacaccgcgtggtacctcgccatcgccgcgctcataaacggccaggtagagggcgtctcgcacaccggcccgaccaagctcgtgctctacttcaccggcgccaccaacatcctctacaccttcggcggccacgccgtcacagtcgagatcatgcacgcgatgtggaagcctgccaagttcaagtacatctacctgctggcgacgctgtatgtgttcacgctgacgctgccgtcggcgtcggccatgtactgggcgttcggcgacgagctcctgagccactcgaacgccttctcgctgctgcccaaga

SEQ ID NO: 36091 - protein, 312 aa, Panicum virgatum
  misc_feature: Ceres CLONE 1964978
  misc_feature (49)..(311): Pfam Name: Aa_trans Pfam Description: Transmembrane amino acid transporter protein
MAREQLEEAIVADGNGKEEEVGVMGIAGAGDGDEQHGGGKFSMKSFLWHGGSVWDAWFSCASNQVAQVLLTLPYSFSQLGMLSGVLLQIFYGFLGSWTAYLISVLYVEYRSRKEKEGVSFKNHVIQWFEVLDGLLGPYWKAAALAFNCTFLLFGSVIQLIACASNIYYINDRLDKRTWTYIFGACCATTVFIPSFHNYRIWSFLGLGMTTYTAWYLAIAALINGQVEGVSHTGPTKLVLYFTGATNILYTFGGHAVTVEIMHAMWKPAKFKYIYLLATLYVFTLTLPSASAMYWAFGDELLSHSNAFSLLPK

SEQ ID NO: 36092 - DNA, 774 bp, Panicum virgatum
  misc_feature: Ceres CLONE 1964978-R
tcagcttcaccgtctacatcatccccgcgttcgcccacatcctcacctaccgcacggcctccgcgcgcatgaatgctgcggagaagccaccgttcttcctgccgagctggacggggatgttcgtggtgaacgtgttcatcgtggtgtgggtgctggtggtcggcttcgggctcggcggctgggccagcatggtgaacttcatcaggcagatcgacacgttcgggctcttcgccaagtgctaccagtgccccaagccgcccgtccccgccgcgccggcgccgttgccgcaccactaggggggcgcgcgtacgatggcggcggcggccggaggcatcgcaaggaagcccccgctctcccggccggctcgtcggcgtcgctttgcagcagccagtgttaattgctaggttttggtcgccttgtaatatacaagcctcctctcccctagggtgccgcttcacaccgtagcagaacccgatcggcagcagaggtttctcgcacggcggcggctcgggtcccgttcctgggcgtaacaagaacacaagatctcctcgccccgaggccgtgccgctgtcgcgtcgctttcccctcgccccgcgcccgatcggtccgtcgccatcggtgttccttgtgttttgtttggcttgccacaagtataagtgtgagtgatggtcatgggttataaggctcactctctctttctctcgctctcgctctcggctgatgtgagagtgagggtgacgattccacaatccatatgatatgacatacttatcc

SEQ ID NO: 36093 - DNA, 1183 bp, Panicum virgatum
  misc_feature: Ceres CLONE 1964989
  misc_feature: Encodes the peptide sequence at SEQ ID NO. 36094
ctccccaatctctgcctggctgctctgctcccctcccccctctccgcggctctgctatctcgatcgcttgcttctcgggccgggctaccacgccccgcggctgatgcgcgcctggccccatgccaatgccggcgcccgccatggcaagagccgcgctcccgctggcactggcgctcctcctcctcctgcggggcgcccctgagccggccgccgcggtgcggttcgactacgccacgctgacgctcggcagcctcaagctgctcggcgacgcgcacctcaagaacggcaccatccgcctctcccgcgacctgcccgtcccgacgtccggctccggccgcgcgctctacgcctccgcggtccccgtccgcgccggcttctccacccagttcgccttcaccgtcgccacgctcaacccctcctccgtcggtggcgggctcgccttcgtcgtcgccgcagacgactcctccctcggcgacgccgggccctacatcggcgtcgccaccgggaccgacgccgccgcggtcgagttcgacacgctcatggacgtgcagttcggggacgtgaacgggaaccacgtcggcctggatctcggctccatggtgtcggccgccgtcgccgatctcgacgaggccggcgtcgagctcaccagcgggaggaccgtcaacgcatggatcgactaccgaccggacaaatcgaaaggaggggggatcttagaggtgtccgtgtcctacgccgccaagcggccgaggacgccggtgctgtccgcgccggtcgaccttggggagagcgtcaaggacgcggctttcgtcggcttctcggcgtccacgcaggggagcacagaggtgcacgcgatcgagtggtggagcttctcgacagcgtcgccggcgccggcgccgcattcggcgcccacgccgccgccggaatcaccggtcgttcagccgccgccgagcgtcaatccggtgcttccttcaccgctgctccctggagtgatgactccgtcgccgccatccgcgacggtttcggcgccgaccagctccatctcggcggccagcgctccgtcgaacgcctccatggggaatgccggctcgccgcacccgcccgcgcacgcggccgtggccggcgccgccacggcgggcgcctttctggccgcctcgttcgcgggcttcgggctctgggcgctgga

SEQ ID NO: 36094 - protein, 347 aa, Panicum virgatum
  misc_feature: Ceres CLONE 1964989
  misc_feature (24)..(244): Pfam Name: Lectin_legB Pfam Description: Legume lectin domain
MARAALPLALALLLLLRGAPEPAAAVRFDYATLTLGSLKLLGDAHLKNGTIRLSRDLPVPTSGSGRALYASAVPVRAGFSTQFAFTVATLNPSSVGGGLAFVVAADDSSLGDAGPYIGVATGTDAAAVEFDTLMDVQFGDVNGNHVGLDLGSMVSAAVADLDEAGVELTSGRTVNAWIDYRPDKSKGGGILEVSVSYAAKRPRTPVLSAPVDLGESVKDAAFVGFSASTQGSTEVHAIEWWSFSTASPAPAPHSAPTPPPESPVVQPPPSVNPVLPSPLLPGVMTPSPPSATVSAPTSSISAASAPSNASMGNAGSPHPPAHAAVAGAATAGAFLAASFAGFGLWAL

SEQ ID NO: 36095 - DNA, 646 bp, Panicum virgatum
  misc_feature: Ceres CLONE 1964995
  misc_feature: Encodes the peptide sequence at SEQ ID NO. 36096
gggaaacaaagaggcttcctctccttccccaaactatcctcctctgcctctccctctccccgatccgatccgtagtggctcgcgtcccggttcctcgccggcggcagcggcgctgggcgagcggcggcggctgggagaggtcttcgtctgcgcttcgccggcggcgatcatccactaggtcggttggcggcggcggcggcggcggcggcggcggcggcggcgggagatggaggcggacaccgggaagctgttcatcggcggcatctcgtgggacaccaacgaggaccgccttcgagagtacttcaacaagtatggtgaggtggtggaggcggtcatcatgcgcgaccgggccaccggccgcgctcgaggcttcgggttcatcgtgttcgccgaccctgctgtcgccgagcaggtgattatggagaagcacatgatcgacggccggatggtggaggcgaagaaagctgtccccagagatgatcagcatgctctgagcaagagcggtggcagcactcatggatcgccagggcccagtcgcacgaagaagatatttgtcggtggtttggcttccaccgtgaccgaagcagacttcaggaagtactttgagcagtttgggacgatcactgatgttgtggtgatgtatgac

SEQ ID NO: 36096 - protein, 139 aa, Panicum virgatum
  misc_feature: Ceres CLONE 1964995
  misc_feature (8)..(77): Pfam Name: RRM_1 Pfam Description: RNA recognition motif. (a.k.a. RRM, RBD, or RNP domain)
MEADTGKLFIGGISWDTNEDRLREYFNKYGEVVEAVIMRDRATGRARGFGFIVFADPAVAEQVIMEKHMIDGRMVEAKKAVPRDDQHALSKSGGSTHGSPGPSRTKKIFVGGLASTVTEADFRKYFEQFGTITDVVVMY

SEQ ID NO: 36097 - DNA, 1341 bp, Panicum virgatum
  misc_feature: Ceres CLONE 1965001
  misc_feature: Encodes the peptide sequence at SEQ ID NO. 36098
atatgacattgtaaggccaacttagagcattcaaatacacctaaaccatccaagattcatgcggattgtgcagcttgcctgaaagcttttagggaccaatacgatgtgatggaatcttggcagttccctcagggagttcacccaaacacttcaaaaccagccatggagcctatggcaagcgaggcatctgtacccaaaagggcagattttgtagacctggtgctgcaagcgccagatcctccaagcctgtggtatgaccttattggcatgttgagaaaggcagttcgttaccgatgtgcagataagcatttcacactctctgtgtgtgtaatgtcaattctgcgtagtctgtttccaatacttgaatggtcgaaaagctacagcctgaagtccttccgaagtgacgccatggctggtcttactcttgcaagccttagcattccacagagcattggatatgcaaatctggcaaaacttgatcctcagtacggtctttatacaagtgctgtgccacctcttgtatatgctgttatggggacctctagggagatagccattggaccagttgcagttgtgtcactcttgctttcatcaatggttcagaagatagctgacccagccattgatccggcttcctatcggaaaatggttttcactgtgacattcctcactggtgtcttccagtttgcatttggtctgttcaggttgggtttccttgtggattttctctcacatgctgcaattactggattcatgggaggagctgccattgttattggactacagcagttgaaggggctacttgggcttggtcatttcacaagtaacacagatgttgtatctgtcaccagagcagtttgggtttctgttcacgaaccatggcaccctgagaacttcttcattggatgttcctttttcctcttcattcttggcatgagattcataggtcggaagaataagaatctcttctgggtctcaacaattgcacctgtgttctcagttgcattatctactctgatggtttatatcacaagagctgataaccatggtgtgaaaatcatacaaaaagtggatgcaggcatcaattcaagttcagtcaagcagataaatctcaatggaccctatattacagaatgtgcaaagatagctcttatttgtgctgttattgctctaacggaagctatcgctgttggtcgctccttttcagtcataaacggacataaattggacggcaataaggaaatggttgcaatgggtttcatgaatgtagcaggatccttatcatcttgctatgtggcaacagggtcgttctcccgcacagctgtgaacttcactgctggc

SEQ ID NO: 36098 - protein, 392 aa, Panicum virgatum
  misc_feature: Ceres CLONE 1965001
  misc_feature (177)..(392): Pfam Name: Sulfate_transp Pfam Description: Sulfate transporter family
MEPMASEASVPKRADFVDLVLQAPDPPSLWYDLIGMLRKAVRYRCADKHFTLSVCVMSILRSLFPILEWSKSYSLKSFRSDAMAGLTLASLSIPQSIGYANLAKLDPQYGLYTSAVPPLVYAVMGTSREIAIGPVAVVSLLLSSMVQKIADPAIDPASYRKMVFTVTFLTGVFQFAFGLFRLGFLVDFLSHAAITGFMGGAAIVIGLQQLKGLLGLGHFTSNTDVVSVTRAVWVSVHEPWHPENFFIGCSFFLFILGMRFIGRKNKNLFWVSTIAPVFSVALSTLMVYITRADNHGVKIIQKVDAGINSSSVKQINLNGPYITECAKIALICAVIALTEAIAVGRSFSVINGHKLDGNKEMVAMGFMNVAGSLSSCYVATGSFSRTAVNFTA

SEQ ID NO: 36099 - DNA, 704 bp, Panicum virgatum
  misc_feature: Ceres CLONE 1965001-R
  misc_feature: Encodes the peptide sequence at SEQ ID NO. 36100
ctgcttcataaacgccagtttcgtcagagaaaggattacaggatgggtaaccgaaaagcttgaggaaatccacaccgttgttcttgacatgtcaaatgtggtgaacattgacacagcaggtcttgcagcgttggaagaactgcgcgaggagctggtgtctcgtggcatacagatggctatagccagccctggatggcaggtgatccacaagatgaaactagcacggctcgtcgatggaaccggagaaaactggatcttcctcacggttggtgaagcagtggaagcgtgcctagccagtaagaagggcggcgatctggaacgctgaattcgccgtccttgttgccattgctgaataaacatatgggtgtggtatcctatatttctatctactctgtccacggcagtggatttcgctattgtgtaagctgatgcagctcttgaagtattccacggccacgcttctgtcagaggagctctttgaacgcacagaagggtggcgtctgcatagaataaggaatacgtgtgaagtgacgtgtcctaagggtcacacccgacccttgatgcttgtgattgtaagtatttcttatgattggattggaattgtgcctataaaagcttgtgtttactgctaacctatctgtaaccaaacaaattgtggcgcttaagtgaacttgctagcatgggctgttgctggctggctcgct

SEQ ID NO: 36100 - protein, 107 aa, Panicum virgatum
  misc_feature: Ceres CLONE 1965001-R
  misc_feature (1)..(92): Pfam Name: STAS Pfam Description: STAS domain
CFINASFVRERITGWVTEKLEEIHTVVLDMSNVVNIDTAGLAALEELREELVSRGIQMAIASPGWQVIHKMKLARLVDGTGENWIFLTVGEAVEACLASKKGGDLER

SEQ ID NO: 36101 - DNA, 1129 bp, Panicum virgatum
  misc_feature: Ceres CLONE 1965032
  misc_feature: Encodes the peptide sequence at SEQ ID NO. 36102
acgccgccacacacgctttgtattcctcgcgccaccgccacaaaactccaagacgagcagaagaggaggtgccggccggcccgctcccagaatctcccaccactgcaacccctaggtgtttccctttgtcgtctccctctcctccgccgttggagtccaactactccctagtcagcagcctcagccatggggacggaggaggccaacggcctcgtcgtggtgccggagccgcgcccgcgcaagggcctgacctcctgggcgctcgacctgctcgagtccgtcgccgtgcgactcggccacgacaaggccaagccgcttcactggctatcaggcaactttgcccccgtcgtcgacgagactccgccggcacctgacctccccgtccgcggacacctcccggagtgcttgaatggagagtttgtcagggtcgggcctaatcccaagtttgtcccagtcgcagggtaccactggtttgatggagatggaatgattcatgccatgcgtattaaagatggaaaagctacctatgtatcaagatatgtgaagacggctcgcctcaagcaggaagagtattttggcggagcgaagtttatgaagattggagatctaaagggattctttggattgttcatggtccaaatgcaacaacttcgtaaaaaattcaaagtcttagattttacctatggagttgggacagctaatactgcacttatatatcatcatggtaaactcatggccttatcagaagcagataagccctatgtagttaaggtccttgaagatggagacttgcagactcttggtttgttggattatgacaaaaggctgaaacattctttcaccgcccatccaaaagttgatccatttacagatgaaatgttcacttttggatactcacatgagcctccttactgtacataccgtgtaattaccaaagatggggctatgctttatcctgtgccaataacaataccagaatctgtaatgatgcatgactttgccatcaccgagaattattctattttcatggatctccctttattggtccgaccaaaggaaatggtgaagaatggtgagtttatttacaagtttgatcctacaaagaaatctcgttttggtattctcccac

SEQ ID NO: 36102 - protein, 314 aa, Panicum virgatum
  misc_feature: Ceres CLONE 1965032
  misc_feature (34)..(314): Pfam Name: RPE65 Pfam Description: Retinal pigment epithelial membrane protein
  misc_feature: SWISSPROT Homolog: EC 1.13.11.51 9-cis-epoxycarotenoid dioxygenase
MGTEEANGLVVVPEPRPRKGLTSWALDLLESVAVRLGHDKAKPLHWLSGNFAPVVDETPPAPDLPVRGHLPECLNGEFVRVGPNPKFVPVAGYHWFDGDGMIHAMRIKDGKATYVSRYVKTARLKQEEYFGGAKFMKIGDLKGFFGLFMVQMQQLRKKFKVLDFTYGVGTANTALIYHHGKLMALSEADKPYVVKVLEDGDLQTLGLLDYDKRLKHSFTAHPKVDPFTDEMFTFGYSHEPPYCTYRVITKDGAMLYPVPITIPESVMMHDFAITENYSIFMDLPLLVRPKEMVKNGEFIYKFDPTKKSRFGILP

SEQ ID NO: 36103 - DNA, 114 bp, Panicum virgatum
  misc_feature: Ceres CLONE 1965032-R
gcacgaggaaaaaacagggaaaccggaagggaaggaagagacgcgaagacaaggccggcggacccaggggcagggggggagcccccaaacagggccccgaagggagaccacgcc

SEQ ID NO: 36104 - DNA, 1073 bp, Panicum virgatum
  misc_feature: Ceres CLONE 1965058
  misc_feature: Encodes the peptide sequence at SEQ ID NO. 36105
aacgcgaggcatcaagacgcgattcctcttgctgccgacagaggtgctccacggccgaaccctaagcccgcacgcattccctgtgctccaagcgtgctgggctgtgccgtgctggcagtccgccgcggagggttgtttactgcctcatatacaaataatatgctgctcaattaatttgcccttttgaggatcatcatatgggttacctcaatcttaggagctctttccatattctgctctcaatacagttgctgttatcattgttcaaccccgtggcagtcgcagacttggcctccgagaagcaagcgcttctggactttatctctgcagtctctcatggcaacaagctcaactgggataaaaatacatcatcttgttcatggcatggtgtaaaatgctcggcagatcagtcacacgtttttgaattgagggtaccagctgctggtatcattggagcaattcctccaaacactcttggaaaactcgattccctccaagtattgagcctgcggtctaatcgtttaacgggaagtcttccatctgatgtggcctcacttccttctttacattccatatacctacagcacaatgaattttcaggaccgttgccttcttccttcagtcctagcctcagtgtaatagacctctcctacaattccttcacaggacaagttccagcaagtttacaaaaactgactcagttaactgcgctaaatttacaagacaattctttctctggatccatccctgacctcaagcttccaagtctgaaactattaaatctgagcaacaatgagctggaaggtccaattcctcgttcgctcgaaacatttccaaatggttcgttctcagggaatcctggactgtgtgggctacctctacctgaatgctcagttccttcaccaacaccctcacccgagtcatcttcatcgccacaatcgctgcctttgccacaccataagaaactaggcataggtctcataattgcagttgctgttggtggatttgcattggtgatactagttgtggttgtgttggttgtgtatttttcaaagaggaaaggcaaggatgag

SEQ ID NO: 36105 - protein, 291 aa, Panicum virgatum
  misc_feature: Ceres CLONE 1965058
  misc_feature (31)..(68): Pfam Name: LRRNT_2 Pfam Description: Leucine rich repeat N-terminal domain
  misc_feature: SWISSPROT Homolog: EC 2.7.11.1 Non-specific serine/threonine protein kinase
MGYLNLRSSFHILLSIQLLLSLFNPVAVADLASEKQALLDFISAVSHGNKLNWDKNTSSCSWHGVKCSADQSHVFELRVPAAGIIGAIPPNTLGKLDSLQVLSLRSNRLTGSLPSDVASLPSLHSIYLQHNEFSGPLPSSFSPSLSVIDLSYNSFTGQVPASLQKLTQLTALNLQDNSFSGSIPDLKLPSLKLLNLSNNELEGPIPRSLETFPNGSFSGNPGLCGLPLPECSVPSPTPSPESSSSPQSLPLPHHKKLGIGLIIAVAVGGFALVILVVVVLVVYFSKRKGKD

SEQ ID NO: 36106 - DNA, 761 bp, Panicum virgatum
  misc_feature: Ceres CLONE 1965066-R
  misc_feature: Encodes the peptide sequence at SEQ ID NO. 36107
ctcaatggtgtgatttatgcagttggtggcttcaacagtgttcaatatctgagttctgctgagagacttgatcctcgggagcctaattggaaaatgctcccaacaatgaatgcaggaaggggctgccatacacttgcagtgcttgatgagaagatattttcaattggtggttatgacaatggggctaaagctatggtggctactgttgagatgtacgagccaaggatgccatcatgggtgataattgaacccatgaaccacaccagaggataccattcttcggctgtgcttggtggctcgatatttacatttggtggggtgaaaggtgaagcagatactatcctggatgtggtggaacggtacaaggaagggtgtggctgggtgactactgggttgaagtccatcggcaggaggtgctactgctccgccattgttctctgactgtttgtttacagcagtatcatacttgcgtggtgaatttgctacgatagcttctgacaatgaattgaccaacaagcagatagttaaaacttagaaagccctcgttcgacctgatgagctgagacctgtagacattgagaatgcgatgtgtgtgtgttgagaccctcgtttcttactcttcctcttgttcctgatccgaaccactgtaaaacaatgatgtgtgtgtgttgtctggtttgtgatacggcaacaccggatgtgaaactgaatctgtactgaactagtagatgcgaacgcaatggaacaacatggtgatggct

SEQ ID NO: 36107 - protein, 146 aa, Panicum virgatum
  misc_feature: Ceres CLONE 1965066-R
  misc_feature (1)..(37): Pfam Name: Kelch_1 Pfam Description: Kelch motif
  misc_feature (39)..(86): Pfam Name: Kelch_1 Pfam Description: Kelch motif
LNGVIYAVGGFNSVQYLSSAERLDPREPNWKMLPTMNAGRGCHTLAVLDEKIFSIGGYDNGAKAMVATVEMYEPRMPSWVIIEPMNHTRGYHSSAVLGGSIFTFGGVKGEADTILDVVERYKEGCGWVTTGLKSIGRRCYCSAIVL

SEQ ID NO: 36108 - DNA, 1079 bp, Panicum virgatum
  misc_feature: Ceres CLONE 1965066
gagtaagcatccatctcaggaccaagaaaagaaccgctcgcttctcaattttctctcggtgcagtgtgtgtgatcgtctccttccccttcccctcgtccttccaacagcagtgggttaatctggtgtaggaatctttttcctcgatcacatcttctttctctcaggcacagcaaagcaaagcaatctcaagcatctatataatggtgaagagcaaatcctcgtggaggcagattgtgaaagacagcagaccaacgaacgtgtccatttccacaagaaacctcagcccacaagatcttggagctgtaatatttggttgcacaaacaataccattgcagagtgtcactcaaggcaacttttcggcttgccaagagcacatatctcctatgtgcaaaacattaaggaaggattacctctcttcctcttcaactatgacgaccgcagattgtatggtatttatgaagctgcaggcagtggcaagttctgtcctgaatcaaaagcatggtcacatgatggcaaaggaaagacaagttaccctgcccaggttgcagtgcgagtaagggtgtggtgttttccgctagcagagaatcagtttagaagtgctattctagccaactattaccagaagatgcctggtgtccctggccagaagcttcatttcttccagtttgaattggatcatgcacaaacacatgttttgatggaaatgtttactccttcgcctcctcccgacaatttctggaagccctctgctgcagcaccagctgatgagtatgtgagcgaattaatatcttcacctgtatggccaccaaagtgtgagaggaataatgatctcaaatcagaaaaggttgtaaagtcatatgcagacattgtaaggaagaacaaatttgaggaagttggaacaggagatgtggatgctgaacgtgctagctcaggtaatgaatcttcaaatggttttgatgatctggattgtggaaacacaccaccagagagggaggaacatgaactatcagataaggcggttgaagtacaaaagcaactacaatctggtcggcaggaaaaagtgcttagcatcaattg

SEQ ID NO: 36109 - DNA, 450 bp, Panicum virgatum
  misc_feature: Ceres CLONE 1965070
  misc_feature: Encodes the peptide sequence at SEQ ID NO. 36110
atcgtcgttgtcctctccctgtaatgtcactcccccgaagcttgcccgcagctcaatggccatgaggacgacggccgcggccgcctcccgtgccctcgtcgccctcctcatcgtcgccatcgccgtcgccgtcgccgtcgccgacgacggctcgacgctgctggagatcaagaagtccttccgcaatgtcggtaacgtactgtacgattggtccagcgacgactactgctcctggcgcggcgtgctgtgcgacaacgtcaccttcgccgtcgctgctctcaacctctctggactcaaccttgggggcgagatctctccagccgtccgcagcctcaagagcctcgtctccatgtatggatgattccttgtttaccctaatgaccgtgctgattgcagttttctgaccgaaggtactttgtgtgcattggtatgtgcatcaagtgatctgaa

SEQ ID NO: 36110 - protein, 101 aa, Panicum virgatum
  misc_feature: Ceres CLONE 1965070
  misc_feature (28)..(66): Pfam Name: LRRNT_2 Pfam Description: Leucine rich repeat N-terminal domain
MAMRTTAAAASRALVALLIVAIAVAVAVADDGSTLLEIKKSFRNVGNVLYDWSSDDYCSWRGVLCDNVTFAVAALNLSGLNLGGEISPAVRSLKSLVSMYG

SEQ ID NO: 36111 - DNA, 1318 bp, Panicum virgatum
  misc_feature: Ceres CLONE 1965100
  misc_feature: Encodes the peptide sequence at SEQ ID NO. 36112
ttcctgctcaaaaaaaaaaaaaaacgaaaagcttccctccgcaccaaaccaaccaaaacccccaaaccctcgccattcctggagaacccacatcgcctcgctgaccacgccgagcgattcgacccgctgcggtcggcgggctcctcaattcgcgatcgggtcccgtgatccgagcgcgatcccgcggttcggtgccgaattggggggaggaatttcaagcggcgtcgcatctcgcaagcgcggctccccagaagcttctggaacgttcgacggcctcctgctccggatctctctcggggttgcttgaccaggcccgggatttcgcggggaaccggcgcgcggcggatttggggcgcgcacgggggaagtcgaaatggcggcgcggcgccgcctcctcctcgccgtggcggtgctctgcgccgcgttcgcctccgccgcttccttcaccgacccccccgatgcgataggactttgggggttatatcgcacattagagtcgccatggcagctttctggttggacattccagggcggtgacccatgcggcgggggtggtgggcgtcgacagtggcgaggcgtcttttgcaagggatcctctgttgtcgcaataaatattagcgggctcggagttggtggatggcttggcccagagctgctcaagtttcagtcactgaaaaaactggatttgagcttcaataacatttctggtgaaatcccacccactttgcccccaaatgtggaatacttaaatttggcagccaacaagtttgaagggaatatgccatcaacattgccatggttgcactccctgaaatacctgaacttcagctacaataaactctctggaattattggtgatgtttttgttaacatggatagcttagaaacgatggacttgtcattcaacgctttcagtggtgacctaccaagatcgtttagcttattgacaaaccttcgctacctttacctacatcataacgagttcacaggatctgtgattttgttagcaggccttccactgtcatccctcaacattgaaaacaatcacttcagtggttatgttcctggaacatttgagtccattcctgagctgaggattgatggaaacaagtttcaacctggtttcagacatgcatcgtcctcatttacaaagagggctcattcacctccacctcagtctttgtctccatctctaccaccacctccacctccacctccaccatttccaccagcagctaagcagaatccaaagcacaggccaaaatttccaaagccttctttggggtattcttctctgcaaagtaatagccaccatagg

SEQ ID NO: 36112 - protein, 314 aa, Panicum virgatum
  misc_feature: Ceres CLONE 1965100
  misc_feature: SWISSPROT Homolog: EC 2.7.11.1 Non-specific serine/threonine protein kinase
MAARRRLLLAVAVLCAAFASAASFTDPPDAIGLWGLYRTLESPWQLSGWTFQGGDPCGGGGGRRQWRGVFCKGSSVVAINISGLGVGGWLGPELLKFQSLKKLDLSFNNISGEIPPTLPPNVEYLNLAANKFEGNMPSTLPWLHSLKYLNFSYNKLSGIIGDVFVNMDSLETMDLSFNAFSGDLPRSFSLLTNLRYLYLHHNEFTGSVILLAGLPLSSLNIENNHFSGYVPGTFESIPELRIDGNKFQPGFRHASSSFTKRAHSPPPQSLSPSLPPPPPPPPPFPPAAKQNPKHRPKFPKPSLGYSSLQSNSHH

SEQ ID NO: 36113 - DNA, 656 bp, Panicum virgatum
  misc_feature: Ceres CLONE 1965100-R
gatgacaatcatagcagacaaattagtaaaactgtcgaatcaacaggtcttcaaaagactagcacaacacagcgatggagggttgatgctcaggacccctctttcgtaacaactagaccttactttgagccatcctctactgtcagccagggaggaactgagagctgcatctcccgatgatgaaggcctgctcttcgccaatcattcccggtctcatgctgccttatctactcaatagcacttccaagtatcttaccaatgccagttggttcatcagtgcgtgatgcccaaagctgctgtgttgcatcctgattaccagaggacttcgggtagattccactattgtctacataaaaaggagtgatcaacaaactgcagtctctaactcatgcagaaattggtgcaagcttggttacccgtacagccatgacttacgggttcaggattcttaccccatctctttggaaccggagtcatcagtgaactccatatggagatagctattttggatgctcttttgtagtttgtccaggatctcccattggctggtccaggcttcacttgctgtacagcaaggcagcctgatctatggtcgctgtctgtgaaactgtgaagatgagacgtttgctagacattagcttccaagttccagcggc

SEQ ID NO: 36114 - DNA, 453 bp, Panicum virgatum
  misc_feature: Ceres CLONE 1965102
  misc_feature: Encodes the peptide sequence at SEQ ID NO. 36115
aaaaaaaaatcccctccctttgacagagggagggggagagatatagggggagacggagggggaggaggaggaggtcgtgagctcgggagggagcgtgtgcgctgcgctgcagatcgggcggcgcctccgcgtagctcgggccgtttgagggggcccgcccgccccctgcgccggtgaggtggtggggcccgctctgcgcgcgagtccgaatggcggcggcggcgaggtggtgggcggcggtggcgctcgctgtggcggtggtgctcgggccggggcgggtcgtccccgacaccgagggtgatgctctgtaccgcctgcggccgagcttgacagatgctaactctgtcttgcacagttgggatccctctcttgtttatccctgtacatggttccatgttacgtgtaacagtgataccagtgttatcccagttgaccttggatatgcaccattat

SEQ ID NO: 36115 - protein, 81 aa, Panicum virgatum
  misc_feature: Ceres CLONE 1965102
  misc_feature (26)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAAARWWAAVALAVAVVLGPGRVVPDTEGDALYRLRPSLTDANSVLHSWDPSLVYPCTWFHVTCNSDTSVIPVDLGYAPL

SEQ ID NO: 36116 - DNA, 406 bp, Panicum virgatum
  misc_feature: Ceres CLONE 1965169
  misc_feature: Encodes the peptide sequence at SEQ ID NO. 36117
aaaaagatttcacacctggcttgaaggggctcgtgattgggctgttagcagaactaggttctggggcactccacttccactgtggatgagtcaagatggtgaagaaattgttgttatggattccattgagaaacttgaaaaattatctggagtgaaggttactgatcttcaccgacactatgttgacgatattacaattccctctaagagaggacccgagcttggtgtgctcaaacgtgttgacgatgtttttgactgctggttcgagagtgggtcgatgccgcatgcctacattcattatccttttgagaataaggagctatttgaaaagaattttcctggctattttgttgcatagggtttagaccaaacacgctgatggttctatactctgatggtgctctca

SEQ ID NO: 36117 - protein, 118 aa, Panicum virgatum
  misc_feature: Ceres CLONE 1965169
  misc_feature: SWISSPROT Homolog: EC 6.1.1.5 Isoleucine--tRNA ligase
KRFHTWLEGARDWAVSRTRFWGTPLPLWMSQDGEEIVVMDSIEKLEKLSGVKVTDLHRHYVDDITIPSKRGPELGVLKRVDDVFDCWFESGSMPHAYIHYPFENKELFEKNFPGYFVA

SEQ ID NO: 36118 - DNA, 628 bp, Panicum virgatum
  misc_feature: Ceres CLONE 1965171
  misc_feature: Encodes the peptide sequence at SEQ ID NO. 36119
gtcccagctgtgtactgctcgtcgccttcctagttcctccccctcctcccgccgccaaccgccgcacgcacgccccgcccgcctctccacttgtctctatccatccacgcatcccccgtcacctacctcactcatcgccacccaaaaccctaaaccccattccgtacctcgccgccgccgccgccgccgcgatgcagtccctggcgctcacctcgccctccctcccggcggccggccctgtccccggccgccgcggcctccagcgcgtccgcgccaccgccgtctccgacgagcccaagctcaacaagtacagcgcgcgcatcaccgagcccaagtcgcagggcgcctcgcaggccgtgctctacggcgtcggcctcaccgacgccgacctccgcaagccgcaggtcggggtctcctccgtgtggtacgaggggaacacctgcaacatgcacctgctccgcctcgccgaggccgtccgcgacggcgtccgcgaggccggcatggtcggcttccggttcaacaccgtcggggtcagcgacgccatctccatgggcacccgaggcatgtgctacagcctccagtcgcgggacctcatcgcggacagcatcgagaccgtcatgggcgcgca

SEQ ID NO: 36119 - protein, 145 aa, Panicum virgatum
  misc_feature: Ceres CLONE 1965171
  misc_feature: SWISSPROT Homolog: EC 4.2.1.9 Dihydroxy-acid dehydratase
MQSLALTSPSLPAAGPVPGRRGLQRVRATAVSDEPKLNKYSARITEPKSQGASQAVLYGVGLTDADLRKPQVGVSSVWYEGNTCNMHLLRLAEAVRDGVREAGMVGFRFNTVGVSDAISMGTRGMCYSLQSRDLIADSIETVMGA

SEQ ID NO: 36120 - DNA, 1068 bp, Panicum virgatum
  misc_feature: Ceres CLONE 1965179
  misc_feature: Encodes the peptide sequence at SEQ ID NO. 36121
accacacgccgagacttgctcttcttcttcttgttgttgaggaatagatagatagaattctggggcagccggggcccgagatcggcgaggagccgtccggccggccgtgcttgcttgcgccattgatacatccttccatctcatctactagagagggagttgtagcagcagatccacccaacacaatgacgacctgggacagcgttccctccaccacgccgctcccctacgcctactcgccgctcccggccgccgacgccgcctccgccgaggtctccggcgccggccgagccaacggccgccgcaggccgctctgcgccgccgcgctcgtgctgtccgccgcgctgctcctggccgtcgcggcgctggccggcgtccgcatcgcgcccccgcgccccatcacggtgggagtgggagagacgacgactgcggcggcggcggcggctaggagcaggggccccgcggccggcgtgtcggagaagacgtccggcgcgcaggggatgctgcgcggcggcaacgccttcccctggaggaacgcgatgctgcaatggcagcgcacgggattccacttccagccgcagaagaactggatgaacgatcccaacggccctgtgtactacaaggggtggtaccacctcttctaccagtacaaccccgacggcgccatctggggcaacaagatcgcgtggggccacgccgtgtcccgcgacctcgtccactggcgccacctcccgctcgccatggtgcccgaccagtggtacgacatcaacggcgtctggacgggctccgccaccaccctccccgacggccgcctcgccatgctctacaccggctccaccaacgagtcggtgcaggtgcagtgcctcgccgtccccgccgaccccgccgacccgctcctcaccaactggaccaagtacgacggcaaccccgtgctgctcccgccgccggccatcggccccaaggacttccgtgaccccaccaccgcctggttcgacccctccgaccgcacatggcgcatcgtcatcggctccaagggaccgcaccacgccggcatcgccgtcacctacc

SEQ ID NO: 36121 - protein, 294 aa, Panicum virgatum
  misc_feature: Ceres CLONE 1965179
  misc_feature (128)..(294): Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature: Functional homolog of the protein sequence given in SEQ ID NO 51130
  misc_feature: Useful for making plants with altered carbohydrate content
MTTWDSVPSTTPLPYAYSPLPAADAASAEVSGAGRANGRRRPLCAAALVLSAALLLAVAALAGVRIAPPRPITVGVGETTTAAAAAARSRGPAAGVSEKTSGAQGMLRGGNAFPWRNAMLQWQRTGFHFQPQKNWMNDPNGPVYYKGWYHLFYQYNPDGAIWGNKIAWGHAVSRDLVHWRHLPLAMVPDQWYDINGVWTGSATTLPDGRLAMLYTGSTNESVQVQCLAVPADPADPLLTNWTKYDGNPVLLPPPAIGPKDFRDPTTAWFDPSDRTWRIVIGSKGPHHAGIAVTY

SEQ ID NO: 36122 - DNA, 645 bp, Panicum virgatum
  misc_feature: Ceres CLONE 1965179-R
  misc_feature: Encodes the peptide sequence at SEQ ID NO. 36123
agcccgacgtcggctacaactgcagcaccagcgacggcgccgccagcaggggcgcgctcggccccttcggcctgctcgtcctcgccgacaagcacctccacgagcagacggccgtctacttctacgtggccaaggggctcgacggcgccctcaccacgcacttctgccaggacgagtcgcgctcctcctccgccaacgacatcgtcaagcgcgtcgtcggcagcgccgtcccggtgctcgacggcgaggacacgctctcgctccgggtgctcgtggaccactccatcgtcgagagcttcgcgcagggcggcaggtccaccgccacctcgcgcgtctacccgaccgaggccatctacgccaacgccggcgtctacctcttcaacaacgccaccgccgcgcgcgtcaccgcaaagaagctcgtcgtgcacgagatggactcgtcatacaaccacgactacctttaatttcttcatcagatcatcgtctccattatatttttgagccatccacggcttgtacttattgttaattccgatccaagcatgcctctcgatttttgtttatctttcttttcttttcttttcttttcttctttttaatctcctcctctcctaagcaggctatataatttttgtttctggttcc

SEQ ID NO: 36123 - protein, 153 aa, Panicum virgatum
  misc_feature: Ceres CLONE 1965179-R
  misc_feature (1)..(103): Pfam Name: Glyco_hydro_32C Pfam Description: Glycosyl hydrolases family 32 C terminal
  misc_feature: SWISSPROT Homolog: EC 3.2.1.26 Beta-fructofuranosidase
  misc_feature: Functional homolog of the protein sequence given in SEQ ID NO 51130
  misc_feature: Useful for making plants with altered carbohydrate content
  misc_feature: The sequence is a functional homolog of SEQ ID NO 4 in US patent 7253335
PDVGYNCSTSDGAASRGALGPFGLLVLADKHLHEQTAVYFYVAKGLDGALTTHFCQDESRSSSANDIVKRVVGSAVPVLDGEDTLSLRVLVDHSIVESFAQGGRSTATSRVYPTEAIYANAGVYLFNNATAARVTAKKLVVHEMDSSYNHDYL

SEQ ID NO: 36124 - DNA, 1133 bp, Panicum virgatum
  misc_feature: Ceres CLONE 1965196
  misc_feature: Encodes the peptide sequence at SEQ ID NO. 36125
atccccttatccgccgccaccaaggccaaaacccaacacgctctcacccaatccatggcgccaccgcgctaaaccccccaacctccgctccgcccttcgctccccgccttcatggcgctctccgagctcccgctccaccactccttccgcctctcctccaggccccacctccaccgcctcctcccgctccgcctcctctcctcccgccacgcctcggccgccgccgcctcggcctcctccccctcttcctccagcggcaaccgcgcggccccacccgccccaagtaccggcgcgccgtggctgcagaagtgggcgccgtccgacccctcccagcccgcccccgccccgtcccccaccacctccatcgaccgcatcgtccaccgcctccgcaacctcggcctcgcctccgacgacgacgacccctccgcctccactgccacggccaccgcgccccccgacggcaccgagcgccttggcgacctgctcgaccgcagctgggcgcggcccgaccgccagttcgcggccgccagcttcgacgacgcgatcctcccgtgggagagggacgaggaggccgcggcggggagcagagacgaggaggatggggccaagaggaggcgggtgaaggcgcccacgctggccgagctaacgatcgaggacgaggagctgcggcggctgcgcaggctggggatgactctccgcgaccgcatcaccgtgcccaaggccggggtcaccacggccatcacggagaagatccatgacgcgtggaggaagtcggagctggtccgcctcaagttccacgaggacctcgcgcacgacatgaagactgctcatgagctcgttgagcgacgcacgggcggattgatcatatggagatctggaagtgtcatggtggtttaccgagggagcaattacaaaaggcctctgaaatctcaagctctgaatggtgcctcaacaccagtaaagggggaagatggtacattgttcatcccagatgcctccagccctgctgagagtgacagtcaggggaaggatttggctgcgcaacgtgcagatgtgtcccaattgaacatgcagaatactgaggacatgacagaggaagagctggaatttcatcaaatgcttgatgaattggg

SEQ ID NO: 36125 - protein, 340 aa, Panicum virgatum
  misc_feature: Ceres CLONE 1965196
  misc_feature (180)..(263): Pfam Name: CRS1_YhbY Pfam Description: CRS1 / YhbY domain
MALSELPLHHSFRLSSRPHLHRLLPLRLLSSRHASAAAASASSPSSSSGNRAAPPAPSTGAPWLQKWAPSDPSQPAPAPSPTTSIDRIVHRLRNLGLASDDDDPSASTATATAPPDGTERLGDLLDRSWARPDRQFAAASFDDAILPWERDEEAAAGSRDEEDGAKRRRVKAPTLAELTIEDEELRRLRRLGMTLRDRITVPKAGVTTAITEKIHDAWRKSELVRLKFHEDLAHDMKTAHELVERRTGGLIIWRSGSVMVVYRGSNYKRPLKSQALNGASTPVKGEDGTLFIPDASSPAESDSQGKDLAAQRADVSQLNMQNTEDMTEEELEFHQMLDEL

SEQ ID NO: 36126 - DNA, 689 bp, Panicum virgatum
  misc_feature: Ceres CLONE 1965196-R
ccctcagtcagcatatagatcaactgaaaagcaatatcaagcagatgaagctgattttgggtatcgaggactatgaggaacaaaaggaggatagctcagattcagaaaatgaagatgggacagatgttacctctgcaagctacgatgaggaccaagacgattttgatgaatcagctgatgaatatggtgattatgacgatgatgaagatgatgaggttgacagatagtagtatggaattgtttcttgtgatgtgcagttctgaagtaatgattctccgtatgtgatgctgtacttcggacatccatatggagccaagtttatggatggcccttgatgactggtaccacagctcctgcatttgatgtatgtactccaactccattgcttcgttcatggcagaatgggtgttgagatccacattagaagtgctgcgactgagctgggaaatttcatgcaccatgtgatttatgagatctatgctcacagcatcatttctctctcgttccttttgcctttcttctcttgtgactacatcttagagggctcggcgtaggtggcatttttctttctccaatttctctccagaaaatatacctggacacgagcattgtgtaactcagtccggctgaaaccaaatatactagaacagcataaatttgatcaagaagtaactgaagggtgttccacc

SEQ ID NO: 36127 - DNA, 1230 bp, Panicum virgatum
  misc_feature: Ceres CLONE 1965214
  misc_feature: Encodes the peptide sequence at SEQ ID NO. 36128
cagatcctcccccggccccgcccgcccccctcctcagatccacgaagctccctcccaccgacgcctcctctgctcctcggattctccgcaggagcactcaaaaaaaaaatctccgctggaggccagcgagcggcagccccgcaggcgctccacggcgggttggcgcgccgcacagggctacacagcgggtggcggcttggcgccaccggtgcgctgctccgcctccgcgaggcgcgggcggatgggcctccggttcttcgccagattcctcacatggttgttgtgcacgggcaagtaatctctcgattccctttcccttttcctcgatttttttcatctgcaatctcaatagctgttgcaaatctcataaatccgtgccgttttgtgttacaacttactgcagctagacgggatctgagttcttgactggtttggagatgaaagccacgttcttggatggtgctcctttttacttcgtattccttctttttcgtggttgcaaatctgtccttttcaaagcttgtcccccgttgctgcttggagtcctgccactgctcgttcggtatatgcactcctcaccctctcccttgaagaactggtgatgcagactgtacatgttgtttgtgctgtcattggtgtttttttttaagatttagatctgagaattttcatggtattttctgagcatatgtgcaagtcagtgatgatggtacttctaatttgaaggtatgtccatgcccccactgattcgttttttgttgttgtgactgataccaggcaaagtattcatggcgaaggagatggagacataggaaatcatggcagtcaagaagatccgcatggacaccgagcgagaggacttccctatcacggccatccaggagattaaaatcctcaagaagctgcactaccagaacatcgtcaatatcaaagaggtcgtcatcgccagggccagagagagatgagcaggggatgcaaagtatgattctaaacaaaaacaccattgaaagttttgctttattgctaatccagatgtgccatatgttgtgatgttgggtagtcaagggcaacaagtacaagggaagcatttgcctttggcattggcgtgtaatgatcggctaaattctgaccgagagagattatgctttttttcttttctgcctgtttgtcgacattgcttggcgggaacataaatactcagtggctattgtgtcaatgcctaggtgaagt

SEQ ID NO: 36128 - protein, 48 aa, Panicum virgatum
  misc_feature: Ceres CLONE 1965214
  misc_feature: SWISSPROT Homolog: EC 2.7.11.22 Cyclin-dependent kinase
MAVKKIRMDTEREDFPITAIQEIKILKKLHYQNIVNIKEVVIARARER

SEQ ID NO: 36129 - DNA, 649 bp, Panicum virgatum
  misc_feature: Ceres CLONE 1965214-R
agtttctttaaatagctgctggtttcgcaggaagaaaaaagctgctggttacctggtagatgtacatttattcagtaaggttagttttttttttcttcagaattttaggaatgttcaagattctgtcaaacggttacctaaatcatgagattttggatccagatcccctatccaaactggtacttgttaatagatgcactgaagtgagaaataagtatactctacctatgggtccattctatttgttattcttgtgaatcaacatgttattcaatcagagttgtatgttggaattctttgtcttattactctcatgatccatgtgttattctgaacactagccaattatctacccatgccacattcatttcttgaaagctctttccagactagagtccaagctaagaccaaattctgaaagtggcacaggtgaagcttcaggacagcagattgttttttttttattattatagaactgataggcgaggacggcagattgcttttttttttagaacagataggcgaggacagcagattgcttatcacacttctgaccgaggtgaagtctctgaaacatttagtcccatatttatttaatgcaaatttaagtgtaccgaaggaaaaaaaacataaacacgcgcacgtccag

SEQ ID NO: 36130 - DNA, 1407 bp, Panicum virgatum
  misc_feature: Ceres CLONE 1965242
  misc_feature: Encodes the peptide sequence at SEQ ID NO. 36131
aaaacccaccctccatctccacccccatctccatctccatctccatctccatccccttcgtcgcgtctgctccaaccgctccctccttgatttgatcacgggccgattggggccgattagagtttacgagagtgagggggaggtagggttccgctcccgcgggagatggcgcaggcggtggaggagtggtatcggcagatgcccatcatcacgcgctcctacctcaccgccgccgtcgtcaccaccgtcggctgcaccctcgatatcatctcgccctaccacctctacctcaacccgaagctcgtggtgcagcagtacgagatctggcgcctcgtcaccaacttcctctacttccgcaagatggatttggattttctgttccacatgttttttcttgcacggtactgcaagcttctcgaggagaactcatttagagggagaactgcggactttttctacatgctcttatttggtgctactgtcctaactggcattgttctaattggagggatgataccttatgtttctgagacatttgccagaattctgttcttgagcaattcactgacgttcatgatggtttatgtctggagcaagcacaaccccttcatccacatgagctttctgggcttgttcacctttactgctgcctacttaccttgggtccttttgggcttctctatccttgttggaagcagcacatgggtggatctcttgggtatgattgctggacatgtgtactactttctggaagatgtgtacccgcggatgactggtcgtcgacccttgaagactccttcgttcatcaaggctctgtttgctgatgacaatgttgttgtggcacaggcgcccaatgctggggttggtgcgggtgcaaggtttggcggtatgggtccagctccccaggtccaatgatgacctgaggctgtgacagatgtgagaggcggcaatttgtttatctgctcaagttgcgagattgtacaagctaatgttcttgtgtatttatacaggctagatgagagttattgtgcataacaaaagatttgtagtatctgaggcagctgagtttctcaccccttggcaacgccgaccgaaatgattgtgattgccagacaggccacctcatgtttctggaacttgttcttgcaatggctaacatcatctgacctgttaggctggtactcaccgtgttcggctggtgcaccagcctccagccctatagtatttctctctcatgtcgctccagtactagcctccagtcaacagtgtttttctctcacatcactccagctctagtctccagcagtgtagtctaagaagctctttcaaccagagttaagtgcgctactttggccgtgagaatttcatcgagcgttgtaattgcagaatggtgcaaaaattagctct

SEQ ID NO: 36131 - protein, 249 aa, Panicum virgatum
  misc_feature: Ceres CLONE 1965242
  misc_feature (12)..(212): Pfam Name: DER1 Pfam Description: Der1-like family
MAQAVEEWYRQMPIITRSYLTAAVVTTVGCTLDIISPYHLYLNPKLVVQQYEIWRLVTNFLYFRKMDLDFLFHMFFLARYCKLLEENSFRGRTADFFYMLLFGATVLTGIVLIGGMIPYVSETFARILFLSNSLTFMMVYVWSKHNPFIHMSFLGLFTFTAAYLPWVLLGFSILVGSSTWVDLLGMIAGHVYYFLEDVYPRMTGRRPLKTPSFIKALFADDNVVVAQAPNAGVGAGARFGGMGPAPQVQ

SEQ ID NO: 36132 - DNA, 536 bp, Panicum virgatum
  misc_feature: Ceres CLONE 1965251
  misc_feature: Encodes the peptide sequence at SEQ ID NO. 36133
aagatccaagctcatctccgatccatggcggcctccatcctctgcgcggcggcccttgtcgccatggctgcggtggctgccggcgccgtcgtcgagcacacctttgttgtgagcgaggtgaagatggcgcacctgtgcagcgagacgctggtcaccgtggccaacggccagctcccggggccggcggtcgaggtcaccgagggagacgccgtcgccgtccatgtcgtcaacaagtcgccccacaacatcaccatccattggcacggactgaagcagcggctcaactgctgggcggacggggtgccgtcggtgacgcagtgccccatccggccgggccgcagcttcacctaccacctcaacgtcagcgggcaggaaggcaccctgtggtggcacgctcacgtctcctgcctccgggcgagcctgcacggcgccttggtcatccggccgcggcacgcctacccgttccccaagcctgacaaggagatccccatcgttataggtgagtggtggaaacctgacctcgcgcagttggccaa

SEQ ID NO: 36133 - protein, 170 aa, Panicum virgatum
  misc_feature: Ceres CLONE 1965251
  misc_feature (28)..(144): Pfam Name: Cu-oxidase_3 Pfam Description: Multicopper oxidase
  misc_feature: SWISSPROT Homolog: EC 1.10.3.2 Laccase
  misc_feature: Functional homolog of the protein sequence given in SEQ ID NO 51212
  misc_feature: Useful for making plants with altered cell wall content and/or composition
  misc_feature: Functional homolog of the protein sequence given in SEQ ID NO 50535
  misc_feature: Useful for making plants with altered carbohydrate content
MAASILCAAALVAMAAVAAGAVVEHTFVVSEVKMAHLCSETLVTVANGQLPGPAVEVTEGDAVAVHVVNKSPHNITIHWHGLKQRLNCWADGVPSVTQCPIRPGRSFTYHLNVSGQEGTLWWHAHVSCLRASLHGALVIRPRHAYPFPKPDKEIPIVIGEWWKPDLAQLA

SEQ ID NO: 36134 - DNA, 658 bp, Panicum virgatum
  misc_feature: Ceres CLONE 1965255-R
  misc_feature: Encodes the peptide sequence at SEQ ID NO. 36135
agaggaccagatccgaagcgctcttgaaaaacattttggctcatgtgaagagattgttcggatttcaattccaaaggattatgaaactggtgcacccaaagggatggcatacatggacttcaaggatccggattccttgaataaagcatatgagctgaacggaaatgaacttgatggctacagcttgtatgttgatgaggcgaagcctaggcctgataacaacagagatggtggcttcagtggtggaaggcgtggaagtttcagtggtggaagaggagggagaagtgacaggggccaaggtggtggccgcggacgtgacggaggacgggggggacgtggatttggaggaaggggtggaaggggtgacagaggccgtgggggccggggcacaccatacaagcagagtgctggtacagctagtacaggaaagaagaagacattcgatgatgacgagtgaagcattggcaaacgactatagtgaaatgcgagcacctactatctttaccctaaaacttctgttatgtgctctcgtatatggtgctgctctgcttgctttgcaattttgacatttttttaacctcttttcacaccgtagttattgaagtatctcgtggatctcattgacgtgacatgtttaatgcatttttatgatgaggat

SEQ ID NO: 36135 - protein, 151 aa, Panicum virgatum
  misc_feature: Ceres CLONE 1965255-R
  misc_feature (1)..(64): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
EDQIRSALEKHFGSCEEIVRISIPKDYETGAPKGMAYMDFKDPDSLNKAYELNGNELDGYSLYVDEAKPRPDNNRDGGFSGGRRGSFSGGRGGRSDRGQGGGRGRDGGRGGRGFGGRGGRGDRGRGGRGTPYKQSAGTASTGKKKTFDDDE

SEQ ID NO: 36136 - DNA, 1265 bp, Panicum virgatum
  misc_feature: Ceres CLONE 1965255
ctaaaccctccggtccgctacccggcctgaaccctagccttgcccccgcgccgccgccagacctccccgccgcttctccttccacctcttctcgggccgccttccgtatctcctgcgctcgagcttagttgggccattatgggcaagtcgagcaagaaatccggtgttgaggtggcacctgctgctgtctcggtcccagagggcaagtctgcaaagaaggggaagagaaatgcggaagttgagattgagaaggcagtcagtgcgaagaagcaaaagactgtacctgtaaaggttgagccagtgaagaagcagccccctcccaagaaagttgagagcagtagctctgaggaagaatcttcagattctgaagaggaggttaaggtycagccaaagaaggttactcaaccgaagaaaggcatgcaacctgctaaagaggagagcagtgatgatagcagtgatgagagctcctcagatgatgaaccttccaaaaaaccagttgcttcaaataaacctccagctgttgctggcagcagcagcagcgatgagaccagcgatagtggtgatgatagcagttctaatgacgaacctgcaaagaaacccactacccttacaaagaagcctgctgcagtggttagtaatggttccaaaaatcttatgtctgacagcagcagctcagacagtagctcggacgatgaatctgatgaggatgataagcctgctgctcagctaaagaagccttcagttgcctctgtgcaacagaagacccaagagtctgatagctctgacagcgattcggatgatgattcagatgaggatttgcctgttaaagctccggtagcagccaagaaaaaggaggagtccgaggatgaggataacaatgctaagcctgcaaaggctgctgctcctaagaagaaagaggaatctagtgatagctcagaatctgactctgagtcagattctgattctgatgaacctgaaaagcctactgttgctgcaaaaaggcctctagcaacagataagaagagcagacaatccattgacgaatctgatgagagttctgaagaaagtgatgaggagcctcctcaaaaggagccaaagcctgccactaaggtttcaaagaaagaaagcagcagtgatgaggatagtgaagaggaaagtgacaagcaggctaaaactcccaacaaaaaattggcacagaacgaagccaaaactcctgccaaaagccaaagtcagtctgctggatcaaagacgatttttgtggggaa

SEQ ID NO: 36137 - DNA, 1171 bp, Panicum virgatum
  misc_feature: Ceres CLONE 1965258
  misc_feature: Encodes the peptide sequence at SEQ ID NO. 36138
cttgcaatctctccgctcctccgccttcaatccccaaccaaacccctcctctccactctcactccctcgcccgcgtcgcaatcattcgtggggcggtgctgcgctttaatcccgaatttctgtggcctccagctctccgctcggatttcgccaagattgagtaatcgcctccctcctctcctcccaatttctttctctttcctttccatctgggtcgcgtttgcttcttcccgatttgttgccgtcgccctcgtcgtctcccaccacttcgtctagtgtagaacgactcggtcctgtcctgtcctcctcgcttccatcgccattgccgctccccctctctgctcaagccgcctgctttcttggaccggtccgggggcttgccacggccgggcgtaaatgcccgtccgtgcagaggatcccagccttctccgctccaaatcccgtctttgtttcccccaattaagagcacgacaagattcttcaacgctccctgatccttgtagccaggcatgacaaaatcgtcctgactgctcttgcccaggcaggctccccggcggcggctcagctctgagggccgcccccactgctatgggcttcttgatctgcgcctgcctcctccagctcctgctcttggccaccgcttccggggtggcggcgcagtcgcagccgctgtcgccggccaggatcctcgacgcgacgctgcaggactacgcgttccgggccttcgtgcgcccgcgcaccggcattgtctacaacgccaccctccccgccaacctcaccggcattgcggtctccgcggtccgcctgcgcagcggcagcctccggcggaagggcttcgcggactacttcgagttcggcgtccccaccggcgtcgttgtgcagccgcacgtcgagcgggtggtgcttgtctaccacaacctcggcagctcgttggaccactactaccggctctccgggtacacctacctcgcgccggtgctggggctgctggcctacgatgcggccaacctctcagctgtgggtctgcaggagctcaacgttgtcgcgtcagggagtccgatttctgtcactttcagcaatgtcagggcggtgccgtcaggcagtgcgccgccgcggtgtgtggtgttcgatttgaatggcgcgccgcagttccgggacctggaggcaacca

SEQ ID NO: 36138 - protein, 194 aa, Panicum virgatum
  misc_feature: Ceres CLONE 1965258
  misc_feature: Functional homolog of the protein sequence given in SEQ ID NO 51513
  misc_feature: Useful for making plants with modulated nitrogen use efficiency
MGFLICACLLQLLLLATASGVAAQSQPLSPARILDATLQDYAFRAFVRPRTGIVYNATLPANLTGIAVSAVRLRSGSLRRKGFADYFEFGVPTGVVVQPHVERVVLVYHNLGSSLDHYYRLSGYTYLAPVLGLLAYDAANLSAVGLQELNVVASGSPISVTFSNVRAVPSGSAPPRCVVFDLNGAPQFRDLEAT

SEQ ID NO: 36139 - DNA, 484 bp, Panicum virgatum
  misc_feature: Ceres CLONE 1965258-R
  misc_feature: Encodes the peptide sequence at SEQ ID NO. 36140
ggtcaggtacaaaagggataagaagttagaggtgatggagcggaatgcggaggttggggagacgttacggatggcgcaggttgggcggacgcaggcacctgtggccttggggacacggacacaaccagtgattgaaaacgattatgctgcatagcattcttttgagatttttgcagagttctttctagtctagtaacagaaagatttgatggttatggctagcggcggggttgtccattggttggttgaggcagcaaattttccatatccacgagggtgatgctagctgctgattttagagctcaggttctgctccatgaggggtcagcacattcttttggtgggcttgttcagaaggttacattttgtactgcaagcaatgggctattgttcctgttcgtagttgccatgttcatatgcggagttcctttcatctccaagcaagcaatggagggggaatgtttgccatcccagaaggggaaat

SEQ ID NO: 36140 - protein, 50 aa, Panicum virgatum
  misc_feature: Ceres CLONE 1965258-R
  misc_feature: Functional homolog of the protein sequence given in SEQ ID NO 51513
  misc_feature: Useful for making plants with modulated nitrogen use efficiency
VRYKRDKKLEVMERNAEVGETLRMAQVGRTQAPVALGTRTQPVIENDYAA

SEQ ID NO: 36141 - DNA, 554 bp, Panicum virgatum
  misc_feature: Ceres CLONE 1965260
  misc_feature: Encodes the peptide sequence at SEQ ID NO. 36142
gtaaaatgaaccatgttgagaaggtaaggaataccatgatcaagagaagattgaagaagcaaataggttacagcttgattgagattgggggtattgcccatttgtttcgcatgggtgagaagtctcatccgcaaactcgagatatttaccaatatttggaggaactaatccataggattactgatgctggctatgtgcctgaaactgactcggtgctgcatgaattggaaaaagaggaaagggagtttgcactaagatatcacggtgaaaaactggctgtagcctttggactcatgatgagcgctgggagcacagctccaatcaggataataaaaaacctgcggatatgcggggattgccatctagctatcaaatatatgtcagttgtggagaatcgagagataattgtcagagataagcatcggtttcatcatttcaaagatggaaagtgttcttgtcaggaatattggtgacaaggcctcctgttgataagccaggattttttttagagttttaggagccacagcccctgtcttaactattgaagcaaagac

SEQ ID NO: 36142 - protein, 156 aa, Panicum virgatum
  misc_feature: Ceres CLONE 1965260
  misc_feature: Functional homolog of the protein sequence given in SEQ ID NO 51514
  misc_feature: Useful for making plants with altered cell wall content and/or composition
KMNHVEKVRNTMIKRRLKKQIGYSLIEIGGIAHLFRMGEKSHPQTRDIYQYLEELIHRITDAGYVPETDSVLHELEKEEREFALRYHGEKLAVAFGLMMSAGSTAPIRIIKNLRICGDCHLAIKYMSVVENREIIVRDKHRFHHFKDGKCSCQEYW

SEQ ID NO: 36143 - DNA, 629 bp, Panicum virgatum
  misc_feature: Ceres CLONE 1965273
  misc_feature: Encodes the peptide sequence at SEQ ID NO. 36144
caaatttggtaccctggaggattatttctcgacactgagagatgaagctgagaagataaactatactcgtcctggtgaattgggttctgctgagctgcaaggttttccaacgctttcaggggatttctttacatatgctgatcgaaatcaggattactggagtggttactatgtatcaagaccattcttcaaagctgtcgaccgtgtactagaacagacactacgagcctcagaaattcttggttcatttgttctaggatactgtcagaagtttcaatgttcaaaactccccatcagcttttctcacaaactgactgcagcaaggaggaacttggcactttttcagcatcatgatggggtaactggcacggctaaggatcatgttgttgtggattatgggacacgaatgcatacttctttgcaagacctacagctatttatgtcaagggcagtcgaagtgcttttaggagatgtccatgatagatctgatcctacgttgttatcacattttgagccggtgcaggaacggtcaaagtatgacgttcaacctgtgcataagattcttgagccccgtgaaggaaaggtgcagtcggtagtctttttttacccgttagaacaaacaagagacg

SEQ ID NO: 36144 - protein, 209 aa, Panicum virgatum
  misc_feature: Ceres CLONE 1965273
  misc_feature (51)..(136): Pfam Name: Alpha-mann_mid Pfam Description: Alpha mannosidase, middle domain
  misc_feature: SWISSPROT Homolog: EC 3.2.1.114 Mannosyl-oligosaccharide 1,3-1,6-alpha-mannosidase
KFGTLEDYFSTLRDEAEKINYTRPGELGSAELQGFPTLSGDFFTYADRNQDYWSGYYVSRPFFKAVDRVLEQTLRASEILGSFVLGYCQKFQCSKLPISFSHKLTAARRNLALFQHHDGVTGTAKDHVVVDYGTRMHTSLQDLQLFMSRAVEVLLGDVHDRSDPTLLSHFEPVQERSKYDVQPVHKILEPREGKVQSVVFFYPLEQTRD

SEQ ID NO: 36145 - DNA, 374 bp, Panicum virgatum
  misc_feature: Ceres CLONE 1965274
  misc_feature: Encodes the peptide sequence at SEQ ID NO. 36146
aacaccatctacggcgccgcgacgggcggcgccgacgtctggatcaacgagcgccgcttccgcgtcatccgccagatcggggagggcggcctcgccttcgtctacctcgtcaaggagcagcagcccgcctccgacgccgcgcccgccaagcgccacgacgcccatgtctcagaggatggaacgtatgccatgaagaaggtgctcatacagagcaaggagcagctggatctggtgaaggaggagatccgcgtgtcgtcattgttcaatcaccccaacctgttcccgcttcttgatcatgccataataaccgtcaaggtaatctattttgccttattttttttctttgcatgtgcatagcgatgctataagaaact

SEQ ID NO: 36146 - protein, 118 aa, Panicum virgatum
  misc_feature: Ceres CLONE 1965274
  misc_feature: SWISSPROT Homolog: EC 2.7.11.1 Non-specific serine/threonine protein kinase
NTIYGAATGGADVWINERRFRVIRQIGEGGLAFVYLVKEQQPASDAAPAKRHDAHVSEDGTYAMKKVLIQSKEQLDLVKEEIRVSSLFNHPNLFPLLDHAIITVKVIYFALFFFFACA

SEQ ID NO: 36147 - DNA, 507 bp, Panicum virgatum
  misc_feature: Ceres CLONE 1965280
  misc_feature: Encodes the peptide sequence at SEQ ID NO. 36148
gggtgctgcacaagtggaccaactacggccgcgggtggcgggagcgctggttctcgctccgcgacggcgtcctatcctactccaagattcgggccggcgcgggcgccggcgccgcggaggaggacggcgaggtcaggctgatcggctccagggtcggcggcgcgcgccacactgagaagcccaccggcgtcgtaagcctcaaggtgtcagcatttcgggagagtaagtctgacgataggagattctacatattttcccccacaaagacgcttcacttgaagacagattcaaaagatgaccgtgttgtctggattgaggccttgatcttggcaaggagtgtgtactctctcaggtcactcagcggaagagtaactttcgtgcagtgcgatgtttcgatttcaactacaaggcttcgagatcgaatgcatcaggagggtctgaacgagaatcttattcaggactgtgaacagattgtactttctgaattctcaagctaccggaagcaaa

SEQ ID NO: 36148 - protein, 168 aa, Panicum virgatum
  misc_feature: Ceres CLONE 1965280
  misc_feature (1)..(112): Pfam Name: PH Pfam Description: PH domain
VLHKWTNYGRGWRERWFSLRDGVLSYSKIRAGAGAGAAEEDGEVRLIGSRVGGARHTEKPTGVVSLKVSAFRESKSDDRRFYIFSPTKTLHLKTDSKDDRVVWIEALILARSVYSLRSLSGRVTFVQCDVSISTTRLRDRMHQEGLNENLIQDCEQIVLSEFSSYRKQ

SEQ ID NO: 36149 - DNA, 1310 bp, Panicum virgatum
  misc_feature: Ceres CLONE 1965289
  misc_feature: Encodes the peptide sequence at SEQ ID NO. 36150
atcccccctcacgcgcgcgtcacgcgcgggtttcctctcctccctagtcaccccgactcgctcatctctcttcccctcctctcccttggcgggcggcggcgcatctgtccgatcgccggcgaggcagcggcggcggacggcctccctctaccccgtgtaggaaagcaggcgccctgacctcccttctgcacgcatcggtggggaggcctgcgccctcctatctcgtccgaggggagccccgggccctcctgcacgcatcggagtggagcccagcgccaccgccgcgcgccctcgtctctagtcggctgcttctcgtccccgtttccttccttctcctcggctgccggatctcgggttcctttgcccaaggagtccatggggagtacttcagatgtacaaatgcaacattgccctgaagattctgagactacaattgagatcaaaatcaagaccttggattctcagacatacaacttgcgtgtgaataaatgtgtgccggttcctctgttgaaggaaaaaattgctactgtaacaggaatattgtctgaacagcaacgcttgatttgccgtgggagagtcttaaaggatgatgaactcttgtctgcttatcatgttgaagatggccatacattgcatcttgttgttagacaaccaggacagtcagctccatcaggaaatgcagcaactgaagctaaccaatcaaattctggccgtcgtcgtggtcccactatggcaagaagtgttgtacttgaggctgttaatgtggatcctgcgagcagtgaactcccagcttttgttgcccagattctccaaagcgtccttggaacaatcagcgcacaatcttcgggtgtaccagcatcttctgacaccagaccttcagagcctacacaatcttccatcccaaatactgtaagggttgaacttgaccaaaaccaacaggctcctctgcttttcccgtctgagccagcacatgggtcatcacaaccaaatgtcatccctgatgccttgacaactatgtcacagtacattgaatttatgagggactcatttaggagggaaggctttaatcatgatggacaagcagagggtaatgtggaaaacagaactgcaggaagtactagggttggtgatacacaaaatcaggaaagccagcctgaatcagcttctacacttgggcttcatactgcatcgttgctagctgaaactatgcagtctactaggcaaatcgttgttgaacaggctggtgcaatgctatctcaactctcagttcaattgggaggtcttcagaatgtaactgatcctgcaacacg

SEQ ID NO: 36150 - protein, 311 aa, Panicum virgatum
  misc_feature: Ceres CLONE 1965289
  misc_feature (25)..(93): Pfam Name: ubiquitin Pfam Description: Ubiquitin family
MGSTSDVQMQHCPEDSETTIEIKIKTLDSQTYNLRVNKCVPVPLLKEKIATVTGILSEQQRLICRGRVLKDDELLSAYHVEDGHTLHLVVRQPGQSAPSGNAATEANQSNSGRRRGPTMARSVVLEAVNVDPASSELPAFVAQILQSVLGTISAQSSGVPASSDTRPSEPTQSSIPNTVRVELDQNQQAPLLFPSEPAHGSSQPNVIPDALTTMSQYIEFMRDSFRREGFNHDGQAEGNVENRTAGSTRVGDTQNQESQPESASTLGLHTASLLAETMQSTRQIVVEQAGAMLSQLSVQLGGLQNVTDPAT

SEQ ID NO: 36151 - DNA, 507 bp, Panicum virgatum
  misc_feature: Ceres CLONE 1965289-R
gtagaaatcatgcaacaacacacgtgtctggagccagtgaggaggcgctacactttgctagcatggtcagacaaattatgccatttatctcccaagttgaaacacagaatcaaagtgccccactggacagtagcagcacacgttcacaggctgcatctgggagtgcaaacagagcaagggatggcccaagtgattctacgagttcccatcaacataaccacgaccaaattgatgagcctaattctaaaagacaaagaaccagcgactgattcaaatatgcttgtgagctgagaatcttgccagttcttgcctaccgcagcgagttgtcaaatcaggagtcggcaaatgtgaaagtactgagacaattggacctagtagtatataatcggcattgaggacactagacgaggcaactatgttatccttctgtgcatcttagaaactgttattttcgagtgcacaaccatacaccggcatcctatctccaatatgtagaagttccttatc

SEQ ID NO: 36152 - DNA, 533 bp, Panicum virgatum
  misc_feature: Ceres CLONE 1965301
  misc_feature: Encodes the peptide sequence at SEQ ID NO. 36153
tgcatagcccaggcccgaaggccgctctcgcctcgcctgaaaaccgaacccaaaattccccatcctctcctagggttcacgcgatctccttcccctgcctccccgccccgccgcgcctgcgatgtcgtcggagccgccgcccgcggattccccggaggcgcccgcctccgcatcccctccgaaggacgccgtggccagcgggggcggcgccgctgctggggtcctggagacgaacacgctctgggtgggcaacctgcccgcccatgtgagcgagggcgacctgatggcgctgttcgcgccgcacggcgcgctcgattgcgccctcgcccgagccggctcccgcagctacgcgttcatcctcttccgcacccccgccgaggctcgcgcggccgtcgaggccacccggggcgaaaaggtcaagggcgccgccatgcgcaccgagttcgcgcggccggccagagctgttaggaatctgtgggttggtggcattagcccgtcggtttcaaggaggagctagaggaggagtttccaaa

SEQ ID NO: 36153 - protein, 131 aa, Panicum virgatum
  misc_feature: Ceres CLONE 1965301
  misc_feature (40)..(106): Pfam Name: RRM_1 Pfam Description: RNA recognition motif. (a.k.a. RRM, RBD, or RNP domain)
MSSEPPPADSPEAPASASPPKDAVASGGGAAAGVLETNTLWVGNLPAHVSEGDLMALFAPHGALDCALARAGSRSYAFILFRTPAEARAAVEATRGEKVKGAAMRTEFARPARAVRNLWVGGISPSVSRRS

SEQ ID NO: 36154 - DNA, 1210 bp, Panicum virgatum
  misc_feature: Ceres CLONE 1965303
  misc_feature: Encodes the peptide sequence at SEQ ID NO. 36155
acattcaagactgccctcgctagtcccccccttccagcgctcgaactcgaaccccccatccatttcctctcttgctcccggcctcggcgagctcgtcgctcctgtgggagggaggggagggatggactggttggagaagagcctgcgggaggacttcgatctcccgcccaagaacccttctgaggaagcgcagcggcgatggcgctccgccgtcggcgccctcgtcaagaaccgccgccgccgcttccgcatggtggccgacctcgacagccgcagccagaacgaagcccgccggcgatccatccagcaaaaaatctggcttgccctctatgtgcagaaggctgcgatcaccttcattgatggtgccaaacataaagagtaccatctgaccgatgatattatcaaagctggattttccatcaatccagaagaactggcatcgataacaatcaagcatgatcataaagcattggggatgcatggcgggatagatgggatatccaaaaagatccgctcaacatttgaccgtggtgtatctgctagtgacttggatacaagacaaagcatctatggtgtcaatcgctatgcagagaaaccgtcaagaagtttctggatgtttgtctgggatgcattgcaggacatgactcttatcattcttatggtatgtgctttgatatctgctgtagttggtctggcatctgaaggttttcccaagggcatgtatgatggcttgggcataatactcagcattttgttggttgtgatggttactgctatcagtgactacaggcagtcacttcaattcaaagagctagacaatgaaaagaagaagatatttatccatgtaaccagagacggctctcgacaaaagatctctatatatgacttggtggttggtgatatcgttcatttatcaattggagaccaagtacctgctgatggactgtacattcatggatactctcttttgattgatgaatccagcttgtcaggtgagagtgacccagtttatatttctcaagataagccgttcatcttggcaggaaccaaagttcaggatggatcagctaagatgatggtaactgctgttggcatgcgcactgaatggggaagactgatgagcacgctgagtgaaggaggggaggatgagacgccattgcaggttaaactaaatggagttgcaaccatcattgggaagattggcctggtg

SEQ ID NO: 36155 - protein, 362 aa, Panicum virgatum
  misc_feature: Ceres CLONE 1965303
  misc_feature (112)..(191): Pfam Name: Cation_ATPase_N Pfam Description: Cation transporter/ATPase, N-terminus
  misc_feature (205)..(362): Pfam Name: E1-E2_ATPase Pfam Description: E1-E2 ATPase
  misc_feature: SWISSPROT Homolog: EC 3.6.3.8 Calcium-transporting ATPase
MDWLEKSLREDFDLPPKNPSEEAQRRWRSAVGALVKNRRRRFRMVADLDSRSQNEARRRSIQQKIWLALYVQKAAITFIDGAKHKEYHLTDDIIKAGFSINPEELASITIKHDHKALGMHGGIDGISKKIRSTFDRGVSASDLDTRQSIYGVNRYAEKPSRSFWMFVWDALQDMTLIILMVCALISAVVGLASEGFPKGMYDGLGIILSILLVVMVTAISDYRQSLQFKELDNEKKKIFIHVTRDGSRQKISIYDLVVGDIVHLSIGDQVPADGLYIHGYSLLIDESSLSGESDPVYISQDKPFILAGTKVQDGSAKMMVTAVGMRTEWGRLMSTLSEGGEDETPLQVKLNGVATIIGKIGL

SEQ ID NO: 36156 - DNA, 505 bp, Panicum virgatum
  misc_feature: Ceres CLONE 1965303-R
  misc_feature: Encodes the peptide sequence at SEQ ID NO. 36157
taaacagtagggaaatgcagaagattaatgttttccgtggtatgatcagcaattggatctttattggaatcatagccgtgacagtcatatttcaagtggtgatcatagaatttctgggcatttttgccagcactgttccacttagttggcagctttggttggtgagcgttggccttggatccatcagcttgatcgtgggcgccatcttgaagtgcataccagttaaatcagatgaaaatccttcaggtccaaatggctatgtgccgctaccgagtggtccggataacatatagccgaagaagagcgattggcaacggcaaggcattgcatttggtagaatttgcagtttcctgagaaccccaaaggcaccacggctacattatactttgagttatgtttgggacaattaataaaccactgtctaggttcagttataacaaattgttctttaccttgtcatgcaatgcaacgcattatatttggcatgggtcatggaaacaatgtt

SEQ ID NO: 36157 - protein, 96 aa, Panicum virgatum
  misc_feature: Ceres CLONE 1965303-R
  misc_feature: SWISSPROT Homolog: EC 3.6.3.8 Calcium-transporting ATPase
NSREMQKINVFRGMISNWIFIGIIAVTVIFQVVIIEFLGIFASTVPLSWQLWLVSVGLGSISLIVGAILKCIPVKSDENPSGPNGYVPLPSGPDNI

SEQ ID NO: 36158 - DNA, 1150 bp, Panicum virgatum
  misc_feature: Ceres CLONE 1965310
  misc_feature: Encodes the peptide sequence at SEQ ID NO. 36159
attttgccaagaataggaaggactttccgatggatcgaggcgcgatggaagaggaagatgagggacacggagagggagaggatcgagtgagggacctcagctcaaccgaccatcatccatgtggattggtagcaagaccggccgagagggaagagcggaggagacgcacttgttgggggccgggggaatcctagcctagcctagcctaggataggacggagattttttttttctgatcgatcgatctcgccccctctcctgccgcagcatctgaatctatcgccggccactcgcgtcctgtgcgatccatgacgcgctgacgatcgacaacctgcagctgttcgatccttcagggaacaagaacggcggcggcacatacattgttgccagggcacaaattgtcctgaggttcttcggaacccagagatttagatcaggcacacaatgtcagcttctgagttcaggattccgtaccagcaggtttcttcttcacagcctgctgagactgcaaatcagttcaagacctgccgttgtggggagggagacacatctgaaactggtgacagcccgccaacttcttgtcctagttgccaggtccttaagagtgggcatttactactttcatcaaaaggaattggatggacatcatggaaaaagcgctggtttgttcttacaagggcatcgttagtgttcttcagaagcgaccctaatgtgccccctccaagaggagctgaaccaattgtcacacttggtggaatcgacttgaatagctccggaagtgttgtcgtcaaagaagaaaggaaacttctgacagtattatttcctgatggccgtgatggacggactttcactctgaaggccgaaaccatagaagaccttaatgagtggagaagtgcattggaaaatgctctagcgcaagcaccaagtgtagcaaatacaacagggcaaaatccaatattcagcactgatgtagcggcagaacctgctgaagctccagctgaacagtcggaggacagttctgttattggcagacctgcagaatttgcacttgtcgatgcagatggcagcccgtcatttctggaaaaggccctgaagttcattgaagatcatggtaattatttctgcttattgaattcagtacacaatcttg

SEQ ID NO: 36159 - protein, 235 aa, Panicum virgatum
  misc_feature: Ceres CLONE 1965310
  misc_feature (51)..(157): Pfam Name: PH Pfam Description: PH domain
  misc_feature: SWISSPROT Homolog: EC 2.7.11.1 Non-specific serine/threonine protein kinase
MSASEFRIPYQQVSSSQPAETANQFKTCRCGEGDTSETGDSPPTSCPSCQVLKSGHLLLSSKGIGWTSWKKRWFVLTRASLVFFRSDPNVPPPRGAEPIVTLGGIDLNSSGSVVVKEERKLLTVLFPDGRDGRTFTLKAETIEDLNEWRSALENALAQAPSVANTTGQNPIFSTDVAAEPAEAPAEQSEDSSVIGRPAEFALVDADGSPSFLEKALKFIEDHGNYFCLLNSVHNL

SEQ ID NO: 36160 - DNA, 657 bp, Panicum virgatum
  misc_feature: Ceres CLONE 1965323-R
  misc_feature: Encodes the peptide sequence at SEQ ID NO. 36161
cgttcccgaactgcctgacctacaagacctccgaagacttcgtggccagggtgaaggaggccatgactcgcgacccgcagcccctgacccccgagcagcggtacaacctgtcgtgggaggctgccacccagcggttcatggagcactcggagctcgacaatgtcctgaacggcagtaacgactgcagcagcagcggtaccgaactcgacgggagcgcgggcaggaggacgaggcggtccgtctgggcgcccagcatctcggacgtggtcgacggcgggctggcgttcgcgcactactgcctgacgggcagcgagcttctgagactgtccaccggagccgtccccggaacccgggactacaacaagcagcacagcgcggacctccgcctcctgccgccccaggtgcagaaccccatatacggatggtaatcagggcatgttggcaccgtcgatcagtagctgtacacacacatgtagagcctcgcagtctgtaacactagtgttcgttttcgccgcctcgtggctgtttgcctctgctgccaaaggcaacgccttgttcattcattgttacgaaccaccatatatatgctgcctgcttgtgtatgtaacactagctctctagataaagaggccagcaaggctcccttttttgtggctc

SEQ ID NO: 36161 - protein, 141 aa, Panicum virgatum
  misc_feature: Ceres CLONE 1965323-R
  misc_feature: SWISSPROT Homolog: EC 2.4.1.241 Digalactosyldiacylglycerol synthase
FPNCLTYKTSEDFVARVKEAMTRDPQPLTPEQRYNLSWEAATQRFMEHSELDNVLNGSNDCSSSGTELDGSAGRRTRRSVWAPSISDVVDGGLAFAHYCLTGSELLRLSTGAVPGTRDYNKQHSADLRLLPPQVQNPIYGW

SEQ ID NO: 36162 - DNA, 490 bp, Panicum virgatum
  misc_feature: Ceres CLONE 1965323
accgcctccaccaccaccaccaccaccgcagcctctcgccgcggcgcgcggaaaccctagctccacccgccgccgcccccctcgctctcctccggtgatccatggcaagcttcggcgtcgacacccggccggccgccgcggcctcgggcggcgggggaggcggggcggggaccggggagggcgcgctgtccttcctctcccgcggcctgcgggaggacctccgcctcatccgcgcgcgggccggggagctcgagacgttcctcaacgcgccggtcgcggagcccgagctgctcgcgcgcctccgccgcgcctactcctcctcggcctcctccgcgcggacgcggctggacctgtccgcgatcgggaaggcgttcgaggccgagtcgtggaggggtgccagggggcaggccgggtggaggtgcgaggaggaggccgaggagtgggagcccgtgcggctggtcaaggcgcgcctcagggagctcgagcggaa

SEQ ID NO: 36163 - DNA, 1286 bp, Panicum virgatum
  misc_feature: Ceres CLONE 1965324
  misc_feature: Encodes the peptide sequence at SEQ ID NO. 36164
accaacccgccctttctcactctccctcgcccggccgtcacagcccccttctctctgtttcagtgtttcccctcccctcccctccctacgagatctacaactctagggtttgcccgctcggccttcgtccttcttgggccgagccctaatcctgccgcaccgcagtccgccaccaataatccgagttggtggatcgcctcgcctccgcgctgcgcctgcctgctcgctcctccgcgcattcttgggttccatcgacaccaaacaaaatctagcatacctacttgctgctcgacctagctagtccggactccagatctcagccaccagcccaccacctaccacatcctatttcacggttcagctgctagcctatcggcatggctgaggagactgccaatgatgcccaggtggcccaagaaaacgcagttgctcccaatgatgaggcggtccaaacagatgaattggtccaaggtgaagatatggctcaggctgatgagttgatacaaggtgaagaaatcaatcaaggtgatgagttggtccacggtgatgatttcgtgcaaggaaatgagttggtcgttgctgaggaaacgacccctcgtaccggaaccagacggaggagaaagaagtccttggtatgggagcacttcactatcgaagaagtcgctggaggggtcacacgggcatgctgcaacctctgcaagcaaacctttgcttacagctcgggctcaaagattgctgggactagccatctcaagaggcacatcaccttgggttcttgtcctaagataaagaatcaagagcagaggctggcactgccatcagcaggaggtactgacaatgatggtgagggaactgtggagcggcgaactaagagacgatacagatatactggttatgcaaatgctgcttttgatcaagaccgcagttgctcatacctggcgaagatgatcattcagcatgactacccgcttcacattgttcaacagcaggcgtttggaacttttattgagagcctgcagccacgtttcaagattgtggatgttgatacgatggagggagaggtgtatgctgtttatcagaaagagaaagagaacctgcttcaagcattcaacactatgcctggaaggatcagcctcaccataggattgtggacaacgagtcagactcttggctacgtttcacttgcagggcagtttatcgactcagagtggaaagtacaccgaagaatgcttagcttcatgatggtgtcatctcctcactcagagaatgcacttagtgaagcaatt

SEQ ID NO: 36164 - protein, 302 aa, Panicum virgatum
  misc_feature: Ceres CLONE 1965324
  misc_feature (84)..(135): Pfam Name: zf-BED Pfam Description: BED zinc finger
MAEETANDAQVAQENAVAPNDEAVQTDELVQGEDMAQADELIQGEEINQGDELVHGDDFVQGNELVVAEETTPRTGTRRRRKKSLVWEHFTIEEVAGGVTRACCNLCKQTFAYSSGSKIAGTSHLKRHITLGSCPKIKNQEQRLALPSAGGTDNDGEGTVERRTKRRYRYTGYANAAFDQDRSCSYLAKMIIQHDYPLHIVQQQAFGTFIESLQPRFKIVDVDTMEGEVYAVYQKEKENLLQAFNTMPGRISLTIGLWTTSQTLGYVSLAGQFIDSEWKVHRRMLSFMMVSSPHSENALSEA

SEQ ID NO: 36165 - DNA, 583 bp, Panicum virgatum
  misc_feature: Ceres CLONE 1965324-R
atattctctgcaggaacaggaagtcgcatgcttgatgactacagaagctctcttcgtcccgagattgtggaggcaattgtctgtgccaaagactggctccagtactcagcacctgccactgaggctccaagttctgcactggtcaaggctgaagggtcatagattcgatgtggccccttcttatcaaagtattaatctatgtgtgtatcttatctatgagtgtagttaactgtaggcgtattgtaggctgaaattgcgaactgtttgtgatttattctggtatttatcttgctgaggtgtaacttgtttgtgtcgagctctatttaatttgctgctgttgtaatgtgcccgttgtcagaattggaattaggcagtgaatgaaatttcaaagaaagagcagcttagtaccttggcttggctacaagttattagagaatggttctcgtatgtatcaggctgtaacaacaaacttaagttttgtaaatttataagtgcaggagagatgtacctgtgctcttgagcagtgtagtatgtatcggtttgattggattctttgttggaaaagatctgtagttgtgctgtg

SEQ ID NO: 36166 - DNA, 1316 bp, Panicum virgatum
  misc_feature: Ceres CLONE 1965343
  misc_feature: Encodes the peptide sequence at SEQ ID NO. 36167
actcctctagatcgccggcccctcgctcggctcggccatggggggcggctccgcgctgtccctcgccgtctgcctcgtcctctccgtcctcgcgcctgctgtctccggagatggtgccacgttggagtcagttccagaccttgtgaaggcaatgtacctaaacattgaaagtttcccttgtgtgaggctgctgaatctttctggtgaaattggctgttcaaatcctggaagcgaaaagatcattgcaccgattgtaagattaacaaaaggcagtgatcaattggttcaaccatccactgttcttcttccctcagatcagatgtcagatttctttctgagggtatccaatgatccagaatttcaccagaaggtgtctggtgtactgatcgagtctaatggtgcaaacaataacttacaagagttgtcgccggatggaaaatttccacaagatgcttttgcaccttactcaaatcgcagccacaattggaatcctgctggatcaggtattatgtggaacagatatgactttcctgtatttctactctcagaggagagcacacgggttctgcaaaaggtttctgaaaagaataagaagactgacaatggatataaagcaaatgttgcagaattcgaccttgttatgcagacaactaaagctcaaacacatgattcagcatcctgcctcaaagagcgctcatgcctgcccttaggaggacacagtgtatgggcttcattaccgccaattaaaaatggatctacagaacatcagaaaccaatagtattggctatcacatcgcaagactctgcatcatttttccgggaccgcagtattggttcagattctcccatatctggattgattgccttgctcactgctgttgatgctctttctcacatccatgatctaagaaaccttaagaaacagcttgtgtttgctgtttttaatggtgaagcctggggttatcttggtagccggaaattcttacaggaattagataaaggtgctgattctgtgaatggaattaacagcttaatgattgaccaggtagtggagatcggttcagttggcaaggctgtaattgagaaatatccatcattttatgtgcatgctgcagggaattcatcagcttcaaacaaaatattagatgcactgcaaagtgccagcaagtcacttggttctgataatgttaaagtaaaacaagcagcttcatcaaatcccggtgttccaccatcatcattaatgtcgttcataagaaagaatatgtcaacctctggagttgtgttggaggactttgattcccacttttccaatagat

SEQ ID NO: 36167 - protein, 426 aa, Panicum virgatum
  misc_feature: Ceres CLONE 1965343
  misc_feature (246)..(426): Pfam Name: Nicastrin Pfam Description: Nicastrin
MGGGSALSLAVCLVLSVLAPAVSGDGATLESVPDLVKAMYLNIESFPCVRLLNLSGEIGCSNPGSEKIIAPIVRLTKGSDQLVQPSTVLLPSDQMSDFFLRVSNDPEFHQKVSGVLIESNGANNNLQELSPDGKFPQDAFAPYSNRSHNWNPAGSGIMWNRYDFPVFLLSEESTRVLQKVSEKNKKTDNGYKANVAEFDLVMQTTKAQTHDSASCLKERSCLPLGGHSVWASLPPIKNGSTEHQKPIVLAITSQDSASFFRDRSIGSDSPISGLIALLTAVDALSHIHDLRNLKKQLVFAVFNGEAWGYLGSRKFLQELDKGADSVNGINSLMIDQVVEIGSVGKAVIEKYPSFYVHAAGNSSASNKILDALQSASKSLGSDNVKVKQAASSNPGVPPSSLMSFIRKNMSTSGVVLEDFDSHFSNR

SEQ ID NO: 36168 - DNA, 695 bp, Panicum virgatum
  misc_feature: Ceres CLONE 1965343-R
cccaggtatgttccagcatattcaacacgggtgaagtttgaggacaatgcatggcatgtacttccagcaaactcgtcagatccaatgggcgtagtggatcctgtgtggactgaaagctactggaacacaatcggcctcagggtgtatgcagtgcaagattcaactttcgattggcttatccttcttgctggtctcagtatcactgccgcatcgtattgtgccgtgcatgtcggcagagcatacatttccaaggtcgtcaagcgcgactgaagcattattgacctgctccactgactctgggaacccccggtctatatgttctgggattttgagctggacagcagaactaattcagttggcgatttgtagaacattagcaacacatcagcacatgtgatagggtgattgaactgccgagaaagccacaaggaattatggaaccgtccagctgaggagctgcctatggaccttggatttgcataatgttcttcatcattgtgcatttgtgctgtggtgcccttgtcttgggccggcagctgtaatatgaaagggtgcccctgacacgcttggcactgaaactggttggtagattatcagacgcctctaggaggatgtttccaggaacgtgcgtctttctgggtttgtggatcattgggtgaatgaatgctacgtatctatccagtttatggttgcgt

SEQ ID NO: 36169 - DNA, 647 bp, Panicum virgatum
  misc_feature: Ceres CLONE 1965393-R
  misc_feature: Encodes the peptide sequence at SEQ ID NO. 36170
aggcccttcctggtgacaatgttggcttcaacgtgaagaatgttgctgtgaaggatctgaagcgtggctatgtggcctccaactccaaggatgaccctgccaaggaggctgccagcttcacctcacaagtcatcatcatgaaccaccctggccagatcggcaacggctatgccccagtgctggactgccacacctcccacattgctgtcaagtttgctgagctcattaccaagattgacaggcgatctggtaaggagcttgagaaggagcccaagttcctcaagaatggtgatgctggtatggtcaagatggttcccaccaagcccatggttgtggagaccttctctgagtaccctcctcttggtcgcttcgccgtccgtgacatgaggcaaacggttgctgttggagtcatcaagagcgtggagaagaaggaccctaccggcgccaaggtcaccaaggctgcagccaagaagaaatgatgtgtctggtggttgatagcgtacctagatgcgttattgtcgcttaagttttgttcatggtcattgctgttatctcgtgaactctcagctggcaatgtgtgccctcagtctgtgtgtcgttcgcatacggttttaatattttattcggcaaaacttaaattacctgcc

SEQ ID NO: 36170 - protein, 158 aa, Panicum virgatum
  misc_feature: Ceres CLONE 1965393-R
  misc_feature (33)..(141): Pfam Name: GTP_EFTU_D3 Pfam Description: Elongation factor Tu C-terminal domain
  misc_feature: The sequence is a functional homolog of SEQ ID NO 576 in the 10/666,642 US patent application
ALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 36171 - DNA, 1295 bp, Panicum virgatum
  misc_feature: Ceres CLONE 1965393
accgccaggcagcctctcccctcccgagccgccgtcacctgcgcctccgcctcatccccgcgccgccgaagctttgtcgccccctcgtgctagtagcgacctggctttgttttgttgatagtctcatatccgattccgctgggtctgtgggttttgcttgctcgctcgcttgcttagacgatttgattgatagtcacatatccgatttcgtagagtttgtgggttttgcttgctcgcttgctttcagggtttgattcttagtgatggattcgtctggatccggatagttacttagattctgtaggttgatctgttaattgtccttgtggatcgaattcgaatgtttagaggctagagctgttgtaattagttcgaatgtgtggctgctacttttcatctacatagtaatagttttgtctgatctagtttccgatctgatttttgaaactgtattgttagtgcctagtattttgattgtggagcaccgatagtgttcttctggcctcctctagtatgttcatagtctgtgtgtgttcttctggcctcctctagtatgttcatagtctgtgtctctacratagatcattacttgtgtctatgtctctacagtactttctggtacgccacttcatcaagtaattagtagttgttttgatgaatgatgatactgaccgtcgacttttattgtttgattactcgttctcccaatatatattgtttctaattgttgattcatctgtccactgtcatgcagcggttagtcttcacctgcagccatgggtaaggagaagtcccacatcaacatcgtggtcattggccacgtcgactctggcaagtcgactaccaccggccacctgatctacaagcttggaggtatcgacaagcgtgtgatcgagaggttcgagaaggaggctgcggagatgaacaagaggtccttcaagtacgcgtgggtgcttgacaagctcaaggccgagcgtgagagaggtatcaccattgatatcgccctgtggaagtttgagaccaccaagtactactgcaccgtcattgatgcccctggacaccgtgacttcatcaagaacatgatcacgggtacctcccaggctgactgtgctgtccttatcattgactccaccactggtggttttgaggctggtatctccaaggatggccagacccgtgagcatgctctccttgctttcactcttggagtcaagcagatgatctgctgctgcaacaagatggatgccaccacccccaagtactccaagatccgttatgatgagattgttaaggaa

SEQ ID NO: 36172 - DNA, 461 bp, Panicum virgatum
  misc_feature: Ceres CLONE 1965402
  misc_feature: Encodes the peptide sequence at SEQ ID NO. 36173
acgccaacgcagaccgacaccacagtgcaagcgcaccccccaaatccgcctgccgcgccagtgctcggtgctccttcctccccccttctccctgaccagagcagagctctcgtcccctgcggcggcattcctcctctgccaaccaagcaggcaatggggtgcaaggcgtgccagaagcccaaggcgcagtaccgcaagggcctgtggtcgccggaggaggacgagaagctccgcgacttcatcctccgccacggccacggctgctggagcgcgctccccgccaaggccgggctgcagcgcaacggcaagagctgcaggctgcggtggatcaactacctgaggccggggctgaagcacggcatgttctccccggaggaggaggagaccgtcatgagcctccacgctaagatgggcaacaagtaagcacccgcgcagacttctctcagtttccaactctcctt

SEQ ID NO: 36173 - protein, 89 aa, Panicum virgatum
  misc_feature: Ceres CLONE 1965402
  misc_feature (15)..(62): Pfam Name: Myb_DNA-binding Pfam Description: Myb-like DNA-binding domain
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: Functional homolog of the protein sequence given in SEQ ID NO 51515
  misc_feature: Useful for biocontainment applications
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 1917 in the 10/374,780 US patent application
  misc_feature: Functional homolog of the protein sequence given in SEQ ID NO 50236
  misc_feature: Useful for making plants with modulated biomass
  misc_feature: Functional homolog of the protein sequence given in SEQ ID NO 50609
  misc_feature: Useful for making plants with altered lignin content
  misc_feature: Functional homolog of the protein sequence given in SEQ ID NO 50610
  misc_feature: Useful for making plants with altered cell wall content and/or composition
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: Functional homolog of the protein sequence given in SEQ ID NO 50831
  misc_feature: Useful for making plants with modulated nitrogen use efficiency
  misc_feature: The sequence is a functional homolog of SEQ ID NO 296 in the 11/479,226 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: Functional homolog of the protein sequence given in SEQ ID NO 50232
  misc_feature: Useful for making plants with altered alkaloid content
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1073 in the 10/374,780 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 1004 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 1002 in the 11/435,388 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 442 in the 10/412,699 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: Functional homolog of the protein sequence given in SEQ ID NO 50479
  misc_feature: Useful for making plants with altered terpenoid content
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1010 in the 11/435,388 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 569 in the 10/374,780 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 36 in US patent 7193132
  misc_feature: The sequence is a functional homolog of SEQ ID NO 1863 in the 10/374,780 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: Functional homolog of the protein sequence given in SEQ ID NO 50480
  misc_feature: Useful for making plants with modulated low light sensitivity
  misc_feature: The sequence is a functional homolog of SEQ ID NO 58 in the 10/666,642 US patent application
  misc_feature: The sequence is a functional homolog of SEQ ID NO 822 in the 10/412,699 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 836 in the 10/412,699 US patent application
  misc_feature: The sequence is a functional homolog of SEQ ID NO 446 in the 10/412,699 US patent application
  misc_feature: The sequence is a functional homolog of SEQ ID NO 126 in the 10/412,699 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 271 in the 11/479,226 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 824 in the 10/412,699 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: The sequence is a functional homolog of SEQ ID NO 790 in the 11/435,388 US patent application
  misc_feature: The sequence is a functional homolog of SEQ ID NO 186 in the 10/412,699 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 1566 in the 10/374,780 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: Functional homolog of the protein sequence given in SEQ ID NO 50785
  misc_feature: Useful for making plants with modulated flowering time
  misc_feature: The sequence is a functional homolog of SEQ ID NO 1692 in the 11/479,226 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 2898 in the 10/374,780 US patent application
  misc_feature: The sequence is a functional homolog of SEQ ID NO 494 in the 10/225,066 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
  misc_feature: The sequence is a functional homolog of SEQ ID NO 128 in the 11/375,241 US patent application
  misc_feature: The sequence is a functional homolog of SEQ ID NO 166 in the 10/412,699 US patent application
  misc_feature: The sequence is a functional homolog of SEQ ID NO 2272 in the 10/374,780 US patent application
  misc_feature: The sequence is a functional homolog of SEQ ID NO 373 in the 11/479,226 US patent application
  misc_feature: The sequence is a functional homolog of SEQ ID NO 914 in the 11/435,388 US patent application
  misc_feature: The sequence is a functional homolog of SEQ ID NO 118 in the 10/412,699 US patent application
  misc_feature: The sequence is a functional homolog of SEQ ID NO 188 in the 10/225,068 US patent application
  misc_feature: The sequence is a functional homolog of SEQ ID NO 2256 in the 10/374,780 US patent application
  misc_feature: The sequence is a functional homolog of SEQ ID NO 284 in the 11/479,226 US patent application
  misc_feature: The sequence is a functional homolog of SEQ ID NO 772 in the 10/225,066 US patent application
  misc_feature: The sequence is a functional homolog of SEQ ID NO 910 in the 11/435,388 US patent application
  misc_feature: The sequence is a functional homolog of SEQ ID NO 1054 in the 10/225,066 US patent application
  misc_feature: The sequence is a functional homolog of SEQ ID NO 144 in the 10/412,699 US patent application
  misc_feature: The sequence is a functional homolog of SEQ ID NO 2264 in the 10/374,780 US patent application
  misc_feature: The sequence is a functional homolog of SEQ ID NO 912 in the 11/435,388 US patent application
MGCKACQKPKAQYRKGLWSPEEDEKLRDFILRHGHGCWSALPAKAGLQRNGKSCRLRWINYLRPGLKHGMFSPEEEETVMSLHAKMGNK

SEQ ID NO: 36174 - DNA, 1110 bp, Panicum virgatum
  misc_feature: Ceres CLONE 1965417
  misc_feature: Encodes the peptide sequence at SEQ ID NO. 36175
aaattcccacgagaacccaaaccaaacggccgcacccctgcgctgcgcaggtcgcacccgccgcagcaatgtcctccccctcctcctccgacggcgagcgcccgccgtctccggtggaggcgcgccgcgtcgtcgtcacccaccgcctccccctccgcgccgagcccaaccccgacgcgccgcacggcttcgatttctccctcgacaccgacgcgctcccgctccagctctcccgcggcctcccgcgccccgtggtcttcgtcggcgcgctcccctccgccgccgcgtcggtcccggcgtccgaggagctcgcggacgatctcctctagcgcttctcctgcagcccggtgttcctgggtgccggcctccacaagaacttctacgacggattctgcaagcactacctgtggccgatgctccactacctcctcccgctcgggcccttcagcggcggcggcggcggcggcggcggcagcctcaacaacttcaaggcggagctctaccgcgcctacctcaccgccaacacgcagtacgccgaccgcgtctacgagctcctcaaccccaacgaggatctcgtcttcatccacgactaccatctctgggcgctccccaccatcctccgccgcaagtcgccgcgagcccggataggcttcttcctccactcgcccttcccctcctcggaggtcttccgcgccatccccgcccgcgaggacctcctccgcgccctcctcaacgccgacctcgtgggcttccacacctacgattacgcccgccacttcctctccgcctgctgcaggctgctcggcgtcaacagccacacccgccacggcaacatcagcatcgactacttcgggcgcgtggttgtcgtgaagatcctctccgttggcgtcgacatgagccagctccgcagggtgttgtcgtcgccggagacagccgcaaaggccaaggagatcgccgcgaagttcgcgggccgtaaggtgttgctcggcgtggacgatattgatctgttcaaggggattgacctcaagctctcggccatggagaaactgctggagtcgcagaaagggctgcgcggccggggtggtgctcgtgcagatcaacaacccggcg

SEQ ID NO: 36175 - protein, 232 aa, Panicum virgatum
  misc_feature: Ceres CLONE 1965417
  misc_feature (1)..(232): Pfam Name: Glyco_transf_20 Pfam Description: Glycosyltransferase family 20
  misc_feature: SWISSPROT Homolog: EC 2.4.1.15 Alpha,alpha-trehalose-phosphate synthase (UDP-forming)
  misc_feature: Functional homolog of the protein sequence given in SEQ ID NO 50801
  misc_feature: Useful for making plants with altered carbohydrate content
MLHYLLPLGPFSGGGGGGGGSLNNFKAELYRAYLTANTQYADRVYELLNPNEDLVFIHDYHLWALPTILRRKSPRARIGFFLHSPFPSSEVFRAIPAREDLLRALLNADLVGFHTYDYARHFLSACCRLLGVNSHTRHGNISIDYFGRVVVVKILSVGVDMSQLRRVLSSPETAAKAKEIAAKFAGRKVLLGVDDIDLFKGIDLKLSAMEKLLESQKGLRGRGGARADQQPG

SEQ ID NO: 36176 - DNA, 606 bp, Panicum virgatum
  misc_feature: Ceres CLONE 1965417-R
  misc_feature: Encodes the peptide sequence at SEQ ID NO. 36177
gagcccgtgtgttgaaaagcggccataagattgtggaggttaatcctcaggatgtgagcaaaggaatcgcagtgcggaatctgattgcaaccatgggcgctcgcggaagcttgccagatttcatcctatgtgtcggcgacgacaggtctgacgaagacatgtttgcggcaatcaccaagccctcgagcaactttgcgttccaggagtctgctgagatctttgcttgcacactcggcaacaagccaagcctggccaagtactacctggaagactcggacgatgtcctgaagatgctaaagggcctgatggactcgtcgcgtcccggaggagcgttgcaaactcaggtgttcgaggaccccttcgagtgagccaagagttgcccggttctcgttagagcaattttgttcgtgattccattttgtaaccaggggggaggaaatggttggggcagaggcaaaatccagtagactaacaagtgaccaatccatcggtcgttagcgtagatgacatcggctttcttggtcatgtttgcctggttatagtaggtttttttgtagaatcggcggaagttttcctatttttgctcctagagatcgcaaggaaagg

SEQ ID NO: 36177 - protein, 121 aa, Panicum virgatum
  misc_feature: Ceres CLONE 1965417-R
  misc_feature: SWISSPROT Homolog: EC 3.1.3.12 Trehalose-phosphatase
  misc_feature: Functional homolog of the protein sequence given in SEQ ID NO 50801
  misc_feature: Useful for making plants with altered carbohydrate content
ARVLKSGHKIVEVNPQDVSKGIAVRNLIATMGARGSLPDFILCVGDDRSDEDMFAAITKPSSNFAFQESAEIFACTLGNKPSLAKYYLEDSDDVLKMLKGLMDSSRPGGALQTQVFEDPFE

SEQ ID NO: 36178 - DNA, 381 bp, Panicum virgatum
  misc_feature: Ceres CLONE 1965499
  misc_feature: Encodes the peptide sequence at SEQ ID NO. 36179
aggcaggttaggtaggcagctcgggtcacgatggcgccgcgccgcgccgccctcttcgccgccgcgctcctcctggcctccgccgccgcggcggtctccgggttccacctcggcggggacgagagcgggctcgtgcggggcgtgctcgccgcgctccgcgagcgggccgaggccgaggacgccgcgcgcttcgccatcgcccaccacaacaggaaccagggtgctgctttggagtttacacgggtgctgaaatcgaagcggcaggtggtgaccgggacactgcatgacctggtattggaggctgctgatgctggaaaaaagagtctgtacagagcaaaggtttgggtgaagccatgggaagatttcaagtcagttgttgag

SEQ ID NO: 36179 - protein, 116 aa, Panicum virgatum
  misc_feature: Ceres CLONE 1965499
  misc_feature (37)..(116): Pfam Name: Cystatin Pfam Description: Cystatin domain
MAPRRAALFAAALLLASAAAAVSGFHLGGDESGLVRGVLAALRERAEAEDAARFAIAHHNRNQGAALEFTRVLKSKRQVVTGTLHDLVLEAADAGKKSLYRAKVWVKPWEDFKSVV

SEQ ID NO: 36180 - DNA, 1298 bp, Panicum virgatum
  misc_feature: Ceres CLONE 1965517
  misc_feature: Encodes the peptide sequence at SEQ ID NO. 36181
gccccccgttccgccgccgcgagccccacgcccttccgcctctgttccgctgctcagtgctccgggagaagaaaagtaggagctccgcccctgccggtccgaccccacggtacccaattcttgactccccctctctattcgcgatgcaatgagtacttactactaccacgtttcttcaatcatctctcggtctccccccctcccagttccagtgcgttgcttgccatgaataaccacggcgtcgttctagccgccggccccgagctaacaagttggggatgtagctgaattctgaaatctctggatgctcaccatacgtggcaagaacaatctcctcgaaggagcagcgcgataagaacaagaggagtgattaggagaggggatggcaaagtaaatggaaaccgggtttctgtggaaggagaacggcgaccaggccggggcggcgagaatgtccggcgggcacaagaacaagagcctcgactgggatctgaacgactggaggtgggacgccaacctgttcctggccacgccggcggccgccgcgccgtccgagtgcagcagcagggagctgagccgggcgcagggggagatcgatttcggagtggtcgtcgacaagaggcggcggctctcgccggaggaggacggcagcgccagctgcagcaacaactccgcggtggcaaatggagacaccaatcacgtcgtgtctgtgcagagaaggcagagcagtgaagaggagaggcccaggaaaggtgccagttcgagcacccctccgtcttgccaggtcgacggctgccacgccgatctcagcggtgccagggactaccataagaggcacaaggtgtgcgaggcgcataccaggacgagcttggtcagaatcaagaacatagagcatcggttctgtcagcagtgcagcaggttagtcagcaatttctttgtgaggttaccattgccgataatgtaaccttgacaaatgctgaacaagcaatttctttgtgaggttaccattgccgatagtagctttatgtctcttacagaatcccgcttcatgctgatcatgtatattgagaaatgccaaactttatggtttggcatgactctagctgaggccgatcatgtttttttactgccccttaaagaatactatctggtataatgtaaaggtgcttttacttggctctgtgctatggcactactataaaaatgcatctttttgtgctacatagaatgcatcttttcttctatggaagaaagatgttcttttgaaataaattatgaataattgaagttacttgaatggt

SEQ ID NO: 36181 - protein, 188 aa, Panicum virgatum
  misc_feature: Ceres CLONE 1965517
  misc_feature (127)..(187): Pfam Name: SBP Pfam Description: SBP domain
METGFLWKENGDQAGAARMSGGHKNKSLDWDLNDWRWDANLFLATPAAAAPSECSSRELSRAQGEIDFGVVVDKRRRLSPEEDGSASCSNNSAVANGDTNHVVSVQRRQSSEEERPRKGASSSTPPSCQVDGCHADLSGARDYHKRHKVCEAHTRTSLVRIKNIEHRFCQQCSRLVSNFFVRLPLPIM

SEQ ID NO: 36182 - DNA, 633 bp, Panicum virgatum
  misc_feature: Ceres CLONE 1965535-R
  misc_feature: Encodes the peptide sequence at SEQ ID NO. 36183
cactggtgccaccgccatcgctggtggtttcacccccggtaccttcaccaatcagcagcagcagagggacttcaaggagcctcgtctcatcatcgtcgctgacccccgcgtcgaccaccagtcgctcactgagtcgtcgtatgtcaacatcccgaccattgccttcgccaacaccgactcgcccctccgtcacgttgacattgccatcccctgcaacaacggctcgaagcacgccatcggtcttatgttctaccttcttgctcgtgaggtcctctaccttaagggtaccctcaaccgtcacgacggctgggacgtgatgcccgatctcttcttctaccgtgatcccgaggagaccgagaaggaagagaccgtcgaggccaccaccgccttcgatgaggcctacaagcccggttacgacgccaccgccggtgagcagtggtcgctcgagggtgaggagggtgctggtttcactcagcccaccaccgaggagtggggcgctgatgccgaggccacctccgcggctcccgctgccactgagggtgcccccgccacctgggacgtgtaagttcttctgggctgatgatgctctgtccggccttcgatcaaaacatataaacaaaccaatccccagtc

SEQ ID NO: 36183 - protein, 187 aa, Panicum virgatum
  misc_feature: Ceres CLONE 1965535-R
  misc_feature (1)..(94): Pfam Name: Ribosomal_S2 Pfam Description: Ribosomal protein S2
TGATAIAGGFTPGTFTNQQQQRDFKEPRLIIVADPRVDHQSLTESSYVNIPTIAFANTDSPLRHVDIAIPCNNGSKHAIGLMFYLLAREVLYLKGTLNRHDGWDVMPDLFFYRDPEETEKEETVEATTAFDEAYKPGYDATAGEQWSLEGEEGAGFTQPTTEEWGADAEATSAAPAATEGAPATWDV

SEQ ID NO: 36184 - DNA, 400 bp, Panicum virgatum
  misc_feature: Ceres CLONE 1965535
gagattgcgaatcgtgggctgtgacctccctgcctgtcgtcttcgtctccggcgagcaaagcagcggcggaaagagagagggatggggtacctctggcgggtgcggctgtcgtcgttcgcggctggcgccgcggcgacgtcggcggcgggtttcttcctcctcttcaaagaccatctccttgtccgcaccacaatcttccggcgggtgagtccacccccaagaaccaatcgagccactttgcctccgctctgattctcgggggctaatctggttaatcgcccgttcatccccatttctttgcgcacttgacacttctcgctaaattaggcgcctctggtttccttcccgatgcccacataccgtgatctggttcgactaaataggtggtccagcctttca

SEQ ID NO: 36185 - DNA, 1049 bp, Panicum virgatum
  misc_feature: Ceres CLONE 1965539
  misc_feature: Encodes the peptide sequence at SEQ ID NO. 36186
gaaaaaaacaaaacaaaaagaaaaggataaagaagcagagcgggcccacctcgaaaactccaccgctccacctcgaaaactccaccgctcccttccccgtgcgcgctcccactctctcaagtccagtctctgctcgccccctctccgcctccgccatggccgccgcctcgctctccccgccgccgcctctgggattactccctctcctagtcctcatcctcgcctgcctcgccgcgcaggccccaccgcgggcggcggaggcggcgggggtgctgaggcaggtggtggccggtggtggggacggcgacggcgggaccttcttcgagccgttcaacgtcacctacgaccaccgcgcggtgatcctcggtgggaagcgaaggatgctcgtctccgcggggctccactacccgcgcgccacgcccgagatgtggccgagcctgattgcaaagtgcaaggagggcggtgcggatgtgattgagacatatatcttttggaatgggcatgagccagccaaaggccagtattactttgaaggaaggtttgatattgtcaagtttgcgaagctggttgctgctgaaggtctatttctttttctgcgtatcggcccatatgcttgtgctgaatggaatttcggcggtttcccagtttggctgcgtgacatccctgggatagaattccgtactgacaatgaaccctacaaggctgaaatgcagagttttgtgacaaaaatcgtaaatatcatgaaagaggagaaactttattcatggcaaggtggtcccattatactacagcagattgaaaatgaatacggtaacattcaagaccgctatggtcaagcaggaaagagatacatgctatgggcagctcagatggcacttgcacttgatactggtgttccttgggtaatgtgtaggcaaacagatgctcccgaacaaattcttgatacttgcaatgccttttactgcgatggatttaaaccaaactcctacaacaagccgacaatatggactgaggattgggacggatggtatgccgattggggtgaacat

SEQ ID NO: 36186 - protein, 297 aa, Panicum virgatum
  misc_feature: Ceres CLONE 1965539
  misc_feature (67)..(297): Pfam Name: Glyco_hydro_35 Pfam Description: Glycosyl hydrolases family 35
  misc_feature: SWISSPROT Homolog: EC 3.2.1.23 Beta-galactosidase
  misc_feature: Functional homolog of the protein sequence given in SEQ ID NO 51319
  misc_feature: Useful for making plants with altered carbohydrate content
  misc_feature: Functional homolog of the protein sequence given in SEQ ID NO 51516
  misc_feature: Useful for making plants with altered cell wall content and/or composition
MAAASLSPPPPLGLLPLLVLILACLAAQAPPRAAEAAGVLRQVVAGGGDGDGGTFFEPFNVTYDHRAVILGGKRRMLVSAGLHYPRATPEMWPSLIAKCKEGGADVIETYIFWNGHEPAKGQYYFEGRFDIVKFAKLVAAEGLFLFLRIGPYACAEWNFGGFPVWLRDIPGIEFRTDNEPYKAEMQSFVTKIVNIMKEEKLYSWQGGPIILQQIENEYGNIQDRYGQAGKRYMLWAAQMALALDTGVPWVMCRQTDAPEQILDTCNAFYCDGFKPNSYNKPTIWTEDWDGWYADWGE

SEQ ID NO: 36187 - DNA, 578 bp, Panicum virgatum
  misc_feature: Ceres CLONE 1965539-R
  misc_feature: Encodes the peptide sequence at SEQ ID NO. 36188
gctcaaaaatatccgagacttattatcctcccctttcttcctggtctcgtgctgccaacggtcgtgccaccctgaatacggtagctccggagcttcacttacagtgtgatgaggggcatgtgatctcgaagattacatttgcgagctatggaaccccttcaggtggttgccagaacttctctgtcggaaattgccatgcatcaactactctggacttggttacagaggcctgtgtcggcaataacaaatgctccatcagtgtcaccaacgatgtatttggcgatccatgccgaaaggtcgtaaaggatttggcagttgaggctgagtgctccccgcccttggctacagaagaacctcgagatgatatgtgatcaagatactgtaatttggccctgaaagagccgtggtggaagggagcgtttctacagccttgcaggagcatctgagctgcgtgctagtgctaggggttcctgcatcgttgtacctaacctgttcctttgcgcccatgtatgtaaagacaatcacgtactcgggggaccagaaagaaagaaagggaaagaacaagttgtttcctgtgc

SEQ ID NO: 36188 - protein, 122 aa, Panicum virgatum
  misc_feature: Ceres CLONE 1965539-R
  misc_feature (33)..(109): Pfam Name: Gal_Lectin Pfam Description: Galactose binding lectin domain
  misc_feature: SWISSPROT Homolog: EC 3.2.1.23 Beta-galactosidase
  misc_feature: Functional homolog of the protein sequence given in SEQ ID NO 51319
  misc_feature: Useful for making plants with altered carbohydrate content
  misc_feature: Functional homolog of the protein sequence given in SEQ ID NO 51516
  misc_feature: Useful for making plants with altered cell wall content and/or composition
SKISETYYPPLSSWSRAANGRATLNTVAPELHLQCDEGHVISKITFASYGTPSGGCQNFSVGNCHASTTLDLVTEACVGNNKCSISVTNDVFGDPCRKVVKDLAVEAECSPPLATEEPRDDM

SEQ ID NO: 36189 - DNA, 754 bp, Panicum virgatum
  misc_feature: Ceres CLONE 1965559
  misc_feature: Encodes the peptide sequence at SEQ ID NO. 36190
gagagctagggtttgccgccgcctcctcgccgccgcctccccaggccccagcgaaccctaatcgttctcctcgcccgccaccgccgccgcggtcatgtccgggaggaggaagacgcgggagcccaaggaggagaacgtgacgctcggccccgccgtccgcgagggggagtatgtcttcggcgttgcccacatcttcgcctccttcaacgacaccttcatccatgtgacggatctgtctgggagggaaacgctcgtccgcatcactggtggcatgaaggttaaagctgatcgtgatgagtcatcaccttatgctgctatgcttgcctcacaggatgttgctcaaagatgcaaggagcttgggattactgctctgcacattaagctccgtgctactggtggaaacaagaccaaaactccaggtcctggtgctcagtctgcccttagagctcttgctcgatctggcatgaagattggtcgtattgaggatgtcacccctgtcccaactgacagcacacgcagaaagggtggcagaaggggaaggaggctgtaatttcaagtatattggctggtgtatccagatgtagcagttctagactgttttcatcttacactgagcaagttttgcaacatgtattgaagttttgagttgtcaactcgtggatccgtttcagtttaatccttgttgacgaagtatgtgccattcaacgtagcgagatacaattcaggagctcccacttctgcttgttggctcgat

SEQ ID NO: 36190 - protein, 151 aa, Panicum virgatum; identical to SEQ ID NO: 10232
  misc_feature: Ceres CLONE 1965559
  misc_feature (29)..(147): Pfam Name: Ribosomal_S11 Pfam Description: Ribosomal protein S11
  misc_feature: Functional homolog of the protein sequence given in SEQ ID NO 50135
  misc_feature: Useful for making plants with modulated biomass

SEQ ID NO: 36191 - DNA, 879 bp, Panicum virgatum
  misc_feature: Ceres CLONE 1965560
  misc_feature: Encodes the peptide sequence at SEQ ID NO. 36192
gaccaaacaaccgcagcgagcgaaaccaaaccgctctcgtctcggctctccactctccctcccccagcagcccgcaagctaaggctctccactctccctcccccagcagcccgcaagctaagcaaggcaataagaggcggccatgagcgtggtggtcctggacggatcgacggtgcgcgccttcgtggcggacgaggcggcgttcgcgcgcagcgtggacgcgcgcttcgcggcgctggacgccaacggcgacggcgtgctgtcccgcgccgagctccgccgcacgctcgagtcgttccgcctcctcgacggcgccggtttcgggtccgcccggccggcgccgctccccgccgaggtcgccgcgctctacgacgccgtcttcgagcagttcgacgctgaccacagcggcgccgtcgaccgcgccgagttccgcgacgagatgcgccgcatcatgctcgccgtggccgaggggctcggctcgcagccgctccaggtcgccgtcgacgacgagggcggcagcttcctgctcgaggccgccgagcacgaggccgccgcgatcgccgccaagctcgacgcggagcgcaaggcggaggccgccgcagctgctgccgacggcgccgagtgacgtgccgcgtggggtggggcggtggctgaccaccttgtgctctgcgctcgctgctgtactgcttctagatgttggtgtactagtactaatacgtgtcagccgttgcgctgctacacgtgtacgtgaacagaaaaccggccggtggcagtgcaacctgccgggaaatgactacgagagttctactatttactgcttgtgaaaggaataaaacggcttccaagtctcggatgtaacttggcggcaacttgtccacc

SEQ ID NO: 36192 - protein, 160 aa, Panicum virgatum
  misc_feature: Ceres CLONE 1965560
  misc_feature (75)..(103): Pfam Name: efhand Pfam Description: EF hand
MSVVVLDGSTVRAFVADEAAFARSVDARFAALDANGDGVLSRAELRRTLESFRLLDGAGFGSARPAPLPAEVAALYDAVFEQFDADHSGAVDRAEFRDEMRRIMLAVAEGLGSQPLQVAVDDEGGSFLLEAAEHEAAAIAAKLDAERKAEAAAAAADGAE

SEQ ID NO: 36193 - DNA, 1386 bp, Panicum virgatum
  misc_feature: Ceres CLONE 1965566
  misc_feature: Encodes the peptide sequence at SEQ ID NO. 36194
cggagctgaattaaaaaaattaattttcttctaactcaacaacaacactttgcctaaaaactcacatggaacaacaaggcctcaagaacaaatacgccagtctcggcaagtacattctcgtcaaaaccctcggtagcggctacaactccaaagtcaaacttggttatgctccctctattaacaaatactgcgccgtcaagatcatcaagcactcccatcccagtctcaacttgaagaccctcaagaaggaaatggaaatcctccaggctctcaaccatcctaacattgtcaaccttgtcgaattcttcgagaccgccgaatacgtcaagaagaacggtcaatcctacaaggctgtcgctatcgtcatggaactggtccctggtggtgagctcttcgagtacgtcgctgactctggccgtttctccgaagaaaccgccagaacttacttcagaaccatcattgaaaccctcgaatactgctacggccgtgacatcgcccacagagatctcaagcccgaaaacttgttattcgacgccaacttcaacctcaaaatcgccgacttcggttttgccactctcatgtcaggcaaggacggtactggacaactccacaccatcctcggtactgaatcctacatggctcctgaaatccacctcagaaagccatacactggttccgctgtcgacttgttcgcttgcggtatcatcctcttcatcatgatcagtggtaccccaccattcgctaaggctgaccccagaagcgaccctcactacaagctccttgttgctggcagaactgatgtgttctggaaggctcacgaaaagagcaagccaaagaaggccggacaagagaacttctacagtgaagatttcaagaacttgatcaatggtatgttggctcctgaagctggcaacagaccctctgttcaacagattaaggaccacccttggtacaagggacaggttgttgatgtcaacaccttgaaggttgagttcttacagagaaagaagatggtcgatgctgagctccagaagcaaagagaagctaagcttaagcagaagcaaatggccaaggctcaacccaatatggctattggcgcctacactggtatcaagccattcagaagcggtgaagctgaacttgacgctcaaattgccaaggaattggacgctaagtgcaacttcgaagcaaagagagagttggaagaatatcaaactgaaggtggtttcaagccccagactgaagttttctcagttgaagctgccactgagctcttcaagttgctctgcactcaatgcaagaccaagaactacgaattcactacttctgacaataagttcaagatcaaggctaaagctaacttggatgacggcaatgtcgctttca

SEQ ID NO: 36194 - protein, 440 aa, Panicum virgatum
  misc_feature: Ceres CLONE 1965566
  misc_feature (16)..(296): Pfam Name: Pkinase Pfam Description: Protein kinase domain
  misc_feature: SWISSPROT Homolog: EC 2.7.11.1 Non-specific serine/threonine protein kinase
MEQQGLKNKYASLGKYILVKTLGSGYNSKVKLGYAPSINKYCAVKIIKHSHPSLNLKTLKKEMEILQALNHPNIVNLVEFFETAEYVKKNGQSYKAVAIVMELVPGGELFEYVADSGRFSEETARTYFRTIIETLEYCYGRDIAHRDLKPENLLFDANFNLKIADFGFATLMSGKDGTGQLHTILGTESYMAPEIHLRKPYTGSAVDLFACGIILFIMISGTPPFAKADPRSDPHYKLLVAGRTDVFWKAHEKSKPKKAGQENFYSEDFKNLINGMLAPEAGNRPSVQQIKDHPWYKGQVVDVNTLKVEFLQRKKMVDAELQKQREAKLKQKQMAKAQPNMAIGAYTGIKPFRSGEAELDAQIAKELDAKCNFEAKRELEEYQTEGGFKPQTEVFSVEAATELFKLLCTQCKTKNYEFTTSDNKFKIKAKANLDDGNVAF

SEQ ID NO: 36195 - DNA, 459 bp, Panicum virgatum
  misc_feature: Ceres CLONE 1965582
  misc_feature: Encodes the peptide sequence at SEQ ID NO. 36196
ttctcccgcagtctcgttcgctcgcctttccccacacagttagggtttcgtcgccccgcgcgccaatccgccccccgcccgccttgtcaaaccagggagggaaggccaagccgctcaaggcgcccaaggtcaacaaaaaggagtacaacaaaagtgatcttgcttatctgcaaaaaaaaaaaaagaagaaaaaggcactcaaggatctgaaggccaaggcacaaaagggtgcaatcggaggttctggtttgaaaaaaagcggaaaaaaatgattctgtcttgcgtatctggaaaatgataaaccccctgccttatgtgctgggtttggccttatgtgattgaaacaaactatgggttctgtgttattaaggctgcagttggttgcttgatccaaaaaaataatgttggttataatccaaaaacttggcattctaaaatgttatctcaaattttcggtgc

SEQ ID NO: 36196 - protein, 89 aa, Panicum virgatum
  misc_feature: Ceres CLONE 1965582
  misc_feature (28)..(89): Pfam Name: TMA7 Pfam Description: Translation machinery associated TMA7
LPQSRSLAFPHTVRVSSPRAPIRPPPALSNQGGKAKPLKAPKVNKKEYNKSDLAYLQKKKKKKKALKDLKAKAQKGAIGGSGLKKSGKK

SEQ ID NO: 36197 - DNA, 372 bp, Panicum virgatum
  misc_feature: Ceres CLONE 1965628
  misc_feature: Encodes the peptide sequence at SEQ ID NO. 36198
gcaccaaagccaccaaccatgggcggccgcctcgctcaagctcgccacccccaaacccctcgcccccgcgccgctcctccgcgggcgcggcgcggcccaggcgcgtcccctccccgcgcgccgcgtcccgccgaccgcccgcgtcgccgtgcacccccccgccgcgccgcacgccccgctcatccgctacttcaaccacgtgctggatgccctgatggacgtgagcgacgtcacggaggaggacgcggacagcacgctgctgtcgctgctggagcacaagaaccatgtccgcttcgccgcgttcctcgtcctcatcaggggcaagggcgagaactacaaacagacggagctgctggacaaggtcaagctgag

SEQ ID NO: 36198 - protein, 123 aa, Panicum virgatum
  misc_feature: Ceres CLONE 1965628
  misc_feature: SWISSPROT Homolog: EC 2.4.2.18 Anthranilate phosphoribosyltransferase
HQSHQPWAAASLKLATPKPLAPAPLLRGRGAAQARPLPARRVPPTARVAVHPPAAPHAPLIRYFNHVLDALMDVSDVTEEDADSTLLSLLEHKNHVRFAAFLVLIRGKGENYKQTELLDKVKL

SEQ ID NO: 36199 - DNA, 724 bp, Panicum virgatum
  misc_feature: Ceres CLONE 1965630
  misc_feature: Encodes the peptide sequence at SEQ ID NO. 36200
gagagaagctagatcgatcgagcattctggttgacgcaagcagagtgacacacgacgatggccgcgccggcgccgcagcaggggcagacggtgatggtggcggtggacgagagcgagtgcagccgccgcgcgctggagtgggcgctgcggaacctggcgcccccgctggcgcccccgctgctgctgctcaccgtgcagccgctcgtcccccttggatacgtctccgcggcctccttcggcacccctctgggcaccgttcctcctgtagctccggagctcatcaagtcgatgcaggatcagcagagggagctcacgcaggcgctcctcagcaaggccaaggccatctgtgcggagcatggggttccagaagagacaattgttgaagtaggagatccgaaggagatgatatgtgaagcagctgagaaaaaaaatgtcgatctgctagtccttggaagccacagtcgtgggcctatacaaaggttgtttcttgggagcgttagtaactactgcgttcatcattgcaagtgtccagttcttgttgtgaagaatcaaggctgaggattcctgcataaatcaacttccaatgttgtcgtaattctgtttgggtatttatcaatatatatatatatatatatatatatatatatatatatatatatatatatatatatatattattgaatgctatccacatatatttgacactataacggggcaagatagt

SEQ ID NO: 36200 - protein, 166 aa, Panicum virgatum
  misc_feature: Ceres CLONE 1965630
  misc_feature (9)..(163): Pfam Name: Usp Pfam Description: Universal stress protein family
  misc_feature: Functional homolog of the protein sequence given in SEQ ID NO 51517
  misc_feature: Useful for making plants with modulated biomass
MAAPAPQQGQTVMVAVDESECSRRALEWALRNLAPPLAPPLLLLTVQPLVPLGYVSAASFGTPLGTVPPVAPELIKSMQDQQRELTQALLSKAKAICAEHGVPEETIVEVGDPKEMICEAAEKKNVDLLVLGSHSRGPIQRLFLGSVSNYCVHHCKCPVLVVKNQG

SEQ ID NO: 36201 - DNA, 587 bp, Panicum virgatum
  misc_feature: Ceres CLONE 1965636
  misc_feature: Encodes the peptide sequence at SEQ ID NO. 36202
ccaactgacaacacccaaccaacaggcgcacgaacgggagccgtggctgcacacggaaagggaagcggaaagctctgctcgcatggacgactccgcagcggcggcgccggcgccagtgctgctggtgacgaacgacgacggcatcgacgcgccggggctccgcttcctcgtcgaccagctcatcgccgcgcggcgctaccgcgtcctcgtctgcgcgcccgactcgtaaaggccccgccttcgcctcgcgatccatcccctcttcttgctcgcgtcctttcgaattcttgcttgcttggttggtgctcttggagattatgtggttggatcacgggatttggtcagtgactttgggaggaagtagtatgcgagaaaaaaagaacaaggatttagaggggaaagtattgttttcatcccttctcctttggcattctcacccatgaagacgaagaaggggaatggtcatagaaaaagaaatcttttcttttttgtaaatttctggatttgcaggttgcagcagttagtaactgttctctctgttgaccattggtgtgaaattgcggggcctaatttttctgtggaagaaa

SEQ ID NO: 36202 - protein, 48 aa, Panicum virgatum
  misc_feature: Ceres CLONE 1965636
  misc_feature: SWISSPROT Homolog: EC 3.1.3.5 5'-nucleotidase
MDDSAAAAPAPVLLVTNDDGIDAPGLRFLVDQLIAARRYRVLVCAPDS

SEQ ID NO: 36203 - DNA, 682 bp, Panicum virgatum
  misc_feature: Ceres CLONE 1965659
  misc_feature: Encodes the peptide sequence at SEQ ID NO. 36204
gtctttcagcgccgccttcctccggcctcctgggccgccgccactggcacctccgcagcccggagccgggcgaacgcagccctgggagaatccaagggcgccgcggcggtgaccctccgcacgcgcaagttcatgacccaccccctcctctcccgcaagcagttcgtggtccaagttatccaccccgggcgcgccaacgtctcccagggggaactcaaggaacgggtggggaaagtggacgaaggcaaggaccccaactggatcttcctcttccagttccgcacccacttcggaagggggaagtccaccggcttccgcctcatctaccaacacctccaggccgccaagaaattccagccccagtaccgcctcatcaggaatgggcttgcaaccaaaggaaaaaaatcacgccagcagatgaaggaacggaagaacagggcaaagaagattcgtggtgtgaagaagaacaagggtggaaatgccaaaaagaagtaaggaaagaaataattgccttggcatcttcatcctacctggctccgggttggtgaagaccgtggcctttttggcaatggtgaatggttaattagacctagaaaggattttgccagaattatgaatggtgaagctctcgtagtactttgtggtccggtttgaagaatattggcagaaactaacataatac

SEQ ID NO: 36204 - protein, 164 aa, Panicum virgatum
  misc_feature: Ceres CLONE 1965659
  misc_feature (55)..(138): Pfam Name: Ribosomal_S24e Pfam Description: Ribosomal protein S24e
VFQRRLPPASWAAATGTSAARSRANAALGESKGAAAVTLRTRKFMTHPLLSRKQFVVQVIHPGRANVSQGELKERVGKVDEGKDPNWIFLFQFRTHFGRGKSTGFRLIYQHLQAAKKFQPQYRLIRNGLATKGKKSRQQMKERKNRAKKIRGVKKNKGGNAKKK

SEQ ID NO: 36205 - DNA, 646 bp, Panicum virgatum
  misc_feature: Ceres CLONE 1965666
  misc_feature: Encodes the peptide sequence at SEQ ID NO. 36206
gcctcgctccaagcccaagcccaaacccaccagtccaccaccaccaattcaactgcgacccgacccgacccccgcacgcattcccacctcctccctccctccctccctccctccccccagatctctctcccccctgcgcgcgcgcgccggggtgctgccttcgccggcggcggcgacgaccgaggaccgccatgacggcgaagggcggcgccgcgccgtcccccggcggcacgggggccgcggcggggaccgggcgcctcttcaccgtggggctcgtcaccgcctggtactcctccaacatcggcgtgctcctgctcaacaagtacctcctcagcaactacggcttcaagtacccaatcttcctcaccatgtgccacatgtccgcctgcgccctgctctcctacgccgccatcgcctggctccgcgtcgtgcccatgcagctcgtgcgctcccgcgtccagctcgccaagatcgccgcgctcagcctcgtcttctgcggctccgtcgtgtcggggaacgtctcgctgcggtacctaccggtctccttcaaccaggccgtcggcgccaccacgcccttcttcaccgccgtgttcgcgtacgtcatgaccgtcaagcgcgagtcgtgggtcacctacctcaccctcgt

SEQ ID NO: 36206 - protein, 151 aa, Panicum virgatum
  misc_feature: Ceres CLONE 1965666
  misc_feature: Functional homolog of the protein sequence given in SEQ ID NO 51430
  misc_feature: Useful for making plants with altered cell wall content and/or composition
MTAKGGAAPSPGGTGAAAGTGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYVMTVKRESWVTYLTL

SEQ ID NO: 36207 - DNA, 607 bp, Panicum virgatum
  misc_feature: Ceres CLONE 1965686
  misc_feature: Encodes the peptide sequence at SEQ ID NO. 36208
acacatcggtgagcagcttccccacattctcgttctccgtccaccaacctacccacctgcggcggcgcaaggaagcgaagcgacgcgatgtcggcgacgacggcggcggtgcccttctggcgcgcggcggggatgacctacatcggctactccaacatctgcgccgcgctggtgcggaactgcctcaaggagcccttcaagtccgaggccgcgtcccgcgagaaggttcacttctccgtctccaagtggacggacggcaagcaggagaagcccactgtccgcacggagtcagatgaataaagatctggtgccatgatgatagtccttctacagatgttttgaagtgttgttgcaagctctggaacttgctgtttatctggcttgattttatggtcaacactgaagaataaatactttttgtaacaattgatctttttgaacaatgccatgtcattactgtttctaattgcacttgctcaactctcaatccatcgtgtgaacttacggaagtttgtgcaatttggtatcaaatatagtattggctatctcaaatttgcccccctataaagtttttggagaagtaatctgtaggaaggaggaaggaagg

SEQ ID NO: 36208 - protein, 70 aa, Panicum virgatum
  misc_feature: Ceres CLONE 1965686
  misc_feature (9)..(57): Pfam Name: ATP-synt_Eps Pfam Description: Mitochondrial ATP synthase epsilon chain
MSATTAAVPFWRAAGMTYIGYSNICAALVRNCLKEPFKSEAASREKVHFSVSKWTDGKQEKPTVRTESDE

SEQ ID NO: 36209 - DNA, 486 bp, Panicum virgatum
  misc_feature: Ceres CLONE 1965720
  misc_feature: Encodes the peptide sequence at SEQ ID NO. 36210
cccggccgtctccatcccagattccgagagcgctccacaggccaggtcccatcgcgccgcggcatccccggcccgcaccgcctctcccatcccgcccggtcgcctcgccgccgctgctgccgagatggggttcgtgtccttcgtcgggagggtgctcttcgtcgccgccttcctcctctccgcctaccaggagtttaatgaattcggaactgatggtgggccagcggcaaaggtccttcagcccaagttcaatgtgtttgtcaaaaatatctcttcccacttgggagttgccgtgcctcatattgagttaaagcaagctgcgatgtgaagccattgccatcgtgctgagctttcatatgtatcagattccattttgcagggcacggcccgaacgaaggtgtgagtggcggattaggcgactagattgtaccattatgtactcgtgattggtttgttggactaggttgccaatgattgatcttctcc

SEQ ID NO: 36210 - protein, 67 aa, Panicum virgatum
  misc_feature: Ceres CLONE 1965720
  misc_feature (1)..(67): Pfam Name: HR_lesion Pfam Description: HR-like lesion-inducing
  misc_feature: Functional homolog of the protein sequence given in SEQ ID NO 51445
  misc_feature: Useful for making plants with modulated nitrogen use efficiency
MGFVSFVGRVLFVAAFLLSAYQEFNEFGTDGGPAAKVLQPKFNVFVKNISSHLGVAVPHIELKQAAM

SEQ ID NO: 36211 - DNA, 714 bp, Panicum virgatum
  misc_feature: Ceres CLONE 1965739
  misc_feature: Encodes the peptide sequence at SEQ ID NO. 36212
aagaggttttctccaaaccggcgaggggagaggaactagccagtgaattcggtccctccaacccaacgagaagatgccgcggatccctctgatcaagttccccaagcggaatctcaaagccccatccccatccgcaccaggggggccccccacccccccaatcatccttctctttcctcgcaggatttctcacgagctttctaaatttcctcgctttctgcttgttgcagcagcatcgcagcccgcggatcagcacgcgaccctcatgtcccgcttgggggctaaagtagaggcaccatcttctggagagattaaaaattaccgttttagatctgatgtgccatccccaccttctcatactgctgttggaggtccagcttcactccttcctaagcgcaaaccattgactgaagaagagattgaggccatcatgcttggtggctccatctgatatggcctcgcatggattggaaacgtaggaggtatcaataagatcatatacccaaacttgccttgactgtaaggggtgttattcaagccatgttgatatggaatttgtttttttttttgtttctctgtctgggagtcagctgctgtgccattcgtttctaatattctccggtcttcacatgtgacttgaccaaatcgtgagcaggcatgttgatatggagtccggtttttgtttctctgcctggaagccagctgttgcgaaat

SEQ ID NO: 36212 - protein, 61 aa, Panicum virgatum; identical to SEQ ID NO: 31535
  misc_feature: Ceres CLONE 1965739
  misc_feature: Functional homolog of the protein sequence given in SEQ ID NO 50812
  misc_feature: Useful for making plants with modulated heat sensitivity

SEQ ID NO: 36213 - DNA, 646 bp, Panicum virgatum
  misc_feature: Ceres CLONE 1965756
  misc_feature: Encodes the peptide sequence at SEQ ID NO. 36214
aaaaaacacaactccgacctctatttttctcacgccctccccgcgaataaaaacttttcacttttctagcctccctttgaatccatccatccatccacccatccattgctcgtctccctcccaaattcgatgcctttgtagcgctgccgcttcgcccctgcgtcgcgccgcgccgtgcggtgcacttgccgctgcgcttcccatggacgctggggccggtgccggatccggcaatgcctccggcggcggcgcgtccgcgtgctgctactacgccctgctcggcatccgcaagaacgcctccgccaccgacatccgcgccgcctaccggaggctcgcgatgaagtggcacccggaccggtgggcgagcgaccccgccgccgccggcgaggccaagcggcggttccagcggatccaggaggcctattccgtcttgtcggacaaggggaagaaggccatgtacgacgccgggctcttcgatcccctggacgacgacgaccaggatttctccgacttcatgcaggagatgctggtgatgatggataacgtggcaaacgagaagccggacacgctggaggacctgcagaagatgctggaggacatcgtcaacggcgacgatgggagccgcggcgtgggcgggcgcgtgccg

SEQ ID NO: 36214 - protein, 147 aa, Panicum virgatum
  misc_feature: Ceres CLONE 1965756
  misc_feature (21)..(87): Pfam Name: DnaJ Pfam Description: DnaJ domain
MDAGAGAGSGNASGGGASACCYYALLGIRKNASATDIRAAYRRLAMKWHPDRWASDPAAAGEAKRRFQRIQEAYSVLSDKGKKAMYDAGLFDPLDDDDQDFSDFMQEMLVMMDNVANEKPDTLEDLQKMLEDIVNGDDGSRGVGGRV

SEQ ID NO: 36215 - DNA, 532 bp, Panicum virgatum
  misc_feature: Ceres CLONE 1965772
  misc_feature: Encodes the peptide sequence at SEQ ID NO. 36216
aacaggccggagacttctgacttctcaaccgcggcttccctcgtcttgaccgtcggcgccgaagggccaggggaaaacggagtggttcttgtttctctccccagctcaagctggtggcggaatcaacccaaaaccttgccggatttccgacctgatcacgacatgatccggttcatcctgctgcagaaccggcaggggaagacgcggctggccaagtactacgtcccgctcgaggattcggagaagcacaaggtcgagtacgaggtgcaccggctggttgtcaatcgggaccccaagttcaccaatttcgtcgagtttcgcacacacaaagttatctacagaagatatgcagggctgtttttttcaatttgtgtggacataactgacaacgagttggcatacttggaatgcattcatttgtttgtcgagatattggaccatttctttagcaatgtttgtgagcttgatttagtgtttaattttcacaaggtttatctgatattaaatgaatttattcttgccggagagctgc

SEQ ID NO: 36216 - protein, 123 aa, Panicum virgatum
  misc_feature: Ceres CLONE 1965772
  misc_feature (1)..(123): Pfam Name: Clat_adaptor_s Pfam Description: Clathrin adaptor complex small chain
MIRFILLQNRQGKTRLAKYYVPLEDSEKHKVEYEVHRLVVNRDPKFTNFVEFRTHKVIYRRYAGLFFSICVDITDNELAYLECIHLFVEILDHFFSNVCELDLVFNFHKVYLILNEFILAGEL

SEQ ID NO: 36217 - DNA, 318 bp, Panicum virgatum
  misc_feature: Ceres CLONE 1965788
  misc_feature: Encodes the peptide sequence at SEQ ID NO. 36218
gtcttcgcccgccgccgcctcccccgtcctcctcgccgccgtagactaggttaggctagggtttcgacgagctcgcggacatggtggccttcaggttccatcagtaccaggtggtggggcgtgcgcttccgacgcctggcgatgagcaccccaagatctaccgcatgaagctctgggccaccaacgaggttcgggccaagagcaagttctggtacttcctgaggaagctcaagaaggttaagaagagcaacggccagatcctcgccatcaacgagatcttcgagcgtaacccagagcagaaccggctaccacaacatg

SEQ ID NO: 36218 - protein, 79 aa, Panicum virgatum
  misc_feature: Ceres CLONE 1965788
  misc_feature (5)..(79): Pfam Name: Ribosomal_L18ae Pfam Description: Ribosomal L18ae protein family
MVAFRFHQYQVVGRALPTPGDEHPKIYRMKLWATNEVRAKSKFWYFLRKLKKVKKSNGQILAINEIFERNPEQNRLPQH

SEQ ID NO: 36219 - DNA, 649 bp, Panicum virgatum
  misc_feature: Ceres CLONE 1965823
  misc_feature: Encodes the peptide sequence at SEQ ID NO. 36220
aagcatcaccacgcattcgacgcagacgcgcagggaagcacggggggcaggaaaaagagcacggacgatttgcagcggcagcggctgcgggcgaggaggaagactcccgatctcgccggagtcggcggaacgcacgctcccgatctcgctagccggtggcgctcggcgaccgatgcggtagataggttggacagtcagcgggagaagagatcgatggggggagcggggcacggcgtgcatttcttagacgcgtgcttcctctgccggaggccgctcgccggcaacagcgacatcttcatgtacagaggggacacggcgttttgcagcgacgagtgccggagcgcgcagatggcggcggacgaggcggcggagaggaaggagagggcgagcggcgccagcgccaaggcggtcacgcatggggcgctgcccgccagggaagcggaaggcccgcaggagcgcggcggcaaggtccgggccgggtccatcctggccctgtaacgagaaacttctctcgaatctaagcatggcgttttccttctttttttttctccctccctttccatctaggagtatttctctaccttacgaaacgcaccaccggaggtcgccaccttcatgtacatggacgggtttgtgttttttgatgatg

SEQ ID NO: 36220 - protein, 94 aa, Panicum virgatum
  misc_feature: Ceres CLONE 1965823
  misc_feature: Functional homolog of the protein sequence given in SEQ ID NO 50550
  misc_feature: Useful for making plants with modulated biomass
MGGAGHGVHFLDACFLCRRPLAGNSDIFMYRGDTAFCSDECRSAQMAADEAAERKERASGASAKAVTHGALPAREAEGPQERGGKVRAGSILAL

SEQ ID NO: 36221 - DNA, 496 bp, Panicum virgatum
  misc_feature: Ceres CLONE 1965838
  misc_feature: Encodes the peptide sequence at SEQ ID NO. 36222
aaacctttcccttctctcggacagtcggactcttccttccctggcggcgacgaccgggcgagcggcggcgccatttgtccttgtcttcgcccagccctttgccggcgacgagcgtatcctccaggcatctcgcaggtgcagcttgcaagcatgtatatccgagtgaagcgcaacaagagtacctacttcattcaatgtgaaccaacagagacaactttgagcgtcaaacagaagttgcattcactaatagatcaacctcctagtaatcagcagttggtcttgttggctaccaatgacgtgctcgaagattcaaatacattggcagaacaaaaggtggacaatgattctgttgttgccttggcactgagaaaagatgatgatgagtttgaggaaattttccccgccaggccagaggatttcatgtcatcgtcatgatgaagatcaattcatcatatgtgcaaggacaccccccgcgtcgccactaaggggatgctgc

SEQ ID NO: 36222 - protein, 94 aa, Panicum virgatum
  misc_feature: Ceres CLONE 1965838
  misc_feature (4)..(75): Pfam Name: ubiquitin Pfam Description: Ubiquitin family
MYIRVKRNKSTYFIQCEPTETTLSVKQKLHSLIDQPPSNQQLVLLATNDVLEDSNTLAEQKVDNDSVVALALRKDDDEFEEIFPARPEDFMSSS

SEQ ID NO: 36223 - DNA, 654 bp, Panicum virgatum
  misc_feature: Ceres CLONE 1965841
  misc_feature: Encodes the peptide sequence at SEQ ID NO. 36224
atgtcacatcgttagacttccatccaaagaaaacagatcttctgtgttcttgtgatggcaatggtgaaatccgatactggaatgtgacccagcttacatgtatgcgtgccataaagggtggtactgcccaagttcggtttcaacctaatgctggacaatttttagccgcagctgctgaaaacgtggtttccatatttgatattgagacacatgggaaaaaatacactctgcagggacataacaccgatgtgcagtcagtgtgctgggacaacagcggggaatatcttgcctccgtcagtcaggacctagttaaggtttggtcaatatcatcaggagagtgcattcatgagcttagctccaatggaaacaagttccattcctgtgtgttccacccgagctataccaatctcttggttattggaggctaccagtctctggaggtatggaacatggtgaagaaccagagcctgacagtacaagctcatgaaggtctaattgctgcgctggcacagtcaccagtcacaggaatggtagcttctgcaagccatgaccactccgtcaaggtgtggaaataacaaaacaacaaaaataatgaatctaggtagctttttttcttaacccggtaattgatttctccgatcgaggcataagact

SEQ ID NO: 36224 - protein, 190 aa, Panicum virgatum
  misc_feature: Ceres CLONE 1965841
  misc_feature (70)..(107): Pfam Name: WD40 Pfam Description: WD domain, G-beta repeat
  misc_feature (152)..(190): Pfam Name: WD40 Pfam Description: WD domain, G-beta repeat
  misc_feature: SWISSPROT Homolog: EC 2.7.11.7 [Myosin heavy-chain] kinase
VTSLDFHPKKTDLLCSCDGNGEIRYWNVTQLTCMRAIKGGTAQVRFQPNAGQFLAAAAENVVSIFDIETHGKKYTLQGHNTDVQSVCWDNSGEYLASVSQDLVKVWSISSGECIHELSSNGNKFHSCVFHPSYTNLLVIGGYQSLEVWNMVKNQSLTVQAHEGLIAALAQSPVTGMVASASHDHSVKVWK

SEQ ID NO: 36225 - DNA, 640 bp, Panicum virgatum
  misc_feature: Ceres CLONE 1965891
  misc_feature: Encodes the peptide sequence at SEQ ID NO. 36226
agacctaaagcgcgcggctagtggcgcccgagacgaactgggaagttcgaaccagcgagctgcccgcgccgccgtgggtgggggcggtcggctcaggccatggacccgccgccgcagcggggccgctcgcgctacggtggcggcggcggctcatagtggcagcagttcccgttcgtcgttgaccccacggaggcgccgggggcggcggcagtgagggcgttcttcccggcgccgggcggggaggcgccgccgtcgtcgtccggggaccgcgcgctgccggggcagcagcagcagcagcggtacggccacggcgagatctcgctggggcacgggcaagggacgatgcatcatcgctaccaccagttcggcgtggaggggaagcgggacggcggcccgtcggcggcggcgctgccgcggcacagcagctcgccgccggagttcttctccagccccgtcatggatcacggttttccaagagctggagttggtgttggtggtgaggttccccatgcaatgagtagctatcacaagaagatgaaggccccgatgaacctagccggacaaggaaccctctctcatatctcagaggatggaatcccggatctcaccagtaatgtgaatggtattggccactctgaag

SEQ ID NO: 36226 - protein, 99 aa, Panicum virgatum
  misc_feature: Ceres CLONE 1965891
  misc_feature: The sequence is a functional homolog of SEQ ID NO 170 in the 10/714,887 US patent application
  misc_feature: The sequence is a functional homolog of SEQ ID NO 170 in the 11/435,388 US patent application
MHHRYHQFGVEGKRDGGPSAAALPRHSSSPPEFFSSPVMDHGFPRAGVGVGGEVPHAMSSYHKKMKAPMNLAGQGTLSHISEDGIPDLTSNVNGIGHSE

SEQ ID NO: 36227 - DNA, 570 bp, Panicum virgatum
  misc_feature: Ceres CLONE 1965894
  misc_feature: Encodes the peptide sequence at SEQ ID NO. 36228
acccaactccgagcagacattggccgccgccgccgccgccgcgacatcaccagagggcaacaagcggggggaatggcggagcggcgggtggcggagctgggtcccggcgcggcatgctgcggctggaaccactgtggccgccgcctcgcctccggcgccgtcgacggctccgtctccgtctacgactcgcacccgtccccctcctccaagtggcaggcccatgagcaggccattgtgaatgttgtctggcttcctccggagtatggggatgctgtagcttgtgcttgtgctgatgggacactgtctttgtgggaggaggttgctgaagacgataaacttccaacctggagaaagcgtaaagtctttgagggtggcaactgtcgcatactaaatgtacatttcggattacatctgggaagtctgaaaatggtcactacatactcagatggccaaatcaagatctttgagctcttggattccttggaattggacaagtggcagcttcacgcagagttccaaaatgtgatggatccagtctctagatttggaaaacctgcatgcacttctgca

SEQ ID NO: 36228 - protein, 165 aa, Panicum virgatum
  misc_feature: Ceres CLONE 1965894
  misc_feature (41)..(81): Pfam Name: WD40 Pfam Description: WD domain, G-beta repeat
MAERRVAELGPGAACCGWNHCGRRLASGAVDGSVSVYDSHPSPSSKWQAHEQAIVNVVWLPPEYGDAVACACADGTLSLWEEVAEDDKLPTWRKRKVFEGGNCRILNVHFGLHLGSLKMVTTYSDGQIKIFELLDSLELDKWQLHAEFQNVMDPVSRFGKPACTS

SEQ ID NO: 36229 - DNA, 917 bp, Panicum virgatum
  misc_feature: Ceres CLONE 1965921
  misc_feature: Encodes the peptide sequence at SEQ ID NO. 36230
ctctctccgcctcccccattcctcatcccctgcgatccgaggccgcacccgcagccgcagggaggagaagcgatcaccttatcaggcgaggcctcgcgatctcgcgcaggagcggagatggggctcacgttcacgaagctgttcagccgcctcttcgccaagctcaagctcggcgagatcgtcaccaccatccccaccataggatttaatgttgaaactgttgagtacaagaacattagcttcactgtttgggatgttggtggtcaggacaagatccgtcccctgtggaggcactacttccagaacacccagggcctcatttttgttgtggacagcaacgacagagagcgtgttgttgaggccagagatgagctccatcgtatgctgaatgaggacgagctccgtgatgctgtgcttctggtgtttgcaaacaaacaagatcttcctaatgccatgaacgctgctgaaatcaccgacaagcttggcctgcactccctgcgccagcggcactggtacatccagagcacatgtgctacctytggtgagggtttgtatgaggggcttgattggctttccwacaacattgccaacaaggcttgaggcatcttggcagggctccaatgaatgaaaatactttggatgttggagcacatattgcctttaccatactgctatgcaccatatagttgtgactgagataatgtgggggtgttttggggaggataaggctcctttgtcaaaggagctagttatcagatgttttcgtgggtattgttaattgcccactcttctgttttggtctgtgcaaagtttactgtatgtcgtgctgtgtacccttcagtatgaggcgttgtagtgttcgacttgcctcttggcatgactagcttaatggtcgcgtagtttgttgtgtgcagcat

SEQ ID NO: 36230 - protein, 160 aa, Panicum virgatum
  misc_feature: Ceres CLONE 1965921
  misc_feature (1)..(156): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature (141)..(141): Xaa is any aa, unknown, or other
  misc_feature (154)..(154): Xaa is any aa, unknown, or other
MGLTFTKLFSRLFAKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATXGEGLYEGLDWLSXNIANKA

SEQ ID NO: 36231 - DNA, 608 bp, Panicum virgatum
  misc_feature: Ceres CLONE 1965944
  misc_feature: Encodes the peptide sequence at SEQ ID NO. 36232
aatagaagcgaggaggaccagccaagccgccccccggcgaggcatccccaatggctgctgcagctttgcccgccgcggccgctcccgcttttccccacctcttctccatctcctcctgatccccttccacttctccccatcccctcctcctcttccttcctccacgccagtttgttccgcaactgtcgcagtcgccgccgccgcattgggagccgaggagaggggacgaaatggagcagtacgagaagcaggagaagattggggagggcacctatggggtggtgtacaaggcggtggacaaggtcaccaacgagttcatcgcgctcaagaagatccgcctcgagcaggaggatgagggcgtcccatccaccgccatccgcgagatctctctcctcaaggagatgaaccacggcaacatcgtcaggttacatgatgttatccacagcgagaaacgcatatatcttgtcttcgaatacctggatctggacctcaagaagttcatggattcttgcccggactttgcgaaaacccccactttgattaagtcctacctctaccagatactccgtggcattgcctactgccattctcatagagttcttcatcga

SEQ ID NO: 36232 - protein, 125 aa, Panicum virgatum
  misc_feature: Ceres CLONE 1965944
  misc_feature (4)..(125): Pfam Name: Pkinase Pfam Description: Protein kinase domain
  misc_feature: SWISSPROT Homolog: EC 2.7.11.22 Cyclin-dependent kinase
  misc_feature: Functional homolog of the protein sequence given in SEQ ID NO 51518
  misc_feature: Useful for making plants with modulated growth rate
MEQYEKQEKIGEGTYGVVYKAVDKVTNEFIALKKIRLEQEDEGVPSTAIREISLLKEMNHGNIVRLHDVIHSEKRIYLVFEYLDLDLKKFMDSCPDFAKTPTLIKSYLYQILRGIAYCHSHRVLH

SEQ ID NO: 36233 - DNA, 635 bp, Panicum virgatum
  misc_feature: Ceres CLONE 1965952
  misc_feature: Encodes the peptide sequence at SEQ ID NO. 36234
taccatccccgccagccggcacgaagcgcggcgttaatatctccacccctcccgtctcctcccctccccccatcctcctcctcccccgatccccaaatcctcctccggatttcgcactcagccgcggcgcaggtggtgaagggaggcagagaggggaaacatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgagaccgttgagtacaagaacattagcttcaccgtctgggatgtcgggggtcaggacaagatcagacccctctggaggcattacttccagaacacacagggtcttatctttgttgtggacagcaacgaccgtgaccgtgttgttgaagccagagatgagctccacaggatgctgaacgaggatgagctacgtgatgctgtgctgcttgtttttgccaacaagcaagatcttcccaacgctatgaatgctgctgagatcaccgacaagcttggattacactccctgcgccagcgacactggtacatccagagcactt

SEQ ID NO: 36234 - protein, 158 aa, Panicum virgatum
  misc_feature: Ceres CLONE 1965952
  misc_feature (5)..(158): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQST

SEQ ID NO: 36235 - DNA, 587 bp, Panicum virgatum
  misc_feature: Ceres CLONE 1965976
  misc_feature: Encodes the peptide sequence at SEQ ID NO. 36236
aattgctgataggtctgcctatgacttgcgtgcacactcggataaaagtggtgagaaacttgaagcacatgaaaagtttgcagaacccagagaagtggagaaactagttataaccccatcaaagaaggagcttggccttgcattcaaagggaaccagaggatggttcttgaagcattggaagcaatgggtgagactgaagctttggagatgaaagctgcgttggagtccaagggggaggttgagttcaaggtgtgcacccttgggaaggatgttacgataaagaaaagcatggtttcaattaatattgagaagaaaaaagaacaccaaaggaaatttactccttccgtcattgaaccatcctttgggattgggcgcattatatactgcctttttgagcactgtttctaccaaaggcctggcaaggcagaggatgagcagttaaatgtgtttggtttcccccctcttgttgccccaataaagtgcactgtctttccactggtgaagcttgagaaatttgaggttgttgccaagaaaatctcaaaggccttgacagcagcaaggatttcacatattatcgacattgaca

SEQ ID NO: 36236 - protein, 195 aa, Panicum virgatum
  misc_feature: Ceres CLONE 1965976
  misc_feature: SWISSPROT Homolog: EC 6.1.1.14 Glycine--tRNA ligase
IADRSAYDLRAHSDKSGEKLEAHEKFAEPREVEKLVITPSKKELGLAFKGNQRMVLEALEAMGETEALEMKAALESKGEVEFKVCTLGKDVTIKKSMVSINIEKKKEHQRKFTPSVIEPSFGIGRIIYCLFEHCFYQRPGKAEDEQLNVFGFPPLVAPIKCTVFPLVKLEKFEVVAKKISKALTAARISHIIDID

SEQ ID NO: 36237 - DNA, 561 bp, Panicum virgatum
  misc_feature: Ceres CLONE 1966013
  misc_feature: Encodes the peptide sequence at SEQ ID NO. 36238
agctagctgatgtcctgcggttaagcatgcttctgccatctgatgatgggatgttgaggctgttcaagacgtttgatgtcgacggtgacgaaaagatcagcagggatgacttcctcacatgccttgggaggttccccttcctgatagcgttctttgcagccccgatcaatggggaggtgtacatcgagatagtctgaatgtttgaagtggtggcgtgtaagagtaggctggagccggacagacgctgagacgctggcaggggatccctccgtttatgcaatgggatacccactacggctcctccattttgaaactcaaacccaaaacatccttattcttcggtggcatcaagtggctaaccagtatagtgcgacagttttgtttcgtttcttcgttgaaattattgttttcatttcagaaaccttcagtgagatactcgccggactctacttgtggtagtagaatatcgatcgagctgagagtgcacatagaaaagatttgtaatctgaactcttgtaaacaagacatttttgggcaaagaatgactgtagagttggttcc

SEQ ID NO: 36238 - protein, 64 aa, Panicum virgatum
  misc_feature: Ceres CLONE 1966013
  misc_feature (16)..(44): Pfam Name: efhand Pfam Description: EF hand
LADVLRLSMLLPSDDGMLRLFKTFDVDGDEKISRDDFLTCLGRFPFLIAFFAAPINGEVYIEIV

SEQ ID NO: 36239 - DNA, 495 bp, Panicum virgatum
  misc_feature: Ceres CLONE 1966020
  misc_feature: Encodes the peptide sequence at SEQ ID NO. 36240
aaaaaccctagccgccggtaccgtcctgaaccccttctcgcctcttctccgctacgctcctcggccatcatccgggctcatcccgcgcgtggattcaagatgtatctccagtactacatcaacgagaagggggacaaggtctacacaaccaagaaggagtcgcctctaggtgtgccgacgcagtctgctcatccggctcgcttctcaccagatgacaagtactctcgccagcggtacctgttgaagaagagatttggactgctgccaacccagaagccagcaccaaagtactgaagtttcaactgtccaaccatatggatgttcaggagaatatcatctgtttcgcagcttgttggttgtaatgtagattagctatctgagaaaaaaaaatcaaacactactaggcgctaccatggtatttctcagcacattcagatgctatgtaatgctattgacagatcgtgcttcctaatgttatgttactctttgggtctc

SEQ ID NO: 36240 - protein, 64 aa, Panicum virgatum; identical to SEQ ID NO: 25837
  misc_feature: Ceres CLONE 1966020
  misc_feature (3)..(53): Pfam Name: Nop10p Pfam Description: Nucleolar RNA-binding protein, Nop10p family

SEQ ID NO: 36241 - DNA, 353 bp, Panicum virgatum
  misc_feature: Ceres CLONE 1966033
  misc_feature: Encodes the peptide sequence at SEQ ID NO. 36242
aagccaagacgccaccccctcctcccctacacacacgccgcaggcgcgcgcctcccgcacaaaggaaacgaacgaggccatggcgcctagaacgtcggagaaaacgatggcaccggcggcggccccggggctcgcgctcggcgtcggcggcggcggcggcccgcacttccgcggcgtcaggaagcgcccgtggggccggttcgcggcggaaatccgcgaccctgcctagaggaaccgcgtgtggctcggagggctcaaccctgccgaggatggcgcgcgggcctacgacccccccccacgcgagtttcgcggagcccagggatagacctacttcgccttgccttcgtcggcgt

SEQ ID NO: 36242 - protein, 49 aa, Panicum virgatum
  misc_feature: Ceres CLONE 1966033
  misc_feature: The sequence is a functional homolog of SEQ ID NO 2220 in the 10/374,780 US patent application
  misc_feature: The sequence is a functional homolog of SEQ ID NO 500 in the 10/225,066 US patent application
  misc_feature: Functional homolog of the protein sequence given in SEQ ID NO 51519
  misc_feature: Useful for making plants with altered lignin content
  misc_feature: Functional homolog of the protein sequence given in SEQ ID NO 50824
  misc_feature: Useful for making plants with altered alkaloid content
  misc_feature: Functional homolog of the protein sequence given in SEQ ID NO 50251
  misc_feature: Useful for making plants with altered oil content
  misc_feature: The sequence is a functional homolog of SEQ ID NO 489 in the 10/374,780 US patent application
  misc_feature: The sequence is a functional homolog of SEQ ID NO 682 in the 10/666,642 US patent application
  misc_feature: The sequence is a functional homolog of SEQ ID NO 989 in the 10/412,699 US patent application
  misc_feature: Functional homolog of the protein sequence given in SEQ ID NO 51225
  misc_feature: Useful for making plants with altered cell wall content and/or composition
  misc_feature: The sequence is a functional homolog of SEQ ID NO 1158 in the 10/374,780 US patent application
  misc_feature: The sequence is a functional homolog of SEQ ID NO 1361 in the 10/412,699 US patent application
  misc_feature: The sequence is a functional homolog of SEQ ID NO 1448 in the 10/666,642 US patent application
  misc_feature: The sequence is a functional homolog of SEQ ID NO 1789 in the 11/479,226 US patent application
  misc_feature: The sequence is a functional homolog of SEQ ID NO 1862 in the 10/412,699 US patent application
  misc_feature: The sequence is a functional homolog of SEQ ID NO 274 in the 10/374,780 US patent application
  misc_feature: The sequence is a functional homolog of SEQ ID NO 998 in the 10/225,066 US patent application
  misc_feature: Functional homolog of the protein sequence given in SEQ ID NO 51520
  misc_feature: Useful for making plants with modulated biomass
MAPRTSEKTMAPAAAPGLALGVGGGGGPHFRGVRKRPWGRFAAEIRDPA

SEQ ID NO: 36243 - DNA, 608 bp, Panicum virgatum
  misc_feature: Ceres CLONE 1966053
  misc_feature: Encodes the peptide sequence at SEQ ID NO. 36244
cacgactcctgagctgtgctgtgctgtgctgcttggctccttccattccactaccaccttcgccaatcatccaccccaccacccgtcgccgtcgcctccgccttttgccctctcgccctcccccttcccgatcctccacctctcccgtcgcgagcaggacggcggagcaggagggcggcgacgccgaggggatgtcgggggcgtggggcggcaccacgcagaagtgcgcgtcgtgcggccggacggtctaccccgtcgaggaactcgccgccgacgggcgcgtctaccaccgcccctgcttccggtgccaccactgcaagagcacgctccagtttagtaattattcttctgttgaaggtgtcttgtactgcaagcctcactatgaccagatactgaagtcaacaggaagtttggacaaaagttttgaaggtgtgtccagatcagctaagccagaaaaatcaaatggacataaggggcagcaaagaagtaaattctctagcatgtttgttggcacacaggataagtgcgtagtttgtaccaagactgtgtaccctcttgaaaaggtcagtcttactcttctacttcaataaagtaaaagatgtcctggc

SEQ ID NO: 36244 - protein, 132 aa, Panicum virgatum
  misc_feature: Ceres CLONE 1966053
  misc_feature (12)..(67): Pfam Name: LIM Pfam Description: LIM domain
  misc_feature: SWISSPROT Homolog: EC 2.7.11.1 Non-specific serine/threonine protein kinase
  misc_feature: Functional homolog of the protein sequence given in SEQ ID NO 50126
  misc_feature: Useful for making plants with altered carbohydrate content
  misc_feature: Functional homolog of the protein sequence given in SEQ ID NO 50127
  misc_feature: Useful for making plants with modulated heat sensitivity
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
  misc_feature: The sequence is a functional homolog of SEQ ID NO 1308 in the 11/479,226 US patent application
  misc_feature: The sequence is a functional homolog of SEQ ID NO 612 in the 10/412,699 US patent application
MSGAWGGTTQKCASCGRTVYPVEELAADGRVYHRPCFRCHHCKSTLQFSNYSSVEGVLYCKPHYDQILKSTGSLDKSFEGVSRSAKPEKSNGHKGQQRSKFSSMFVGTQDKCVVCTKTVYPLEKVSLTLLLQ

SEQ ID NO: 36245 - DNA, 745 bp, Panicum virgatum
  misc_feature: Ceres CLONE 1966128
  misc_feature: Encodes the peptide sequence at SEQ ID NO. 36246
ctccttcaccttcaatagtgggtactctccacggccgccgccattagtgctccgtagagagggagggagagagagagagagagaaaagctacccgcgcttcctgatcgagctgcgtatacacgcgatcgatttctctctcctggcctgggtcgctagctagggttcaattcgattccatggatcagggcttcgggaatctcggggtcggagggagcagcagcgggggctccaactccgccaacgcggcggcgtcctcctccttcctgcagctgccgctgcccacggcggcggccgcggggccggcgtactacggcacgccgctcgcgctcctgcaccaggccgccgggccgtcgtcgtcgccgtcgccgtacggcaagcacgcggcggccgagatctcgccggcggaggccgaggccatcaaggccaagatcgtggcgcacccgcagtactcggcgctcctcgccgcctacctcgactgccaaaaagtgggcgcgccgccggacgtgctggagaggctgacggccatggcggcgaagctggacgcgcggccgccgggccggcacgagccgcgcgacccggagctcgaccagttcatggaggcctactgcaacatgctggtggagtaccgggaggagctgacccggccgatcgacgaggccatggagttcctcaagcgggtggaggcgcagctggactccatcgtcgggcgccggcgccggctcctccgccgcgcgcctctcgctc

SEQ ID NO: 36246 - protein, 189 aa, Panicum virgatum
  misc_feature: Ceres CLONE 1966128
  misc_feature (126)..(177): Pfam Name: KNOX2 Pfam Description: KNOX2 domain
  misc_feature (79)..(123): Pfam Name: KNOX1 Pfam Description: KNOX1 domain
  misc_feature: Functional homolog of the protein sequence given in SEQ ID NO 50866
  misc_feature: Useful for biocontainment applications
  misc_feature: Useful for making plants with modulated biomass
MDQGFGNLGVGGSSSGGSNSANAAASSSFLQLPLPTAAAAGPAYYGTPLALLHQAAGPSSSPSPYGKHAAAEISPAEAEAIKAKIVAHPQYSALLAAYLDCQKVGAPPDVLERLTAMAAKLDARPPGRHEPRDPELDQFMEAYCNMLVEYREELTRPIDEAMEFLKRVEAQLDSIVGRRRRLLRRAPLA

SEQ ID NO: 36247 - DNA, 617 bp, Panicum virgatum
  misc_feature: Ceres CLONE 1966152
  misc_feature: Encodes the peptide sequence at SEQ ID NO. 36248
agaggagtccaagggaaaattttggccgcaaaatatgcgcgggaaaacaacgttccgtatctcggaatttgcttgggcatgcaaattgcagtgattgaatttgcacgttctatcatgaagttgaatggtgctaacagcacagaattcgatccaacaacaaaaacaccatgcgttattttcatgcctgagggatccaaaacccatatgggtgcaacaatgcgccttggatcaaggaggacctattttcatgtcaataaatgcaaatctgctaagctgtatggcaacgctagctatgttgatgaaaggcaccgccacagatacgaggtgaatcctgatatggtcccagaatttgagaaggcagggctttctttcgttggcagggacgaaagcgggagacgaatggagataattgaactgccaactcataggttttttgttggcgcacaatttcaccctgaattcaagtcaaggcctggcaaaccttctccacttttcctaggattgatagcagcagcatcgggtcagcttgatcacctgcttcaacgcccctgcggcgttttcagtccaacaggcagatgcacctgttttcccacggacctcataagctaaaagtgtac

SEQ ID NO: 36248 - protein, 202 aa, Panicum virgatum
  misc_feature: Ceres CLONE 1966152
  misc_feature (1)..(171): Pfam Name: GATase Pfam Description: Glutamine amidotransferase class-I
  misc_feature: SWISSPROT Homolog: EC 6.3.4.2 CTP synthase
RGVQGKILAAKYARENNVPYLGICLGMQIAVIEFARSIMKLNGANSTEFDPTTKTPCVIFMPEGSKTHMGATMRLGSRRTYFHVNKCKSAKLYGNASYVDERHRHRYEVNPDMVPEFEKAGLSFVGRDESGRRMEIIELPTHRFFVGAQFHPEFKSRPGKPSPLFLGLIAAASGQLDHLLQRPCGVFSPTGRCTCFPTDLIS

SEQ ID NO: 36249 - DNA, 576 bp, Panicum virgatum
  misc_feature: Ceres CLONE 1966169
  misc_feature: Encodes the peptide sequence at SEQ ID NO. 36250
tatcaccgccagtcacccaccccccacaacactcgagagaccctcccaaagtcccaaaggccgccgccgccgccatggccgcgcagaccttcctcttcgcgacgcccgccgccctcttcgccgccccctcttcctccgcacgccctttccactcgctccgcctcgtcgctgggcccgggggtgccgccgccgccagggcgctcgtcctcgccgacgccaccaagaaggccgtcgccgtcctcaagggcacatccgaggtcgagggcgtcgtcacgctcacgcaggaggacgacggaccaaccactgtcaacgtccgtgtcactggacttactcctggacttcatggcttccaccttcacgagtttggcgataccaccaatggatgcatatccacaggaccacatttcaacccaaacaatttgacacacggtgcgccagaagatgaagtccgccatgcgggtgacctgggaaacattgttgccaatgctgagggagtcgctgaggcaaccattgttgataatcagattcctttgagcggcacaaattcagttgttggggagagcatttgtggttcac

SEQ ID NO: 36250 - protein, 167 aa, Panicum virgatum
  misc_feature: Ceres CLONE 1966169
  misc_feature (49)..(166): Pfam Name: Sod_Cu Pfam Description: Copper/zinc superoxide dismutase (SODC)
  misc_feature: SWISSPROT Homolog: EC 1.15.1.1 Superoxide dismutase
MAAQTFLFATPAALFAAPSSSARPFHSLRLVAGPGGAAAARALVLADATKKAVAVLKGTSEVEGVVTLTQEDDGPTTVNVRVTGLTPGLHGFHLHEFGDTTNGCISTGPHFNPNNLTHGAPEDEVRHAGDLGNIVANAEGVAEATIVDNQIPLSGTNSVVGESICGS

SEQ ID NO: 36251 - DNA, 674 bp, Panicum virgatum
  misc_feature: Ceres CLONE 1966202
  misc_feature: Encodes the peptide sequence at SEQ ID NO. 36252
gcacagcactgcagaaccatctcacctccctcgccgtcgcctcccagatcttccaatggcgtcagagaagaagcagtcgaacccgatgcgggagatcaaggtccagaagctcgtgctcaacatctccgtcggcgagagcggtgatcgcctcacccgtgccgccaaggtgctcgagcagctgagtgggcagtcaccggtgttctccaaggcgaggtacactgtgaggtcgtttggaattaggcgtaatgagaagattgcgtgctacgtgacagtgaggggagagaaggcgatgcagctgctggagagtggcctgaaggtcaaggagtacgagctgctgaggaggaacttcagtgagaccggctgcttcgggtttggtatccaggagcacattgatcttggcatcaagtatgacccatctaccggtatctacggcatggacttctacgttgttcttgagcgtgctgggtaccgtgtcgcccgccggcgcaggtgcaagtcccgtgttggtatccagcacagggtcaccaaggaggatgccatgaagtggttccaggtcaagtacgagggtgtgatcctcaacaaggcccaagccaacacctcctaagcatcacaagagcttagccccgctttagagctcgcgttacttaagtttctctggtgggtggatttttact

SEQ ID NO: 36252 - protein, 182 aa, Panicum virgatum; identical to SEQ ID NO: 12122
  misc_feature: Ceres CLONE 1966202
  misc_feature (66)..(165): Pfam Name: Ribosomal_L5_C Pfam Description: ribosomal L5P family C-terminus
  misc_feature (9)..(62): Pfam Name: Ribosomal_L5 Pfam Description: Ribosomal protein L5

SEQ ID NO: 36253 - DNA, 559 bp, Panicum virgatum
  misc_feature: Ceres CLONE 1966209
  misc_feature: Encodes the peptide sequence at SEQ ID NO. 36254
aaaaaggagagagagaagcacgcgcagcatccgttccttgccgctgccgctgcactctcccatagtccatagcagaacccccaccccgcgcaaaagcagagcaaccactttcccctcccgccccccatctcagtcctcctccatggcgagatcgacgcgcggcgcgctcctcctcctcctcgcgctcctggcgctggcagcggcggcccgcgcgggcgacgtgccggcggcgctgggctgggagctcggggtggtgggcgccgcagaggacgaggagttcggcttccccgccggcggcgactccgtggcgcgccgggtgctgcagggcgggcccgggtacatcagctacggcgcgctgcggagggacaacgtgccgtgctccgtgcggggggcctcctactacaactgccgccccggcgcgcaggccaacccctactcgcgcggctgctccgccatcgcccgctgccgcggctgatccgcccgcccgcttcagcgcaggcggccggcgactgccgggaggacgaggagaaggttcaattcatcccgttagtccctcgcc

SEQ ID NO: 36254 - protein, 110 aa, Panicum virgatum; identical to SEQ ID NO: 15978
  misc_feature: Ceres CLONE 1966209
  misc_feature (44)..(110): Pfam Name: RALF Pfam Description: Rapid ALkalinization Factor (RALF)

SEQ ID NO: 36255 - DNA, 662 bp, Panicum virgatum
  misc_feature: Ceres CLONE 1966223
  misc_feature: Encodes the peptide sequence at SEQ ID NO. 36256
accaagaattctctcagaaattcccgcgttgttttcgagcccagatccccgtcgccgcctccccctccgcagccccccaacccgatggcccgcacgaagcagacggcgcgcaagtccaccggcggcaaggcgccgcggaagcagctggcgacgaaggcggcgcgcaagtcggccccggcgaccggcggcgtgaagaagccgcaccgcttccgcccgggcaccgtcgcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgcggaggcctacctcgtcgggctcttcgaggacaccaacctctgcgccatccacgccaagcgcgtcaccatcatgcccaaggacatccagctcgcccgccgcatccgcggggagcgcgcctaggcgcctcgcttgattgctaccactagtgctaggtgtttaggctgctgtcgtcgtgttctaggtgttgcgttgttcttcagttatttgcttcctgctttgtgttgatgctatcgatggattataattgttagtggagaaatgcagtggaagtgatctactttatcatc

SEQ ID NO: 36256 - protein, 136 aa, Panicum virgatum; identical to SEQ ID NO: 10238
  misc_feature: Ceres CLONE 1966223
  misc_feature (58)..(132): Pfam Name: Histone Pfam Description: Core histone H2A/H2B/H3/H4

SEQ ID NO: 36257 - DNA, 641 bp, Panicum virgatum
  misc_feature: Ceres CLONE 1966229
  misc_feature: Encodes the peptide sequence at SEQ ID NO. 36258
gataaataaccccctccacccccaaatccatcaaccccgcacaccaatcctcttccaacgcttcctcctcctccaaattccatctccgagcggtcgcggcgagagaagcttccggtttcggcgatgtcggggcgcggcaagggcggcaaggggctgggcaagggcggcgccaagcgccaccgcaaggtgctccgcgacaacatccagggcatcaccaagccggccatccggaggctggccaggaggggcggcgtcaagcgcatctccgggctcatctacgaggagacccgcggggtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggtcggttccccttctggtggcgaaggcgaactacatgcggtgggctgtgtgttctggtctagtgtagtcagtgttctctgtatcgaactatcgatgctgtgtcgtggtggttgtactctgctcttcgagtaggtgttcgaatttctactccgtctgctgtaatatctagttgctttaatcaatgcaaaatccttggttctagcctc

SEQ ID NO: 36258 - protein, 103 aa, Panicum virgatum; identical to SEQ ID NO: 12044
  misc_feature: Ceres CLONE 1966229
  misc_feature (25)..(94): Pfam Name: Histone Pfam Description: Core histone H2A/H2B/H3/H4

SEQ ID NO: 36259 - DNA, 482 bp, Panicum virgatum
  misc_feature: Ceres CLONE 1966240
  misc_feature: Encodes the peptide sequence at SEQ ID NO. 36260
ttttctccgatccaagggtttcctcgcgccgctgccgccgccgcttccgtcttcgccgccgccgcagccatgccgtcccacaagaccttccggatcaagaagaagctggccaagaagcagcgccagaaccgccccatcccctactggatccgcatgcgcaccgacaacaccatcaggtacaacgcgaagcgcaggcactggcgccgcaccaagctcggattctgagcgggggaagagacgccgggcaccgatgctaggcgaaactggggcttacgagctggcctggggacgctttccatgtttccgcatgctagggagttcttgtttagattttgcttgtgttgaattgatcttatcagttgttcctgtagcgtactgagaataccatggtttgctaatggttgatgaacatcctttataattttgcagaagctatcttggtctgccatgtgttaatccggacagcttttttgcctttctgt

SEQ ID NO: 36260 - protein, 51 aa, Panicum virgatum; identical to SEQ ID NO: 9830
  misc_feature: Ceres CLONE 1966240
  misc_feature (9)..(51): Pfam Name: Ribosomal_L39 Pfam Description: Ribosomal L39 protein

SEQ ID NO: 36261 - DNA, 460 bp, Panicum virgatum
  misc_feature: Ceres CLONE 1966253
  misc_feature: Encodes the peptide sequence at SEQ ID NO. 36262
attgctgaccgcatcaacaagatgcttgcggtgctcgacaccaacatcctttgggtgaaccctgactgcggtctcaagacccgcaagtacaccgaggtcaagcctgccctgaccaacatggtctccgccgccaagctcatccgcacccagctcgccagcaccaagtgagaactctccctgcagcggctttttcattcaattacaaggagggtgttcatcaaagccatttgtcttgaataatctgggtcttgtgaatccgctccatctgtggttagcttagttcttttttttcttggcacgatgatcacaccctgcttatacctctgctactcttacgaatttggtagttttgaggcaagttgcccgtgtacttgtattgtaaaaccggttggatatctgcagtgtttcatctgcaactctgaggtgtgttatggctcgtattaatgatctttgtccccgg

SEQ ID NO: 36262 - protein, 55 aa, Panicum virgatum
  misc_feature: Ceres CLONE 1966253
  misc_feature: SWISSPROT Homolog: EC 2.1.1.14 5-methyltetrahydropteroyltriglutamate--homocysteine S-methyltransferase
  misc_feature: Functional homolog of the protein sequence given in SEQ ID NO 51318
  misc_feature: Useful for making plants with altered cell wall content and/or composition
IADRINKMLAVLDTNILWVNPDCGLKTRKYTEVKPALTNMVSAAKLIRTQLASTK

SEQ ID NO: 36263 - DNA, 669 bp, Panicum virgatum
  misc_feature: Ceres CLONE 1966268
  misc_feature: Encodes the peptide sequence at SEQ ID NO. 36264
agaacagcggcatccggcaaaatcgagcgaccaccatttttcttcttcttccacatcagtcaaaatgatggcccggtcttgctcgtccatgcttcttgtcgctgtggcgctcgtcctcgccgcgccgttggcgctcgccggcgacccggactacctccaggacctctgcgtcgccgacctcaactccgagatcaaggtgaacgggttcccctgcaaggcgaacgccgccgcggacgacttcttctccaacgtcatcgcgaagcccggcaccattaccagccccgccggctccgtggtcaccggcgccaacgtcgagaagatcccaggtctcaacacgctgggtgtctccctcgcccgcatcgactacgcgccgggcggccttaacccgccgcacacgcacccgcgcgccaccgagctcatcttcgtgctctacggcacgctcgacgtcggcttcatcaccaccgctaacaagctcgtggccaataccgtcaccgccggcgacgtcttcgcgttcccgcgcggactcgtgcacttccagaagaaccccggcgaggagcccgccgccgtcgtgtcggcgttcaacagccagctccccggcacgcagtccatcgccatgacgctgttccgggcctcgccggaagtgtcctcccgacgtgctcgccaaggcgt

SEQ ID NO: 36264 - protein, 201 aa, Panicum virgatum
  misc_feature: Ceres CLONE 1966268
  misc_feature (60)..(199): Pfam Name: Cupin_1 Pfam Description: Cupin
  misc_feature (97)..(172): Pfam Name: Cupin_2 Pfam Description: Cupin domain
  misc_feature: SWISSPROT Homolog: EC 1.15.1.1 Superoxide dismutase
  misc_feature: Functional homolog of the protein sequence given in SEQ ID NO 50204
  misc_feature: Useful for making plants with modulated nitrogen use efficiency
MMARSCSSMLLVAVALVLAAPLALAGDPDYLQDLCVADLNSEIKVNGFPCKANAAADDFFSNVIAKPGTITSPAGSVVTGANVEKIPGLNTLGVSLARIDYAPGGLNPPHTHPRATELIFVLYGTLDVGFITTANKLVANTVTAGDVFAFPRGLVHFQKNPGEEPAAVVSAFNSQLPGTQSIAMTLFRASPEVSSRRARQG

SEQ ID NO: 36265 - DNA, 430 bp, Panicum virgatum
  misc_feature: Ceres CLONE 1966333
  misc_feature: Encodes the peptide sequence at SEQ ID NO. 36266
ggatcgcatctcctattcccccctcgctctcggttgtgtgactgattgccgagaagggtctctgcctggatgtgttccaacccctcaatctcgctaggatgtcgtgctgcggaggcaactgcgggtgcggctcctgctgcaagtgcggctccggctgcggagggtgtgatatgtacccggacatgattgagcaaggcaccaccatcaccagccagactgtcatcatgggcgttgcaccaaccaacaaggagcacgcccagggccgatttgaagccagcgccggaaccgacaacggctgcaagtgcggagcctactgcacctgcaacccctgcacctgtaagtgaggatctcacggccatggccagaaccgaggagatctgaacctactatagcggcgttgtgtgtacgtcgttctatttgtctgaaagtg

SEQ ID NO: 36266 - protein, 81 aa, Panicum virgatum
  misc_feature: Ceres CLONE 1966333
  misc_feature (1)..(80): Pfam Name: Metallothio_2 Pfam Description: Metallothionein
MSCCGGNCGCGSCCKCGSGCGGCDMYPDMIEQGTTITSQTVIMGVAPTNKEHAQGRFEASAGTDNGCKCGAYCTCNPCTCK

SEQ ID NO: 36267 - DNA, 601 bp, Panicum virgatum
  misc_feature: Ceres CLONE 1966343
  misc_feature: Encodes the peptide sequence at SEQ ID NO. 36268
ctagggttttagtccgaagaagaaggggagctatggcggcggcggacgtggagtaccgttgcttcgtcggcggcctcgcctgggccaccaacaacgactccctccagcacgccttcgcctcctacggcgaggtcctcgactccaaggtcatcaccgaccgtgagacggggaggtctcgtggcttcggcttcgtcaccttctcctcagagcagtcgatgctcgacgccatcgaggcaatgaacggcaaggagctcgacggccgcaacatcaccgtcaaccaggcccagtcccgcggcggcggtggtggtggcggctacggtggcggtcgcggcggtggcggctacggcggtggtggtggctacggaggaggcggcggtggctacggcggccgtcgcgagggcggatacggcggcggcggtggctacggaggcagcggtggtggcggctacggcggtcgccgcgagggcggctacggcggtggtggtggctacggcagccgcggtgactccggtggcaactggaggaactgatggggtggcccttccgtgctggcaaccaagttatcctagttttctattagtgtccgtttgatcccgagtta

SEQ ID NO: 36268 - protein, 165 aa, Panicum virgatum
  misc_feature: Ceres CLONE 1966343
  misc_feature (10)..(81): Pfam Name: RRM_1 Pfam Description: RNA recognition motif. (a.k.a. RRM, RBD, or RNP domain)
  misc_feature (48)..(157): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
MAAADVEYRCFVGGLAWATNNDSLQHAFASYGEVLDSKVITDRETGRSRGFGFVTFSSEQSMLDAIEAMNGKELDGRNITVNQAQSRGGGGGGGYGGGRGGGGYGGGGGYGGGGGGYGGRREGGYGGGGGYGGSGGGGYGGRREGGYGGGGGYGSRGDSGGNWRN

SEQ ID NO: 36269 - DNA, 626 bp, Panicum virgatum
  misc_feature: Ceres CLONE 1966373
  misc_feature: Encodes the peptide sequence at SEQ ID NO. 36270
ctctctccgcctcccccatcctctacaagctcaagctcggcgagatcgtcaccaccatccccaccataggatttaatgttgaaactgttgagtacaagaacattagcttcactgtttgggatgttggtggtcaggacaagatccgtcccctgtggaggcactacttccagaacacccagggcctcatttttgttgtggacagcaacgacagagagcgtgttgttgaggccagagatgagctccatcgtatgctgaatgaggacgagctccgtgatgctgtgcttctggtgtttgcaaacaaacaagatcttcctaatgccatgaacgctgctgaaatcaccgacaagcttggcctgcactccctgcgccagcggcactggtacatccagagcacatgtgctacctctggtgagggtttgtatgaggggcttgattggctttccaacaacattgccaacaaggcttgaggcatcttggcagggctccaatgaatgaaaatactttggatgttgggagcacatattgcctttaccatactgctatgcaccatatagttgtgactgagataatgtgggggtgttttggggaggataaagctcctttgtcaaaggagctagttatcagat

SEQ ID NO: 36270 - protein, 154 aa, Panicum virgatum
  misc_feature: Ceres CLONE 1966373
  misc_feature (1)..(150): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
LSASPILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 36271 - DNA, 484 bp, Panicum virgatum
  misc_feature: Ceres CLONE 1966416
  misc_feature: Encodes the peptide sequence at SEQ ID NO. 36272
gctaacgccgcagtcatcagctcgcgttcgctatccaatccgccgaaccctccccgcctcctcgcgccgcccgtccgccgcccccgctccgatgggccgcacgaactgcaccgggcgcacgtcgaccggcggcaaggcgcctaggaagtcgctggccaccaaggccgcgcgcacgtccgcgccggccaccggcggcgtgaagaccccgcgccgattccgccccggcaccgtcgcgctccgagagatgcgcaagtaccaaaagatcacggagctgctcatccggaagctccccttccaacggttggtgcggcagatcgcgcaggacttcaagacggacctcctgttcccgtcctccgccgtcgacgcgctgcctgaggccgcgcaggcgtacctggtgaggctctacgaggactccaacctgtgccccatccgcgccaagtgcgtcatcatcatgcccaaggatacccggctccctcgccgcaat

SEQ ID NO: 36272 - protein, 130 aa, Panicum virgatum
  misc_feature: Ceres CLONE 1966416
  misc_feature (58)..(130): Pfam Name: Histone Pfam Description: Core histone H2A/H2B/H3/H4
MGRTNCTGRTSTGGKAPRKSLATKAARTSAPATGGVKTPRRFRPGTVALREMRKYQKITELLIRKLPFQRLVRQIAQDFKTDLLFPSSAVDALPEAAQAYLVRLYEDSNLCPIRAKCVIIMPKDTRLPRR

SEQ ID NO: 36273 - DNA, 640 bp, Panicum virgatum
  misc_feature: Ceres CLONE 1966430
  misc_feature: Encodes the peptide sequence at SEQ ID NO. 36274
aagtctcgccgcgcgtccaccggtcggcggccgtataaagatctcctccggcgccggccattcccatccaccaccacccagccgaacaatctcagctcgccggacacgcagaattgattgaagatggccgcgtcggcgctgcaccagaccaacagcttcctcgggcaggccctggtctcccgccccgccggcggcgccgacgccggcgggcgcatcaccatgcgccgcaccgtgaagagcgcgccccagagcatctggtacggccccgaccgccccaagtacctcggcccgttctccgagcagacgccgtcgtacctgaccggcgagttccccggcgactacgggtgggacacggcggggctgtccgccgacccggagacgttcgcgcgcaaccgcgagctggaggtgatccactcgcggtgggcgatgctgggcgcgctggggtgcgtgttcccggagatcctggccaagaacggcgtcaagttcggcgaggccgtgtggttcaaggccggcgcgcagatcttctccgagggcgggctggactacctggggaacccgaacctggtgcacgcgcagagcatcctggccatctgggcgtgccaggtggtgctcatgggcttcgtcgagggctaccgcgtcg

SEQ ID NO: 36274 - protein, 172 aa, Panicum virgatum
  misc_feature: Ceres CLONE 1966430
  misc_feature (60)..(172): Pfam Name: Chloroa_b-bind Pfam Description: Chlorophyll A-B binding protein
MAASALHQTNSFLGQALVSRPAGGADAGGRITMRRTVKSAPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRV

SEQ ID NO: 36275 - DNA, 1248 bp, Panicum virgatum
  misc_feature: Ceres CLONE 1966492
  misc_feature: Encodes the peptide sequence at SEQ ID NO. 36276
gaagaataagcgctcaaacaaaagacatttcgaatccccaattcccccaaaccccctcaccttccccggcgatcgcgatggcgaacatgccggtctcggagatgcgtctccctccgcacctcgcgcacctcctcgccgcgcgcggcctcgacaccgccaaggacgtgctgtcgctgccggaggtggagctcatggccgtcctcgacgccggccttccaacctcccgcgccgccgtcgctcacgtcagcgaggccgcctgcccgccctgccagacggcgcttgcgcttctggaggagcgcttcaggctaggtggaggcgggcggctggccaccacgctctgcgggttggacgaggcgttgggcggaggaatccccatgggaaagctcactgaggtcgttgggccctcgggaatcggcaagacgcagttctgcctgaagcttgccttgttagcagcattaccagaatactgtggaggtttggacggtagagttgtgtatattgacacggaatccaagttctcttcacggaggatgattgagattggtcagaaaagctttccccaaatatttcgtcaagaaggcttggcacaaaagatggctgggaggatcctagtgacgcgaccagcatctttagctgatttcaccaagagtttggaacagatgaaggttactcttcttcagcatgatgtgaagttactcgttgttgatagcatggctgctcttatgtcattggaaaatgagaaagctacagcaggtttcagacaacatcctttaagatgggccctttcttttcttaagtctatcgcagagctctcaagaattccagttatcgttacaaaccaagtacgcagccaaagtagtgatgatggctaccatttttcctttgaagtggacaggaaggatggtaataaccgtgctgaaaagtttgattctcatcttattgctgctctagggattcagtgggctcatgctgtaactgtccgcctagtctttgagtctcattcaggccacaggttcatcaagatggcaaaatcacctatgtctccagcagtagcattccattcattgttgaatcatcaggcattacattgctaagtgatgagggcattgatgtgactggtcctgagataacctcaattcgttgtcaagggcaaaatgttctgtctcgataaaccatttgaatgccactgtatcgaacaggtgtaatcctgcactttttgttgtctaatgactatgaatagattttatt

SEQ ID NO: 36276 - protein, 338 aa, Panicum virgatum
  misc_feature: Ceres CLONE 1966492
  misc_feature (56)..(334): Pfam Name: Rad51 Pfam Description: Rad51
MANMPVSEMRLPPHLAHLLAARGLDTAKDVLSLPEVELMAVLDAGLPTSRAAVAHVSEAACPPCQTALALLEERFRLGGGGRLATTLCGLDEALGGGIPMGKLTEVVGPSGIGKTQFCLKLALLAALPEYCGGLDGRVVYIDTESKFSSRRMIEIGQKSFPQIFRQEGLAQKMAGRILVTRPASLADFTKSLEQMKVTLLQHDVKLLVVDSMAALMSLENEKATAGFRQHPLRWALSFLKSIAELSRIPVIVTNQVRSQSSDDGYHFSFEVDRKDGNNRAEKFDSHLIAALGIQWAHAVTVRLVFESHSGHRFIKMAKSPMSPAVAFHSLLNHQALHC

SEQ ID NO: 36277 - DNA, 563 bp, Panicum virgatum
  misc_feature: Ceres CLONE 1966544
  misc_feature: Encodes the peptide sequence at SEQ ID NO. 36278
ctccctgggtctctccctccctccacagatcccgattcgatcagccgccatggcccgctcctcctcgcagtcccagtcctccgtcggcggcgccggcgccggagcccgcccggccaccgttggcccccgcggcacggcagcagctgccgccggcatgcgccgccgccgcgccaccgctagcgccgggggagggggcttctccggcggcggcgggagcgacatgcttcggttctacaacgacgaggccccgggcctgcgcctctcgccaaccatggtgctcgtcatgacgctgtgcttcatcggattagtcaccgccctccacgtcttcgggaagctctaccgctccgacaccgccggagcctccgcgggatccatccccatacgcatcccatcccgacggcgcgactatcagaagatcaaggttttgaatatatcataatcagtctagttactcttgtcttgcctaacattccttcctgagctagtgctagatatgaacggagatggacggaaccctcctccttgaagtaagagatgatgtcctctctgaaggattatgcttc

SEQ ID NO: 36278 - protein, 129 aa, Panicum virgatum
  misc_feature: Ceres CLONE 1966544
  misc_feature (52)..(97): Pfam Name: Sec61_beta Pfam Description: Sec61beta family
MARSSSQSQSSVGGAGAGARPATVGPRGTAAAAAGMRRRRATASAGGGGFSGGGGSDMLRFYNDEAPGLRLSPTMVLVMTLCFIGLVTALHVFGKLYRSDTAGASAGSIPIRIPSRRRDYQKIKVLNIS

SEQ ID NO: 36279 - DNA, 618 bp, Panicum virgatum
  misc_feature: Ceres CLONE 1966623
  misc_feature: Encodes the peptide sequence at SEQ ID NO. 36280
ggtcccttctcccgtcgccgccggggtgagcgccgcccgtcccgtcccgtccctcgccgcttgcgcctccagttcacactccaagcaggcgcctcctcgcggaggattcgatccgtattcaagggggcagatagcctctcttccgccggggggagccgagatgaagccggtggtggggatcgtggtgtcgaacaagatgcagaagtcggtggtggtggcggtggaccgcctcttccaccacaaggtgtacaaccgctacgtcaagcgcacctccaagttcatggcgcacgacgaggccgacgcctgcaacatcggcgaccgggttaggctggatccttccaggcccttgagcagacgtaagtactgggttgttgctgaaattcttcgcagagctaagatgtatgttccaccatctgcaactgcatccagtgaaaatgataccaaggctcaacagtctggcgttgctaccaaatgatctgcctttagtttctttgaggaaaagacacaattgcctatgttttctgtgtatgttaacttgtggaatgtgcatgcaatgtttaatcaatagaaataacatggcatccatcatttttgccggactcagttcgctctgtagtg

SEQ ID NO: 36280 - protein, 104 aa, Panicum virgatum
  misc_feature: Ceres CLONE 1966623
  misc_feature (6)..(74): Pfam Name: Ribosomal_S17 Pfam Description: Ribosomal protein S17
MKPVVGIVVSNKMQKSVVVAVDRLFHHKVYNRYVKRTSKFMAHDEADACNIGDRVRLDPSRPLSRRKYWVVAEILRRAKMYVPPSATASSENDTKAQQSGVATK

SEQ ID NO: 36281 - DNA, 630 bp, Panicum virgatum
  misc_feature: Ceres CLONE 1966699
  misc_feature: Encodes the peptide sequence at SEQ ID NO. 36282
attttttccggccccctcttcctcgcgcggcgcctgccccccctgccggttggaagcgtgcgaagaagcagcgcggagagatggcccgtaccaagcaaaccgctcgcaagtccacgggagggaaggctcccaggaagcagcttgcaactaaggctgcccgcaagtcagccccgaccactggaggagtgaagaagccccaccgctaccgccctgggactgttgccctccgtgagatccgcaagtaccagaagagcactgagctgttgatcaggaagctgcccttccagaggcttgttagggaaattgcacaggacttcaagactgatctgcgtttccagagccatgctgtgcttgccctccaggaggctgccgaggcgtaccttgttggtctgtttgaggacaccaacctgtgcgccatccatgctaagcgtgtgaccatcatgcccaaagacattcagctggccaggaggatccgtggcgagagggcttaatcatgatcataagtttctcttctgcagcactatatgttgcgactaccgttgttggtgttattactaaggtcgtcgaatacttaaattgtctcgtctagtggtgttaccgcgttgacagtttgacatttgtgtgctttgt

SEQ ID NO: 36282 - protein, 136 aa, Panicum virgatum; identical to SEQ ID NO: 9871
  misc_feature: Ceres CLONE 1966699
  misc_feature (58)..(132): Pfam Name: Histone Pfam Description: Core histone H2A/H2B/H3/H4

SEQ ID NO: 36283 - DNA, 477 bp, Panicum virgatum
  misc_feature: Ceres CLONE 1966746
  misc_feature: Encodes the peptide sequence at SEQ ID NO. 36284
tccatccgcaaacgcaagcttcacgcacagcctctctccccgcagcttctccgccgggcttcacctgcgaacccgcctcgatcgatcagcgttccacgcggagcaggcagatggccgccacgatgaagctccggatcctcgccatcgccgtcgccgccgcgtcgtgcctggtcgcgaccgccgccgcggccgagggcccggcgcccgccccgacgtccggcgcgccgaccatggccgcgccggccgccgccgccgcgaccatgactgcgctcgacttcggctacctcttctaagaagtgccgcggacggcgttgcctgtcttgcgccatagtcttcctgctcgcagatttcttcctcgcattgccgtctttgctctggttggcgtgaatgacgggtatgtgatccggtgtacggatatcctatggaaaactcgtaacctcagtacgaagacggaatggagacatagagctgtggatc

SEQ ID NO: 36284 - protein, 60 aa, Panicum virgatum
  misc_feature: Ceres CLONE 1966746
  misc_feature: Functional homolog of the protein sequence given in SEQ ID NO 50546
  misc_feature: Useful for making plants with altered cell wall content and/or composition
  misc_feature: Functional homolog of the protein sequence given in SEQ ID NO 50462
  misc_feature: Useful for making plants with altered carbohydrate content
MAATMKLRILAIAVAAASCLVATAAAAEGPAPAPTSGAPTMAAPAAAAATMTALDFGYLF

SEQ ID NO: 36285 - DNA, 606 bp, Panicum virgatum
  misc_feature: Ceres CLONE 1966814
  misc_feature: Encodes the peptide sequence at SEQ ID NO. 36286
aggcaagcaggcgagcaagctcgaggcgacagaggcaagccaagaaaagcagcagcagcagccagccagccaagctcgccgcggctcttcttgctcgcctccgttccgttcccgagcttcgcacaagggatggagatgaagaagatcgcctgcgccgtcctcgtcgccgcctcggccaccgtggcgctcgccgcggacgccccggcgccggcccccaccagcgggtcctccgccgtcgcgcccgccgtcggcgccgcgctcggggccgccgtggcctccttcttcgcctactacattcagtgagccgccgccgccggccggccggcccgggatgaggaggaagagaccaggggggtgacatggcggcgccgattccgaacaccgcgcgcgcgttccgatgcgtgcgtgggtttcgatttgacacggctttgtcttctttttcttctctccttgatttaacgaattgatcgatgtcgctgatgcaccagtttgatttggtgccttgctatttgttctccgatcccttcgagggagagggaccgacacctgtaccattgcttgccatttgtttggatcaattcaacaattcgatttaatcatcgcgtc

SEQ ID NO: 36286 - protein, 57 aa, Panicum virgatum
  misc_feature: Ceres CLONE 1966814
  misc_feature: Functional homolog of the protein sequence given in SEQ ID NO 50462
  misc_feature: Useful for making plants with altered carbohydrate content
  misc_feature: Functional homolog of the protein sequence given in SEQ ID NO 51521
  misc_feature: Useful for making plants with altered cell wall content and/or composition
MEMKKIACAVLVAASATVALAADAPAPAPTSGSSAVAPAVGAALGAAVASFFAYYIQ

SEQ ID NO: 36287 - DNA, 638 bp, Panicum virgatum
  misc_feature: Ceres CLONE 1966817
  misc_feature: Encodes the peptide sequence at SEQ ID NO. 36288
gcagctcgtgcatcaaaaagcatcatcacttcatcagctcgctagctagcagcggcagcaatggcgttcgccaagctctccgcggtgctggtcctcgccgccgtgctcgcgctctcctcctcgccgctcgccctcgcgggggagaaagcggaaacagagtgcggctcgtgccagaaaggcacgccgccctcggccggcgggctcccgttgccccccgtcaccctgccatccgtccctctgccgtcggtgcccctgccaccagtcgccgtgccgtcgctccccctgcccccgttgccgaagctccccgtgcccgtcccgccgatcatcggtgggagcccgccgacgaagacgcccggcggccggaaggcgtgcccgccgcctccgacgcccacgcccccgaccccgacgcccccgccgtcctcggacaagtgccccatcgacgcgctgaagctgggcgcgtgcgtgaacgtcctcggcaacgaggtgcacatcggcgacgccaacgtcaagtgctgcccgctcgtgaagggcgtcgccggcctctcggccgcggcgtgcctgtgcaccgccctcaaggccaaagtgctggacctctccgtctacgtgcccatcgcgctcgaggtgctcctcaactgccg

SEQ ID NO: 36288 - protein, 192 aa, Panicum virgatum
  misc_feature: Ceres CLONE 1966817
  misc_feature (124)..(192): Pfam Name: Tryp_alpha_amyl Pfam Description: Protease inhibitor/seed storage/LTP family
MAFAKLSAVLVLAAVLALSSSPLALAGEKAETECGSCQKGTPPSAGGLPLPPVTLPSVPLPSVPLPPVAVPSLPLPPLPKLPVPVPPIIGGSPPTKTPGGRKACPPPPTPTPPTPTPPPSSDKCPIDALKLGACVNVLGNEVHIGDANVKCCPLVKGVAGLSAAACLCTALKAKVLDLSVYVPIALEVLLNC

SEQ ID NO: 36289 - DNA, 604 bp, Panicum virgatum
  misc_feature: Ceres CLONE 1966845
  misc_feature: Encodes the peptide sequence at SEQ ID NO. 36290
gcgacaaatcatcacagtgagaaccccccctctcgcccaccaccacaccagacctccggcggcggcgaccccagtcgagaacacgaaggcgacggcgatggcgacggcgctcaaccgcggcctccgctccgggatccgcctcctcgccgccggcgccgaggcgtccaagccagcttctcgtggattccatgccactggtgtgaagagaatgggagggcacggccacgatgagccgtactatctccatgccaagcacatgtacaacttgcacagaatgaagcatcaggggttgaaggtgactctttccgtgctgggagcagttagcatcggcgttggagtccctgtgtacgcagtcattttccagcagaagaagaccgcctcaggttgagcgatcatgctctcagcctacatattggagacttattttcaacaacattttgtgaagttttaagcttgattctaccttggtggttgcttattattaccatgttttcttacgagaagttgtaacctcgtttcttgccatgttttcaagtaggacacaactttctgttaataatatcgtggcttgaactttccaggctgtggagaaacctcagcagcg

SEQ ID NO: 36290 - protein, 96 aa, Panicum virgatum; identical to SEQ ID NO: 10081
  misc_feature: Ceres CLONE 1966845
  misc_feature: Functional homolog of the protein sequence given in SEQ ID NO 50154
  misc_feature: Useful for making plants with modulated nitrogen use efficiency

SEQ ID NO: 36291 - DNA, 628 bp, Panicum virgatum
  misc_feature: Ceres CLONE 1966854
  misc_feature: Encodes the peptide sequence at SEQ ID NO. 36292
ctcctccgccgtcgcctctccactttccccatccttcgccgccgtcgcggtcgcctcgcagtccgaagagccgcccccgactccgatggccagccgctgggtccgacccgaggtgagctttcctcggttgcttcgtctctctctctctctcatggggcgttgctgccgcgcaggtgtacccgctgttcgcggcgatgggcgtggccgtcggcatctgcggatttcagctcttccggaacatcaccgggaacccggaagtcagggtaaacaaggctgggagggcagctggtgtgcttgagaaccatgaggaggggaggcgttacgcaatgcacagcctcagaagctttgtgcatgacaagaccccagaaatcatgccggccatcaacaagttcttcactgagccaaagtgaagcgatttgctcgggtgctgctgctggagtcgttattgtcgagtgtacccatttaaggcattcaatatgtaatgtcacccataaattggaggacagcggatacctcttattaaaagttccgtgtgagtgattggtgatggcttgctatgtgtatgatggtttatgagtgctgcatcacccctgtttgatgttcatgctcatctgtcatgtggatttgc

SEQ ID NO: 36292 - protein, 71 aa, Panicum virgatum; identical to SEQ ID NO: 27933
  misc_feature: Ceres CLONE 1966854
  misc_feature (1)..(71): Pfam Name: B12D Pfam Description: B12D protein

SEQ ID NO: 36293 - DNA, 581 bp, Panicum virgatum
  misc_feature: Ceres CLONE 1966864
  misc_feature: Encodes the peptide sequence at SEQ ID NO. 36294
atcaaaagcgaagcagagcaggcaacaagcagcactccaccttcttcagccgcgctacctgcttccttcctcgctcgtgatcaccgagaggagatgtcttgctgcggcggcaactgggggtgcgggtccagatgcaagtgcggcaaccgatgcggcgggtgcgcgatgtcccgtgagatggaggcctcctccaccaccaccaccaccatgggcatcggcggcgccagcgcaaggcgagctcccgcgggttcgaggcggccaccgaaggcggcggctgcgactgcatcacctgcgattgcggcgccagctgcggctgctcctgctgcagctgcaactgaggcggacatggtccggcgccatgtagcacaaggaggaaggataagcccccggcggattatagagtaggatcgcgtctaaataggaacttgccaactgcggcatccatcatctatcgtgtggagtcgagacattcatggtcacctgccgtgtctcggctgggaatgtccaactgaacgtcgcggctcgatcgacgacacttgccggtcaactatctttgggtgagtgtccggcctcctctcgca

SEQ ID NO: 36294 - protein, 103 aa, Panicum virgatum
  misc_feature: Ceres CLONE 1966864
  misc_feature (1)..(65): Pfam Name: Metallothio_2 Pfam Description: Metallothionein
MSCCGGNWGCGSRCKCGNRCGGCAMSREMEASSTTTTTMGIGGASARRAPAGSRRPPKAAAATASPAIAAPAAAAPAAAATEADMVRRHVAQGGRISPRRIIE

SEQ ID NO: 36295 - DNA, 509 bp, Panicum virgatum
  misc_feature: Ceres CLONE 1967043
  misc_feature: Encodes the peptide sequence at SEQ ID NO. 36296
cacatcactgaaaccagtcacccacaaagcttccatggattcggtggcgtggagctcccttctcacagggatccttcttctacggttcaattgctgctcggcggcgggtggagaaggcccagaggaaggggaaggggtgtttccggtggtggtgggcacgtggcccttccgggaggcgatccgggcggcgtgggaggtggtttcgaccgctgatggagggggctcggcggtggatgctgtcgtcgccggctgctccgcttgcgaggttctccgctgcgatggcacagttggtccaggtggaagtccagacgagaatggtgaaactacattagatgctcttattatgaatggggccacaatggaaattggagctgtggctgccatgagatatgttaaggatggaatcaaggcagcaaaattggtcatgcagcacagcgagcatactctgcttgttggagagaaggcaacatcctttgcaatttctatgggtcttccaggacccactaacc

SEQ ID NO: 36296 - protein, 158 aa, Panicum virgatum
  misc_feature: Ceres CLONE 1967043
  misc_feature (12)..(158): Pfam Name: Asparaginase_2 Pfam Description: Asparaginase
  misc_feature: SWISSPROT Homolog: EC 3.5.1.26 N(4)-(beta-N-acetylglucosaminyl)-L-asparaginase
MDSVAWSSLLTGILLLRFNCCSAAGGEGPEEGEGVFPVVVGTWPFREAIRAAWEVVSTADGGGSAVDAVVAGCSACEVLRCDGTVGPGGSPDENGETTLDALIMNGATMEIGAVAAMRYVKDGIKAAKLVMQHSEHTLLVGEKATSFAISMGLPGPTN

SEQ ID NO: 36297 - DNA, 528 bp, Panicum virgatum
  misc_feature: Ceres CLONE 1967084
  misc_feature: Encodes the peptide sequence at SEQ ID NO. 36298
ctcctccgttgccttgccgccaccatcataggcgcattccccactcctctccgccgccgacgatcctgcgccagccgtgcgagatggtgatccagaacaacgtctgcctgctcactcccccggcggacctctagaagctctcgcgccacaagaggcgccgcgccccgtcccccgactctttcttcatggtacgtcatgtgcctcggatgcttctgcataacctctgttttcagcctctcccagactgttgtggtgtgcccgggctgcccaactgtcctctgccatcccactggaggaaaggctgggctctcggatggctgctccttccgacggaagggagactatgaatgtaatctgaagatgatgtttgttctgatccttgtttttcactttgagtatgtatccgtctaattttgtgctatactgttatgtgaaatgttacggccctgatctgctgcttactatagtgctttctatatctattcctatgttatgtactggatactactactcggtgttctgtttggc

SEQ ID NO: 36298 - protein, 71 aa, Panicum virgatum
  misc_feature: Ceres CLONE 1967084
  misc_feature (2)..(47): Pfam Name: Ribosomal_S27e Pfam Description: Ribosomal protein S27
MCLGCFCITSVFSLSQTVVVCPGCPTVLCHPTGGKAGLSDGCSFRRKGDYECNLKMMFVLILVFHFEYVSV

SEQ ID NO: 36299 - DNA, 655 bp, Panicum virgatum
  misc_feature: Ceres CLONE 1967095
  misc_feature: Encodes the peptide sequence at SEQ ID NO. 36300
gtaatccgcccgattcctgcctccctccccccccgccttccccccccccgcggggccctcctccggtcctccggcccacttgggaaaaggccgaatccgaagaacaccctttccaggccaaaggccacccccgaaccccccagaatttccccccaccgggccgccccctccgcaagaaccgaaacctcctcctccagggccccccggggaagggtggtgaagtccccccttccaaaaacgggaaacccgggcctggcaaatggcccttcctggcccttgacattttccatggaaagaaacttggagaaattgggccctcctcccataactgggaagggccccctggccaccctactgactatcaactgaatgacatatctgaagaaggatttggaagccctccgaatgaaaatggaagcacccaggaagatttgaagctccctactgaagaaactccgctttcccaaaataaagctggaatccaagaagggaaagaactgaatggtaatgggatgtctggcctgggtgaagaaccgatctgccgtctgaaagatatccgcaagaactaaaactgccttggcactggtggttggttggcccggcggctatccggggaggtggtgtggtgatgaaattagcgtggttggttaccaat

SEQ ID NO: 36300 - protein, 188 aa, Panicum virgatum
  misc_feature: Ceres CLONE 1967095
  misc_feature (118)..(183): Pfam Name: eIF-5a Pfam Description: Eukaryotic initiation factor 5A hypusine, DNA-binding OB fold
NPPDSCLPPPPPSPPPRGPPPVLRPTWEKAESEEHPFQAKGHPRTPQNFPPPGRPLRKNRNLLLQGPPGKGGEVPPSKNGKPGPGKWPFLALDIFHGKKLGEIGPSSHNWEGPPGHPTDYQLNDISEEGFGSPPNENGSTQEDLKLPTEETPLSQNKAGIQEGKELNGNGMSGLGEEPICRLKDIRKN

SEQ ID NO: 36301 - DNA, 1185 bp, Panicum virgatum
  misc_feature: Ceres CLONE 1967127
  misc_feature: Encodes the peptide sequence at SEQ ID NO. 36302
aaaaattgccagcccatccaagacccagtttctgagttcctcgtcttcatcatccgttgttcatcgtcaatcccctgtgctgtgacctgtgactgtgagcgagccgacgaatccggccggagtcccctcgtccctgcagctgtgcagcccaagcctgaacaccgaacagaagaggaggtctgtgcgcgaagcagcgccccgactcccgagcccccgaccgacagtgtcatgcgcgagcctgcacaagcctccaatcttctccgccgctccagcacctggagccctagaggcagcttccagtaatccagttttggctctcgttgcagcttaaatttctccgttttccttcaaaagagatctctgttcgatttgccaaatcggaggaccaaagttgcacttggaactacttaaaggggatgcttctcaacacacctagtatttcctggcggtgttgtacttcatggaacatgtattctgagtctaggaagttaccaggatggttgactcaaagagttgatttatggaattcttcgtgctcacaaacattgaggcattacgccatgataggttcagttaagaagaacataaagtcatttaatctgcaaactacagcatgttctgtcagtttagggcgagagtcgcagtgcaaactatcaacaagaagccaaatccgaagtgtaaagtcagatgtactatcacatcacaagttttctagtataagttggcgtttgggaagtatgccacgaaaaataggaggtatagcctctggacaaggttttgcagtgcctgggatggcaagtgctgagggtcctgtgaacaacaacattgatggcacccagcccgctgaatcatcatcaaatttatctcatgggaagaaagtttacacagattattctgtcactggtattcctggagatggaagatgtttgttccgttctgtggcccatggtgcatgcattagattagggaaacccatacctaatgaggatcttcaaagaaagctagctgatgagttgagaacaatggttgctgatgagtttatcaagagacgagcagaaactgaatggttcattgaaggggacttcgatacatatgtctctcagattagaaagccacatgtttggggaggtgaaccagagttgttcatggcttcgcatgttcttcagatgccaataacagtttaca

SEQ ID NO: 36302 - protein, 256 aa, Panicum virgatum
  misc_feature: Ceres CLONE 1967127
  misc_feature (165)..(256): Pfam Name: OTU Pfam Description: OTU-like cysteine protease
MLLNTPSISWRCCTSWNMYSESRKLPGWLTQRVDLWNSSCSQTLRHYAMIGSVKKNIKSFNLQTTACSVSLGRESQCKLSTRSQIRSVKSDVLSHHKFSSISWRLGSMPRKIGGIASGQGFAVPGMASAEGPVNNNIDGTQPAESSSNLSHGKKVYTDYSVTGIPGDGRCLFRSVAHGACIRLGKPIPNEDLQRKLADELRTMVADEFIKRRAETEWFIEGDFDTYVSQIRKPHVWGGEPELFMASHVLQMPITVY

SEQ ID NO: 36303 - DNA, 616 bp, Panicum virgatum
  misc_feature: Ceres CLONE 1967233
  misc_feature: Encodes the peptide sequence at SEQ ID NO. 36304
accaacgaatccccagtcccccacatcaccaccgagctctcgatttcaatctcaccacctccgagggagccatgtcgggccgcggcaagggaggcaaggggctgggcaagggcggcgcgaagcgccaccgcaaggtcctccgcgacaacatccagggcatcaccaagccggcgatccggaggctggcgcgcaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagctctgcctctccgttccggcggcgctcctgcttttggtcagacggtgctaggtttagcagtggtggtaggcgttctcgttccatcagttgtcgggaagagtccgtgtctgttttgtgcaaagtcatctgttctgtgatgagaaatggatcccgaaggttatgaatgaaatcgatccatgtttacttttctaactgcagatctctgttactcgataatgttgggttagtgttc

SEQ ID NO: 36304 - protein, 103 aa, Panicum virgatum; identical to SEQ ID NO: 12044
  misc_feature: Ceres CLONE 1967233
  misc_feature (25)..(94): Pfam Name: Histone Pfam Description: Core histone H2A/H2B/H3/H4

SEQ ID NO: 36305 - DNA, 668 bp, Panicum virgatum
  misc_feature: Ceres CLONE 1967245
  misc_feature: Encodes the peptide sequence at SEQ ID NO. 36306
attccaagccacccgcccgcttctcaccgactcctccaagccgccgcccctctccttctgcttcagcatggccgccgcgtcgtccgccacctccgtccacgacttcaccgtcaaggatgcaagcggcaaagacgttgatctcagcacctacaaggggaaggttcttcttatcgtcaacgtcgcatcccagtgtggcttaactaactccaactacaccgagctggcccagctctatgagaagtacaaggaccaaggctttgagatcctggctttcccatgcaaccagtttggtggccaggagccaggcaccaacgaggagattgtccagtttgcctgcacacgcttcaaggctgagtaccccatttttgacaaggttgatgtgaatggtaacgatgctgcgcccctctacaagtatctcaagtctagcaagggtggcctattcggagacagcatcaagtggaacttctccaagttcttggttgataaggaggggcgtgttgtggaccgctacgctccaaccacttctcctctgagcattgagaaggatatcaagaagctgcttgggagctcttaaaacgtctggctgaaacctgtagagatatctgtacttctgcattgcactcagcgctaaaactacaataacgtcctgtcaataaagtagtgccccg

SEQ ID NO: 36306 - protein, 168 aa, Panicum virgatum
  misc_feature: Ceres CLONE 1967245
  misc_feature (10)..(118): Pfam Name: GSHPx Pfam Description: Glutathione peroxidase
  misc_feature: SWISSPROT Homolog: EC 1.11.1.12 Phospholipid-hydroperoxide glutathione peroxidase
  misc_feature: Functional homolog of the protein sequence given in SEQ ID NO 50170
  misc_feature: Useful for making plants with modulated flowering time
  misc_feature: Functional homolog of the protein sequence given in SEQ ID NO 50171
  misc_feature: Useful for making plants with modulated nitrogen use efficiency
MAAASSATSVHDFTVKDASGKDVDLSTYKGKVLLIVNVASQCGLTNSNYTELAQLYEKYKDQGFEILAFPCNQFGGQEPGTNEEIVQFACTRFKAEYPIFDKVDVNGNDAAPLYKYLKSSKGGLFGDSIKWNFSKFLVDKEGRVVDRYAPTTSPLSIEKDIKKLLGSS

SEQ ID NO: 36307 - DNA, 463 bp, Panicum virgatum
  misc_feature: Ceres CLONE 1967295
  misc_feature: Encodes the peptide sequence at SEQ ID NO. 36308
agggcagcgtttcgagcagacgccgccgccgccgagttcctcgtctcctcccaaatcgccctagcatcagagctcctccgccgccgccgccatgggtaaggttcacggatcgctggcccgcgctgggaaggtgcgtgggcagacgcccaaggtggcgaagcaggacaagaagaagaagccccgcggccgcgcctacaagcgcatgcagtacaaccgccgcttcgtcaccgccgtcgtcgggttcggcaagaagcgcggccccaactcctccgagaagtagatctagctaggcccagccgcctgattcatacgcttgtgttcttggcaccctcgtcttcttttttgttccaagtagtttcgttcgagtaatcaaggttttggtgatgtactgatgaccagttgaagacctaagctatgttgctgcaatccaattaagtatgatatgcatcgtttactgcatggc

SEQ ID NO: 36308 - protein, 62 aa, Panicum virgatum; identical to SEQ ID NO: 10043
  misc_feature: Ceres CLONE 1967295
  misc_feature (3)..(61): Pfam Name: Ribosomal_S30 Pfam Description: Ribosomal protein S30

SEQ ID NO: 36309 - DNA, 599 bp, Panicum virgatum
  misc_feature: Ceres CLONE 1967304
  misc_feature: Encodes the peptide sequence at SEQ ID NO. 36310
ccaaatatctcgccccgtcagcagcttcacgcacagaacagggagaaaaaggccggctagcgatggctgccaaggccgtctccttcctggtgctcgcgctcctgctcctcgccgtcgcggcgttccccgtggtggtcgtggccggcggcggcaacggcaaagggaacggctacgggaacgggaacgggaacgggaacgggaacggcggcggcggcaacctgaagccgtgggagtgctcgcccaagtgcgcgtcgcggtgctccaacacgcagtacaagaaggcctgcctcaccttctgcaacaagtgctgcgccaagtgcctctgcgtgcccccggggttctacggcaacaagggcgcctgcccctgctacaacaactggaagaccaaggagggagggcccaagtgcccctagatcagatcagatcccggccgccattgttcctgctcctcctccggtggccgctactgtcaagatccaccggcttacttacttactgatgatcccggcactgttcgtgctctgttctccccctagctgctaggtgtgctagtgatgcactggttgctgaatctgggggatgctattccaagcagatct

SEQ ID NO: 36310 - protein, 116 aa, Panicum virgatum
  misc_feature: Ceres CLONE 1967304
  misc_feature (3)..(116): Pfam Name: GASA Pfam Description: Gibberellin regulated protein
MAAKAVSFLVLALLLLAVAAFPVVVVAGGGNGKGNGYGNGNGNGNGNGGGGNLKPWECSPKCASRCSNTQYKKACLTFCNKCCAKCLCVPPGFYGNKGACPCYNNWKTKEGGPKCP

SEQ ID NO: 36311 - DNA, 590 bp, Panicum virgatum
  misc_feature: Ceres CLONE 1967313
  misc_feature: Encodes the peptide sequence at SEQ ID NO. 36312
acggctcgacggtgcgcgcagcgtggacgcccgcttcgcggcgctggacgccaacggcgacggcgtgctgtcctgcgccgagctccgccgcgcgctcgagtcgttccgcctcctcgacggcgccggcttcgggtccgcccggccggcgccgctccccgccgaggtcgccgcgctctacgacgccgtcttcgagcagttcgacgccgaccacagcggcgccgtcgaccgcgccgagttccgcgacgagatgcgccgcatcatgctcgccgtcgccgaggggctcggctcgcagccgctccaggtagccgtcgacgacgagggcggcagcttcctgctcgaggccgccgagcacgaggccgccgcgaccaccttgtgctctgcgctcgctgctgtactgcttctagatgttggtgtactagtactaatacgtgtcagccgttgcgctgctacacgtgtacgtgaacagaaaaccggccggtggcagggcaacctgctgggaaatgactacgagagtcctactatttactgcttgtgaaaggaataaaacggcttccaagtctcggatgtaacttggcggcaacttgtccacc

SEQ ID NO: 36312 - protein, 177 aa, Panicum virgatum
  misc_feature: Ceres CLONE 1967313
  misc_feature (58)..(86): Pfam Name: efhand Pfam Description: EF hand
  misc_feature (7)..(35): Pfam Name: efhand Pfam Description: EF hand
RLDGARSVDARFAALDANGDGVLSCAELRRALESFRLLDGAGFGSARPAPLPAEVAALYDAVFEQFDADHSGAVDRAEFRDEMRRIMLAVAEGLGSQPLQVAVDDEGGSFLLEAAEHEAAATTLCSALAAVLLLDVGVLVLIRVSRCAATRVREQKTGRWQGNLLGNDYESPTIYCL

SEQ ID NO: 36313 - DNA, 642 bp, Panicum virgatum
  misc_feature: Ceres CLONE 1967351
  misc_feature: Encodes the peptide sequence at SEQ ID NO. 36314
agacgccacacacacacacccacacccaccctctctgccctcagctcctcgccgaaccggaacgcccgcacacccacgccacttggacaccatggcgccccgggcggcgcacaagtcgccgaccaccggcctcggtctcagcgtcgtcggtggcgtcggaggcgtgggcatgggcccgcacttcaggggcgtgcggaagcgcccgtgggggcggtacgccgcggagatccgcgacccggccaagaagagccgcgtctggcttggcacgtacgacacggccgaggaggccgcccgcgcctacgacgccgccgcgcgcgagttccgcggcgccaaggccaagaccaacttcccgttcgcgtccaagtgccccgtcgccgccggcgccggcagccccagcagcaacagcaccgtggagtcgggcggaggcggcggcggcggcggcgtccaggcgcctatgcttgccatgccgctgcccccggccctcgatctcgatctcttccgccgggcggcggccgtgaccgcggtctcccccggcagcatgcggtttcccttcaaagggtaccctgtcgcgcgcccgaccccgaccccgaacccctacttctacgaacaggcggccgcggccgccgccgcggcgtccggcta

SEQ ID NO: 36314 - protein, 183 aa, Panicum virgatum
  misc_feature: Ceres CLONE 1967351
  misc_feature (29)..(80): Pfam Name: AP2 Pfam Description: AP2 domain
  misc_feature: Functional homolog of the protein sequence given in SEQ ID NO 50343
  misc_feature: Useful for making plants with altered carbohydrate content
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
MAPRAAHKSPTTGLGLSVVGGVGGVGMGPHFRGVRKRPWGRYAAEIRDPAKKSRVWLGTYDTAEEAARAYDAAAREFRGAKAKTNFPFASKCPVAAGAGSPSSNSTVESGGGGGGGGVQAPMLAMPLPPALDLDLFRRAAAVTAVSPGSMRFPFKGYPVARPTPTPNPYFYEQAAAAAAAASG

SEQ ID NO: 36315 - DNA, 652 bp, Panicum virgatum
  misc_feature: Ceres CLONE 1967450
  misc_feature: Encodes the peptide sequence at SEQ ID NO. 36316
ccagaccgccaggcagcctctcccctcccgagccgccgtcacctgcgcctccgcctcatccccgcgccgccgaagctttgtcgccccctcgtgctacggttagtcttcacctgcagccatgggtaaggagaagtcccacatcaacatcgtggtcattggccacgtcgactctggcaagtcgaccaccaccggccacctgatctacaagcttggaggtatcgacaagcgtgtgatcgagaggttcgagaaggaggctgcggagatgaacaagaggtccttcaagtacgcgtgggtgcttgacaagctcaaggccgagcgtgagagaggtatcaccattgatatcgccctgtggaagtttgagaccaccaagtactactgcaccgtcattgatgcccctggacaccgtgacttcatcaagaacatgatcacgggtacctcccaggctgactgtgctgtccttatcattgactccaccactggtggttttgaggctggtatctccaaggatggccagacccgtgagcatgctctccttgctttcactcttggagtcaagcagatgatctgctgctgcaacaagatggatgccaccacccccaagtactccaaggcccgttatgatgagattgttaaggaagtctcctcctacctg

SEQ ID NO: 36316 - protein, 177 aa, Panicum virgatum
  misc_feature: Ceres CLONE 1967450
  misc_feature (5)..(177): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSY

SEQ ID NO: 36317 - DNA, 658 bp, Panicum virgatum
  misc_feature: Ceres CLONE 1967452
  misc_feature: Encodes the peptide sequence at SEQ ID NO. 36318
acgagctgcctgatggccaggtgattaccatcggcgcggaggggtttaggtgccctgaggtcctcttccagccatccatgatcggcatggaatcccctggaatccacgagactacctacaactccatcatgaagtgtgatgtggatatcaggaaggacctgtacggcaacattgtgctcagtggaggctcaacaatgttcccaggcatcgctgaccgtatgagcaaggagatcaccgctcttgctccgagcagcatgaagatcaaggtggttgctccacctgagcgcaagtacagtgtctggatcggagggtctatcctagcttctctcagcaccttccaacagatgtggatatcaaaggaggagtacgatgaatctggcccagcaatcgtccacaggaagtgcttctgagttgtgctgcccttttcgtgcagtctccatgtgtgggtttttttttttcatggggggagagagattgcaaggtaatgtttgtgttctgcagacggtccttattgtggccacttgtatctgtgattgccccggttacctttgttctgtactagtatttcgttgttctgtgactatgaggtcactttgtggaacttgtggttggcttgatcggttgtacctgttatagctgatagctctataagttgttt

SEQ ID NO: 36318 - protein, 135 aa, Panicum virgatum
  misc_feature: Ceres CLONE 1967452
  misc_feature (1)..(135): Pfam Name: Actin Pfam Description: Actin
  misc_feature: Functional homolog of the protein sequence given in SEQ ID NO 50712
  misc_feature: Useful for making plants with modulated biomass
  misc_feature: Functional homolog of the protein sequence given in SEQ ID NO 50711
  misc_feature: Useful for making plants with modulated flowering time
ELPDGQVITIGAEGFRCPEVLFQPSMIGMESPGIHETTYNSIMKCDVDIRKDLYGNIVLSGGSTMFPGIADRMSKEITALAPSSMKIKVVAPPERKYSVWIGGSILASLSTFQQMWISKEEYDESGPAIVHRKCF

SEQ ID NO: 36319 - DNA, 541 bp, Panicum virgatum
  misc_feature: Ceres CLONE 1967505
  misc_feature: Encodes the peptide sequence at SEQ ID NO. 36320
atgtcgtcttcttgcttgcccatccgtcgctccacctgagcccaccggcgaagaggaggcgaagaagcgatgggcgccaccaaggaggacgtcgaggcggccatcacctccgccctcagcccttcccatctcgtggtgacggacacatctggagggtgcggcgcgagctatgagatcgaggtggtgtcggagaagttcgaggggaagcggctgctggagcggcaccggatggtgaacacggcgctggcgccgcacatggcggagatccacgccgtctccatcaagaaggcgctcactccggcgcaggcccagccccagccggagccggccgccgataagccccaggcttaagtgctcaactcgccccaaacagattgatcacatttgcgcacgagtcaagctcatccgtgttgtactagtatgtggtctctgatacattaactactggttgaataatgtagcaaacgcaattgcaaaattgcaggattttatgcttgactgcttagaaatttctgtgctgtgcatttaacttcgcaattgc

SEQ ID NO: 36320 - protein, 93 aa, Panicum virgatum
  misc_feature: Ceres CLONE 1967505
  misc_feature (3)..(80): Pfam Name: BolA Pfam Description: BolA-like protein
MGATKEDVEAAITSALSPSHLVVTDTSGGCGASYEIEVVSEKFEGKRLLERHRMVNTALAPHMAEIHAVSIKKALTPAQAQPQPEPAADKPQA

SEQ ID NO: 36321 - DNA, 697 bp, Panicum virgatum
  misc_feature: Ceres CLONE 1967524
  misc_feature: Encodes the peptide sequence at SEQ ID NO. 36322
cgtgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggcggctacggcggcggtcgtcaaggtggctacggcggcggcggcggctacggaggcggtggtggcggtggtggctacggcggtggtcgccgtgagggcggctacggcggaggcggtagcggcggtcgccgcgagggcggctacggtggtggtggctacggcagccgcggtgactccggtggtaactggaggaactgatggggtggccctcccgtgctggcagccaagttatcctatattcgtgtcactgtttgatccgagttacccctgagttttgtccgtgtgttaccgttctattaggtgttggttcccatgtttaccgttcccgagttgtttccgcaatgaaag

SEQ ID NO: 36322 - protein, 155 aa, Panicum virgatum
  misc_feature: Ceres CLONE 1967524
  misc_feature (10)..(81): Pfam Name: RRM_1 Pfam Description: RNA recognition motif. (a.k.a. RRM, RBD, or RNP domain)
  misc_feature (48)..(147): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MAAADVEYRCFVGGLAWATDNASLQQAFASYGDVLDSKVITDRETGRSRGFGFVTFSSEQSMLDAIEAMNGKDLDGRNITVNQAQSRGGGGGYGGGRQGGYGGGGGYGGGGGGGGYGGGRREGGYGGGGSGGRREGGYGGGGYGSRGDSGGNWRN

SEQ ID NO: 36323 - DNA, 685 bp, Panicum virgatum
  misc_feature: Ceres CLONE 1967550
  misc_feature: Encodes the peptide sequence at SEQ ID NO. 36324
atctttgcgcttggggcaatgacgcagctagtgaggtaataccgaggcgcgtcaattgctggttgaaaactatttccaaaccccctctttggccctctgggccactgagaatttctggaagggctccttctcttcggagaggggaaagccctacatcgttaaaaccgagaagagaccaaagccaaaggaaaacaaatcttaaaacctcgaagccatgggtctgcaggaggaatttgaggagtatgctgaaaaggcgacgaccttgcccgatagcacgagcaatgagaacaagctgatcctctacggactttacaagcaggccactgttggaaacgtgaatacccctcgtcctggcatattacaccagagggacagggccaagtgggatgcatggaaggctgttgaaggaaaatccaaggaagaggcaatgagtgactacatcaccaaggtgaagcagctccaggaggaggctgctagctcttaagtctctgaactgctgaaccaaacagctgctgtcagatgagctcctatgccatctgatgatgatgaaagcttgatcatttgatccactggggatgtgaaacatgtacctgtttatgtattgtttacctaagtttcccatccatccatctatctatctgtgaagactttaatcttctatttatgatatctgtgcctgtgtgat

SEQ ID NO: 36324 - protein, 89 aa, Panicum virgatum
  misc_feature: Ceres CLONE 1967550
  misc_feature (3)..(87): Pfam Name: ACBP Pfam Description: Acyl CoA binding protein
  misc_feature: SWISSPROT Homolog: EC 5.3.3.8 Dodecenoyl-CoA isomerase
MGLQEEFEEYAEKATTLPDSTSNENKLILYGLYKQATVGNVNTPRPGILHQRDRAKWDAWKAVEGKSKEEAMSDYITKVKQLQEEAASS

SEQ ID NO: 36325 - DNA, 484 bp, Panicum virgatum
  misc_feature: Ceres CLONE 1967566
  misc_feature: Encodes the peptide sequence at SEQ ID NO. 36326
actcgtcactcctaccacagactgcatcatcagctagcgaacggcctcatcatccctccttcggctcacgcaatggccgcctccaccatggcgatctcctccccggcgatgggcggcacccccatcaaggtgggctccttcggcgagggccgcatcaccatgcgcaagaccgcagccaacgccaaggtggaggcgtccggtagcccgtggtacggccccgaccgcgtcaagaacctcagccccttctccggcgagcccccgagctacctgaccggcgagttccctgacgactacggctgggacaccgcggggctgtccgccgaccccgagaccttcgccaaaaaacgcgagctggaggtcatccactcccggtgggccatgctcggcgcgctcggctgcctcttccccgatctgctcgctcgcaacggcatcaagctcagcgaggccgtctggttcaaggccagctcccatatcttcagcgagg

SEQ ID NO: 36326 - protein, 137 aa, Panicum virgatum
  misc_feature: Ceres CLONE 1967566
  misc_feature (61)..(134): Pfam Name: Chloroa_b-bind Pfam Description: Chlorophyll A-B binding protein
MAASTMAISSPAMGGTPIKVGSFGEGRITMRKTAANAKVEASGSPWYGPDRVKNLSPFSGEPPSYLTGEFPDDYGWDTAGLSADPETFAKKRELEVIHSRWAMLGALGCLFPDLLARNGIKLSEAVWFKASSHIFSE

SEQ ID NO: 36327 - DNA, 592 bp, Panicum virgatum
  misc_feature: Ceres CLONE 1967641
  misc_feature: Encodes the peptide sequence at SEQ ID NO. 36328
gcagaaaccctagacaccgctcgagccgttcgccgccgcgccgcgccgcgccgcgccgctccgctcgtcttctcgggctctctccctcccggatccaggatgaagtttgttgctgcctatctgcttgctgtcctcgctggcaaccccagcccctctgctgaggatctatcgtccattctggaatcagttggctgtgaaattgacaatgaaaagatggagctgctgctgtcccaactgagcggcaaagacattaccgagctcattgctgctggcagggagaagtttgcttcagtcccatgcggtggtggtggtgtggctgtggcagcagctgcccctgctgctggtggagctgctcctgcagctgaggccaagaaagaagagaaggtggaggagaaggaagagagtgatgatgatatgggcttcagcctcttcgactaagctgtgcggtcaccagagttgtgtcttttcggcaggaaaaccagagtcgccatgtttggagtttaaccttgttttatgttgcaaagcacccgaaaagactgctacagtctggatatgtagtgattcagccataggttgctacattggttgttgg

SEQ ID NO: 36328 - protein, 112 aa, Panicum virgatum; identical to SEQ ID NO: 27985
  misc_feature: Ceres CLONE 1967641
  misc_feature (17)..(111): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass

SEQ ID NO: 36329 - DNA, 688 bp, Panicum virgatum
  misc_feature: Ceres CLONE 1967680
  misc_feature: Encodes the peptide sequence at SEQ ID NO. 36330
cgtgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtccccctcccctcagagcactatgcgggggaccccctcaaccccgagaggggaggatatctccagcgccgccatctccccctcccccgctctcacccccgccggcggcgggggcctcggggggtccaccggcgccggcggcgacacaggcggggggggggacagcggtgggctccccgaggggggctacaccggagacgggggggccgggctccccgcgggggcctatactgagatgggctccaccgcccccgctgactctcgtgggatctgtggaagatgagatggtgtgcctctcccgcgctggcccccgatatcccatatatctctaatagtgcgcgtgtctgtgtgagacccgagacacctcagatttgtgctcgtgtgtcaccgctctaatgtgtgttggcccccgtgtaccccgtctccagatgtgtctgcgctataaagaga

SEQ ID NO: 36330 - protein, 130 aa, Panicum virgatum
  misc_feature: Ceres CLONE 1967680
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAADVEYRCFVGGLAWATDNASLQQAFASYGDVLDSKVITDRETGRSRGFGFVPLPSEHYAGDPLNPERGGYLQRRHLPLPRSHPRRRRGPRGVHRRRRRHRRGGGQRWAPRGGLHRRRGGRAPRGGLY

SEQ ID NO: 36331 - DNA, 498 bp, Panicum virgatum
  misc_feature: Ceres CLONE 1967764
  misc_feature: Encodes the peptide sequence at SEQ ID NO. 36332
agcagtacaagaagcacaagaaaaaacacttgtagccatcaacttcttcttcaccgtcatcaactcatcatcagctcagacccatcgatcgatccgcagctagctagcgaccgaagaagaagaagatgagctcctccgcggaagcagctgatcagtgcggcggcggcaagacgtcgtggccggaggtggtggggatgagcatagaggaggccaagaaggtgatcctcaaagacaagcccgacgccgacatccacgtgctgccggtcggcacgccggtgaccagggatttccgccccaaccgtgtccgcatcttcgtcggcaccgtcgcccagacgccccatgtgggctagcagctctgcccatagctttcttgctcacaacatcatgcgcgttccaaataaagccatcctttgtatgtatggatgtgtgttgttaccctatggatccaataaataagggatgtaaaaggtgaataaagcatcgattgtgtgtagcctc

SEQ ID NO: 36332 - protein, 74 aa, Panicum virgatum; identical to SEQ ID NO: 18697
  misc_feature: Ceres CLONE 1967764
  misc_feature (15)..(74): Pfam Name: potato_inhibit Pfam Description: Potato inhibitor I family

SEQ ID NO: 36333 - DNA, 687 bp, Panicum virgatum
  misc_feature: Ceres CLONE 1967806
  misc_feature: Encodes the peptide sequence at SEQ ID NO. 36334
catcacaaccgacctccgatccacttctgctcaccagacactgctaagctagctagctgctttacacttcactcactagtcactagcagcttgatcattcgacgatcagtgagtgttatcatatatcagtagctgcaatattatatatagaattatatatatggctcgcctctccgccgttgtcgccgtcgtcctggtggcaacatgggcaacgccgccgccagcatccccgtgcctggggtacgccatgggcagctcggcgtcgccctcgccggcgtgctgcaacggggtgaggtcgctcaacagccgggcgtcgtcgacggcggacaggcaggcggcgtgcgcctgcctcaagaacatggcggggaggctgggtggcaacatgggcggccgagaccgcttcggctgcggtgagctgcagccaggtgacgtcggcgtgccaatcagcccaaacgtcgactgcgccaagattaactgataagatgctaaggatggatgctcagctctttccttctctttgggtatgatgtcggccaacagaacagagagcagtcgtttaatttactacctcttccttttacatttgtacaacaccacgcaccacctgtgtacgtcgtcgtctatgtacaacaataatcctctctctgcttatgtgtttgctgggtctctgttttcatgtactactac

SEQ ID NO: 36334 - protein, 105 aa, Panicum virgatum
  misc_feature: Ceres CLONE 1967806
  misc_feature (9)..(101): Pfam Name: Tryp_alpha_amyl Pfam Description: Protease inhibitor/seed storage/LTP family
MARLSAVVAVVLVATWATPPPASPCLGYAMGSSASPSPACCNGVRSLNSRASSTADRQAACACLKNMAGRLGGNMGGRDRFGCGELQPGDVGVPISPNVDCAKIN

SEQ ID NO: 36335 - DNA, 360 bp, Panicum virgatum
  misc_feature: Ceres CLONE 1967830
  misc_feature: Encodes the peptide sequence at SEQ ID NO. 36336
tgcatctcatcgatcgagccagccagccatccatccatccatccagccgcctctcctcgcctgctgcgcgcgtctctctgctctcctagggagatctcgcgcagcccggaaacccgtcgacccagctcgtcctcgtcgcagatggccggcctcaggatgaagttcgtcgccgccgccgccgtggccgccgcgctcgtggcgtccgccgccgccgccatcgaggcccccgccccggcgcccgcctccgacgacgccgccgccgtgcccctcgcggcggcggccctcgccgacaccgccttcgcctacctcctcagctagaaccatatcccgaacaccgagggtcctgctgatatgatgatt

SEQ ID NO: 36336 - protein, 58 aa, Panicum virgatum
  misc_feature: Ceres CLONE 1967830
  misc_feature: Functional homolog of the protein sequence given in SEQ ID NO 50631
  misc_feature: Useful for making plants with altered carbohydrate content
MAGLRMKFVAAAAVAAALVASAAAAIEAPAPAPASDDAAAVPLAAAALADTAFAYLLS

SEQ ID NO: 36337 - DNA, 675 bp, Panicum virgatum
  misc_feature: Ceres CLONE 1984997
  misc_feature: Encodes the peptide sequence at SEQ ID NO. 36338
ctagctcattgtgtcgtcgtcgtcgtcgtcgtcttcccggcttcggcgttctatctgctggcagcaacgcccgcagcagctctcgtttgctgcgctgtagcccatctcttgggggtggcatggcgaggcggacgagcggccccaagaagaagctgaggaggggcctctggtcgccggaggaggatgagaagctgatgaaccacattgccaagtatggccatggcagctggagttccgtccccaagctagcaggtcttgagaggtgtgggaagagctgcaggctgaggtggatcaactacctcaggccggacctcaagaggggcgcattctcgcaggaagaggaagacctcatcatccatctccactccatgctgggcaacaagtggtctcagattgcagcgcagctgccggggcggacggacaacgaggtcaagaacttctggaactcgtacatcaagaagaagctccgccagcgcggcatcgacccggccacgcacaagccgctggccgaggccgccagcagcggccgcgggggcgccgccgcagccagccgcgcgcgcacggctgtgttcagcgacgccgagctcatcctgcagtcgtcatcggcgggcaagcacatgccgcccgcgccagtgacggcggagagctacgtgtacagccgcagcatcagcgccg

SEQ ID NO: 36338 - protein, 185 aa, Panicum virgatum
  misc_feature: Ceres CLONE 1984997
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: Functional homolog of the protein sequence given in SEQ ID NO 50235
  misc_feature: Useful for biocontainment applications
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: Functional homolog of the protein sequence given in SEQ ID NO 50232
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1002 in the 11/435,388 US patent application
  misc_feature: The sequence is a functional homolog of SEQ ID NO 296 in the 11/479,226 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 1004 in the 11/435,388 US patent application
  misc_feature: The sequence is a functional homolog of SEQ ID NO 1010 in the 11/435,388 US patent application
  misc_feature: The sequence is a functional homolog of SEQ ID NO 442 in the 10/412,699 US patent application
  misc_feature: The sequence is a functional homolog of SEQ ID NO 1073 in the 10/374,780 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 271 in the 11/479,226 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 126 in the 10/412,699 US patent application
  misc_feature: Functional homolog of the protein sequence given in SEQ ID NO 50733
  misc_feature: Useful for making plants with altered cell wall content and/or composition
MARRTSGPKKKLRRGLWSPEEDEKLMNHIAKYGHGSWSSVPKLAGLERCGKSCRLRWINYLRPDLKRGAFSQEEEDLIIHLHSMLGNKWSQIAAQLPGRTDNEVKNFWNSYIKKKLRQRGIDPATHKPLAEAASSGRGGAAAASRARTAVFSDAELILQSSSAGKHMPPAPVTAESYVYSRSISA

SEQ ID NO: 36339 - DNA, 1055 bp, Panicum virgatum
  misc_feature: Ceres CLONE 1985005
  misc_feature: Encodes the peptide sequence at SEQ ID NO. 36340
aaaaaaaaaaaaaaagcaagcaaaacccttggtccccttccccggccaccaccgcgcgcctccgcgtttcagatcgggaagggcgccgctcccgccggagagccagccagcccagcgaaccgccgctccctcccctccatttcgaaatcccgttttagcggcctcccccgcctcctccgccattccggtcctcctcgctacttaaccgcctcgatctgttccccattcccctcccctccggacccagcgccgccaaaccctaggagcccgtgccgccgccgacgaggaggatggcggacaaggagaacgcgccggcggcggcggccccggggccccggctcacccgatccgccgccaagcgcgcggccgaggccgccgccggcgcccccgccaagcgcaagcgggtggcgctcggggagctcccggcgctcgccgccaacgccgccaccgtccaccgcgccccgctggcccgcccggtcaagcccgcgaggggcgccgccaaggccgccaggcccggcaagccggtccccagacccgcagccgcccccgcggctgcggccgacgccgaagccgagcgctgcggatcctcctcgccgcggcgcgccgcgggggccgccgaccccgaccgcgactcctccgcgtccaactcccctccgcgcgcggccgccgccgcggaccccgaccgcgactcctccgcctcctcctcccccccgccgcgcgctgccggggcgggggctctcggcaacccgcagctctgcgggtcctacgcctccgacatctacacctaccaccgcgctctggaggtggagccgcggcggcggccgagatccgactacattgaggccgtgcagtcggacgtcacggccaacatgcggaccatcctcgtcgactggctcgtcgaggtcgccgaggagtacaagctcgtcgccgacacgctctacctcgccatctcctacgtcgaccgcttcctctccgccaacgcgctcagccgtgacaagctgcaactccttggcgtcgctgccatgctcatcgccgcgaagtacgaggagatcagc

SEQ ID NO: 36340 - protein, 254 aa, Panicum virgatum
  misc_feature: Ceres CLONE 1985005
  misc_feature (162)..(254): Pfam Name: Cyclin_N Pfam Description: Cyclin, N-terminal domain
MADKENAPAAAAPGPRLTRSAAKRAAEAAAGAPAKRKRVALGELPALAANAATVHRAPLARPVKPARGAAKAARPGKPVPRPAAAPAAAADAEAERCGSSSPRRAAGAADPDRDSSASNSPPRAAAAADPDRDSSASSSPPPRAAGAGALGNPQLCGSYASDIYTYHRALEVEPRRRPRSDYIEAVQSDVTANMRTILVDWLVEVAEEYKLVADTLYLAISYVDRFLSANALSRDKLQLLGVAAMLIAAKYEEI

SEQ ID NO: 36341 - DNA, 791 bp, Panicum virgatum
  misc_feature: Ceres CLONE 1985005-R
  misc_feature: Encodes the peptide sequence at SEQ ID NO. 36342
caatacctacactaagcaggagcttcttaagacagagagtgacatactcaagctgctccagtttgagttgggcaatcctacaattaagaccttcctgaggcggttcacaagatcggcccatgaagacaaaaagcgctccatcttattaatggagttcttggggagctaccttgctgagctgagtctgctggactatggctgtctccggttcttgccatcagtagttgctgcttcagtgatgtttgttgctaggctgaccattgatccagatgtcaatccttggaacaagaagttgcagaaggtgacaggctacaaggtttctgaactcaaggattgcattgtagccatacatgacttgcagctcaacaagaagtgttcatcagtgatggcaattcgggacaagtacaagcaacacaagttcaaatttgtatcgaccctgcttcctcctgttgtgatccctactccatactttgaagacttagcggagtagctggtcatggatccacaccactgtaaggctaacaatctgagctcttcttgagctcttagggataggggagaactactactattgatgcgctgcttctcagtgaattagatgctgattgctgaaagccatttatgtgctcgtggttctttaggagttgctagtagtgagacaaggcattcttctgttttgtgaattgtattttttgtatcatatcttaggacatgttgccttggtctgttggccacaaacttgtaatgtttgatatgttggctcattccttctgaatctcattgatttcaat

SEQ ID NO: 36342 - protein, 162 aa, Panicum virgatum
  misc_feature: Ceres CLONE 1985005-R
  misc_feature (26)..(153): Pfam Name: Cyclin_C Pfam Description: Cyclin, C-terminal domain
  misc_feature: Functional homolog of the protein sequence given in SEQ ID NO 50284
  misc_feature: Useful for making plants with modulated nitrogen use efficiency
  misc_feature: Functional homolog of the protein sequence given in SEQ ID NO 50735
  misc_feature: Useful for making plants with modulated oxidative stress sensitivity
NTYTKQELLKTESDILKLLQFELGNPTIKTFLRRFTRSAHEDKKRSILLMEFLGSYLAELSLLDYGCLRFLPSVVAASVMFVARLTIDPDVNPWNKKLQKVTGYKVSELKDCIVAIHDLQLNKKCSSVMAIRDKYKQHKFKFVSTLLPPVVIPTPYFEDLAE

SEQ ID NO: 36343 - DNA, 1635 bp, Panicum virgatum
  misc_feature: Ceres CLONE 1985010
  misc_feature: Encodes the peptide sequence at SEQ ID NO. 36344
ctgcgagcaaatcagacgaaaccctcttgggctcttggcttcctcccctcccctaccggatcccccatggcgcaggacgagaccccggagccccccgccaccgcatccggctcctcctccacctcctctgccgccgccgccgccccggccgcccgcctcaacgccgccgcgcccgagttcaccccgcgatccaccgcccagcaccacggcagcaacccccaccgccgcgggtctcaccactaccagcagcaccaccaccagccgcatcaccaccaccaccagccgcaccagcactaccagccgcggcaccaacagcaccaccagggcggcgaggatgaggggagcgccgccgcggcgggggaggataaggaggggcctgcggggggcggggggcgcgggggtcccgtgccgcgccgagggggatgcgcggggggtcgtcaagcaggtggaattttacttcagtgatatcaatttggccacaactgaacatctgataaagttcatcactaatgatccagatggatttgtgccaatatctgtagttgcgtcttttaggaaaatccgggagatagtttctgacagatccttgttggttgctgcattgcgcacatcgtcagagctggttgtttcagaggatgggaaaaaggttaaacgcctacggcccttcaacactgaagaagttcagtcacgtatcgttgttgctgaaaatttacctgatcaaaagtatcagactcttatgaagattttctcggatgttgggagtgtgaaatctatacgtacctgctatccacaggatggcgctgcagctgctgctagcaaaacatcaaggattgagatgctttttgctaataagctgcatgcttttgtggagtatgggactgttgaagatgctgaaaaagcggttgcattcagtggcgagggaaagtggagggatggtgcgattagagttcgctcgctgcttgcttgtctgaagcatggattgggtcaagggaggagaggtggagatgaatatgctgttgatgaagatggccctgacacaactggccactcacatgactacggagcagatgatacgacccagatttctgaagcacatcttgatcatcaggctgaagatggctactatgacaagggaatgaggcaaggaagagggcgaggacgtggaggcagaggccgcggtcgtggccagtactacggccacagccgagatgcccaccatccgattggcactcctccatcagagcacccagctatcccaaagccacccccaggcccccgcatgccagatggcacaagagggtttaccatgggccgagggaagccgctcaacccttccccagatgctgcacctatcacagatgctgcctagtggtgttaccatgtgatgacttgtcctgctcgtcatcagtcgtacaaaccatgacagtgatccttttctcaggttctaaaactgattgctgtggtgtgctgtttcattttgatgtgagatctaaaagagagaaaaaaatatatggctggtaccgtggtacatgcgtgtataccaacaccgggggtataaacatgtgaacaagtactgtgatatgtagttcttaaagtagaaaaaaaaatcatacttgacaaaaaaaaggttatatc

SEQ ID NO: 36344 - protein, 344 aa, Panicum virgatum
  misc_feature: Ceres CLONE 1985010
  misc_feature (34)..(93): Pfam Name: La Pfam Description: La domain
MRGAPPRRGRIRRGLRGAGGAGVPCRAEGDARGVVKQVEFYFSDINLATTEHLIKFITNDPDGFVPISVVASFRKIREIVSDRSLLVAALRTSSELVVSEDGKKVKRLRPFNTEEVQSRIVVAENLPDQKYQTLMKIFSDVGSVKSIRTCYPQDGAAAAASKTSRIEMLFANKLHAFVEYGTVEDAEKAVAFSGEGKWRDGAIRVRSLLACLKHGLGQGRRGGDEYAVDEDGPDTTGHSHDYGADDTTQISEAHLDHQAEDGYYDKGMRQGRGRGRGGRGRGRGQYYGHSRDAHHPIGTPPSEHPAIPKPPPGPRMPDGTRGFTMGRGKPLNPSPDAAPITDAA

SEQ ID NO: 36345 - DNA, 1973 bp, Panicum virgatum
  misc_feature: Ceres CLONE 1985011
  misc_feature: Encodes the peptide sequence at SEQ ID NO. 36346
actaacgctaaaaaagtaacagtttctgtactttattgatccccccacggcgagatggacatctaccagacgttccgcggcaagaccattttcttcaccggcgtcaccggcttcgttggtaaggtgttcctgtggaagcttttcaaggagttcccggaccttgacaacatcatcgtgttgatccgcaccaagaagggccagaagccgctcgaccgcctgaagaaggaggtgctctcgtcggcgtgcttcgagccgctgaagaagcagatcggcgaggaggagtggcagcgccgcgtcagcaaggtcatcggcgtctccggcgacatcatggacgagcgcctcggcatgtcggacgaggactacgccatgaccgccagcaaggtgaacttcatcgtgcacatggccgcgaccgtcaacttcgacgagcgcctcgacacgtcggtgaagatgaacgtgctcggctcgatgcgggtgctcgcgctggcgcagaaggcgacgaagctcgagggctacgtgcacatgtcgacgtgctacgtcaactaccagcgccaccaccgccaggtcgtgcgcgagaccatctacccgctgcccttcgacgcggaggacatgtgcaagtacatcctctcccacgacccgcaggtgatccacctcgtcacggagcgcgtgctcaagcagtacgggttcccgaacacgtacacgctcacgaaggccatgggcgagcagatcctcgagcgccgcaagggcgacctgccgctcacgatcatccgcccggccatcatcgggtgcgcgtggcgcgagcccatgccgggctgggtggacgctctcacggccgccggtggcatcttcctgaccgcaggcctcggcatccttcgcgagctgcacatcaagccatcgaacatcacggatctggtgcccgtcgactacgtggtgaactcgaccatcaagctcctgcaccgcaccgcgaccttctacaacgcgaagaagcagcccatggcccgcgccatcacggcgccccgcccggccgcgatcgccacggccgccggaaagccggacgtcagcttcgcgctctccgtgggctccgcggcggccacggctgggtcgacggtcaaccacgtctccagcgcgtcatctgccgggactgcggacggtatcgcgccgtcgacgctcccgttcgtgtaccaggcgtcgacctcgtcgagcctgaacgtgatgcggtgggagacggcgtgggttgcggtgcacgagtactggagcaagcacccgcaccctaaggcgatccacaaggtcgacatggcgatgatccccaactacatggtctacgtgctgcgcatgtacttcatgcgtgtgatccccatcgcggccttgaaggtcgtctcgtcgctcccggtcgtcggcaacccgcagcgcaagaagctcgtcgaacgcctggagcgtgccgtgttccgctcgtgggacctgcagcgccagttcagccccttcgtcaacaacgagtggtgcttcgatgccaccaactcgagcggcttggacgagtacatcaagccagagcagttgaagaacttctcgtgcgatccgtacgacatcaactggcacgcgtacacgctcgcgtacagctacggcatggtcatctacatcatgaagacggccgacggccgctctgccccggtgatgcccgctagcggctccgagctcttcgccaaggccagcttgtaacgcgcatactggcgaaacggtttcaggtcgcactcaacccgcgattcatccatcgcggttgcatagaccttcgagtgtgttcgaaccgtttggcattaacctacccccaacggcgtccttgtgtaaagggcgccatcttttcaaatctgttaagctgatccccctctttcgtcgcgctgctgccgtcgcggttccgccgcatgcctttccccgcgacgaggacaggcgcggcgcgagtcaagctgtgctgatactgcttgcag

SEQ ID NO: 36346 - protein, 551 aa, Panicum virgatum
  misc_feature: Ceres CLONE 1985011
  misc_feature (14)..(295): Pfam Name: NAD_binding_4 Pfam Description: Male sterility protein
  misc_feature (428)..(529): Pfam Name: Sterile Pfam Description: Male sterility protein
  misc_feature: SWISSPROT Homolog: EC 1.2.1.31 L-aminoadipate-semialdehyde dehydrogenase
MDIYQTFRGKTIFFTGVTGFVGKVFLWKLFKEFPDLDNIIVLIRTKKGQKPLDRLKKEVLSSACFEPLKKQIGEEEWQRRVSKVIGVSGDIMDERLGMSDEDYAMTASKVNFIVHMAATVNFDERLDTSVKMNVLGSMRVLALAQKATKLEGYVHMSTCYVNYQRHHRQVVRETIYPLPFDAEDMCKYILSHDPQVIHLVTERVLKQYGFPNTYTLTKAMGEQILERRKGDLPLTIIRPAIIGCAWREPMPGWVDALTAAGGIFLTAGLGILRELHIKPSNITDLVPVDYVVNSTIKLLHRTATFYNAKKQPMARAITAPRPAAIATAAGKPDVSFALSVGSAAATAGSTVNHVSSASSAGTADGIAPSTLPFVYQASTSSSLNVMRWETAWVAVHEYWSKHPHPKAIHKVDMAMIPNYMVYVLRMYFMRVIPIAALKVVSSLPVVGNPQRKKLVERLERAVFRSWDLQRQFSPFVNNEWCFDATNSSGLDEYIKPEQLKNFSCDPYDINWHAYTLAYSYGMVIYIMKTADGRSAPVMPASGSELFAKASL

SEQ ID NO: 36347 - DNA, 1321 bp, Panicum virgatum
  misc_feature: Ceres CLONE 1985028
  misc_feature: Encodes the peptide sequence at SEQ ID NO. 36348
ctcgcgagcccgccagtcacctcactgcaatggtggaagctgcaaaggctgagtccttgcccccctgctcctttgtcctctcgattagcccttgacgcaacaaggttgattggcttttggtctctctctctctccccctccctccctcccttgaggccttgactgtccagagagagcaatccagtggagaaaataatctcttgtggtctgcaagacacaccctctcacacacatacaaacaaacattacactaggcttattagacacaaaacatctgcagcagcagcagagctcctccttcatatcttcctctagcccttgttgctttgtgtctggttcaaggggaggagagacaagctgtgtgttgcaattgcaagcctaagagagaaagagagtgtggtcaaaggctggtccatagcccatacatacatacatctaataggggaggaaaacaaaagaatacagtagtctaggagcagtatatatatcagtaaccagtaaaaatcttggagccagtaacaagcaggcagctcaaagtaaccctgctgccttttgtaagaacagcctcactgttcatccttcttgcactatagccactgaagaagaacagaagcgtcagcagcagctgccgcggcagcaagaagcatcttctctctggagaggcgccgccgagacgaggaaggatcaggaggaggcatggatctttctggcacgcagggcgagctcgcgatcccaatgcacgccaacgtcgtctcgccctacggcggcggtggcggtggcggcgtcggcggtgggagagccgccgccggccatgtcctgcagctgcaccatgagcaccatggcaacaacaatggccagtccccggtgctgcctccgtcgccgcctgccgcggcggcagaggagatggagagctccgcgaagaagcgcgggccggcggccggcgccggcattggtagcgccgcggtgaggtaccgcgagtgcctcaagaaccacgcggcggccatcggcggcaacgccaccgacgggtgcggcgagttcatgccgagcggcaaggagggctcgctggaggcgctcaagtgctccgcctgcggctgccaccgcaacttccaccgcaaggaggcggacgatgacgacgacgacatctacgcggtgggcgacggcttcggccgcggccacggcccccgcgccgcccaccgcctcctcgcccccgcactgccgcaccacagcaagggcggcggcggcggcgggctcctggtctccgcggccgacccctacggcgcctacgccgcggcgcgcgcgctccccccggcgctgccgccgg

SEQ ID NO: 36348 - protein, 208 aa, Panicum virgatum
  misc_feature: Ceres CLONE 1985028
  misc_feature (87)..(146): Pfam Name: ZF-HD_dimer Pfam Description: ZF-HD protein dimerisation region
MDLSGTQGELAIPMHANVVSPYGGGGGGGVGGGRAAAGHVLQLHHEHHGNNNGQSPVLPPSPPAAAAEEMESSAKKRGPAAGAGIGSAAVRYRECLKNHAAAIGGNATDGCGEFMPSGKEGSLEALKCSACGCHRNFHRKEADDDDDDIYAVGDGFGRGHGPRAAHRLLAPALPHHSKGGGGGGLLVSAADPYGAYAAARALPPALPP

SEQ ID NO: 36349 - DNA, 697 bp, Panicum virgatum
  misc_feature: Ceres CLONE 1985028-R
  misc_feature: Encodes the peptide sequence at SEQ ID NO. 36350
caccagtacgtgatgccgctgaacatgctgcacaccggctcggagtccgacgacatggacggcggcgcgggcggcggcggcggcggctcggcgtcgtcttccaagaagcggttccgcaccaagttcaccccggagcagaaggcccgcatgctggagttcgcggagcgcgtggggtggcgcctgcagaagctcgacgacggcatggtgcaggccttctgccaggagatcggcgtgaagcggcgcgtgctgaaggtgtggatgcacaacaacaagcagaacctcgccaccaagcgcctggaggcctcgccgcaggagccgccggagatggcgtccccgccggcgccgccgctgatgcctctccagatgatgcccgctgcaatgatgccgccggccgctgggccctccggctgccaccgcggcggccccgggtccccgccaccgccgcccaagctcgagtgaccccgactgacaaagaagctaatggaggcgatcgcaatgctgcatgccgtcgttcggtccatggtgatcgttccttccattcttgatccgtcctggtaacctagctagcaaatcgatcgccatttcactgttccattaaatccgccaccatgtgatctaccggcgtccaagaagacagaggagtgaactgaaacaacaagagatttagagagaacatgtcgaggttattatcgtctag

SEQ ID NO: 36350 - protein, 152 aa, Panicum virgatum
  misc_feature: Ceres CLONE 1985028-R
  misc_feature: The sequence is a functional homolog of SEQ ID NO 116 in the 10/714,887 US patent application
  misc_feature: The sequence is a functional homolog of SEQ ID NO 116 in the 11/435,388 US patent application
HQYVMPLNMLHTGSESDDMDGGAGGGGGGSASSSKKRFRTKFTPEQKARMLEFAERVGWRLQKLDDGMVQAFCQEIGVKRRVLKVWMHNNKQNLATKRLEASPQEPPEMASPPAPPLMPLQMMPAAMMPPAAGPSGCHRGGPGSPPPPPKLE

SEQ ID NO: 36351 - DNA, 1191 bp, Panicum virgatum
  misc_feature: Ceres CLONE 1985035
  misc_feature: Encodes the peptide sequence at SEQ ID NO. 36352
agccggcctgcccgagcgctcgcctctcctctgcccgaggccccgagcggacgcgcggccgcccctctcggctctagcctcgactctgcgcgcgcctgaaccctaggccgtagctagcgggctagcagctggggcgggcgcgcgcggtgccatcgacggctttgagggtggcagttggcggcctgtggctatctctactgtcagtctctcggcttctagaccggacgggcaggcggcagcacatctgcgtctcaaggccggtgcggtcaggcggaggctcctgcaggctcgttctggactgcgtgcaagcacaagagcagaagcacaagccaatttggagcaaagaaggatttagaacccaccctctgttctccatagttgcatcaaagatgccgcaggtattggtggtggcgcggaacttcatggatatggtggctgcgctgcctgcctccaagcttgatatgctctatgactcggccttcatctgtgaggctgtactcaggtcacttccaccactggcaaagaaatatgcactgcagatgctgtacgtgttggcaccggtgaccgctgcagctatggaagagtgggtgctcaatgaatatgctgccaagcatagggttgccattgataagctgctccaacttagggtctttgttgaagtgcgcgatagacgaaaggaggttagctacaagatgaatcaaaagttccagggtaacatgcagaagtatttggtttatggtggaagtttaccaagggaaccgataccattaagtgttactggtagattgcctgcatcaacagatctggaagcctatgctcttgatcaatgggagtgcttcttgttgcaattgatcaattcatctcaagttgaaaaagggacaagcttcagctcctccatgatgaagacatttcagcgtggccttctgagttcaagggatggtgaagctccaaagttgactgagaatggcttccaatttcttctgatggaaacaaatgcacaactttggtacataatgagagaatacatttcctctgcagaggaacgtggagtggaccctacggagctgatatcatttctcttggaacttagttttcataaattgggagcggcttatagtttgaacactctgactgatgtgcaaagaattgccatcagggatcttgcagagttgggattagtcaagctgcagc

SEQ ID NO: 36352 - protein, 267 aa, Panicum virgatum
  misc_feature: Ceres CLONE 1985035
  misc_feature (13)..(267): Pfam Name: Tfb2 Pfam Description: Transcription factor Tfb2
MPQVLVVARNFMDMVAALPASKLDMLYDSAFICEAVLRSLPPLAKKYALQMLYVLAPVTAAAMEEWVLNEYAAKHRVAIDKLLQLRVFVEVRDRRKEVSYKMNQKFQGNMQKYLVYGGSLPREPIPLSVTGRLPASTDLEAYALDQWECFLLQLINSSQVEKGTSFSSSMMKTFQRGLLSSRDGEAPKLTENGFQFLLMETNAQLWYIMREYISSAEERGVDPTELISFLLELSFHKLGAAYSLNTLTDVQRIAIRDLAELGLVKLQ

SEQ ID NO: 36353 - DNA, 775 bp, Panicum virgatum
  misc_feature: Ceres CLONE 1985035-R
ctttgtggttgtggagacaaactttagaatgtatgcatactctacttccaaattgcactgtgagattctgcgccttttctcaagggtggagtatcaacttccaaacctcatcgtaggagctattacaaaagaaagtatttatggtgcttttgagaatggaataactgctgaacagataatttcatttctcaagcaaaatgctcaccctcgtgttgcggacaagatacctgctgtcccggagaatgtcacagatcagattaggctgtgggaaactgatcgtaacagggtcgagatgattccatcacatttatatgaagattttcctagcaaggaatggtttgaacaatgctgtgatcacgcaagggatcatggatacttgctctgggaggactcaaggaggatgaggctgattgtacgaggggagttccaccctgaaatgagggagttcctccgcaggcaaagatgaaagggaccatgtgcttgttctggttcgctccttcatgattgatggaaagggccattttggatagaacaagcaatttgtgtgcatatagctcctcgacgcaaatgccttccatttatactagtctgccagcatggctcttgtctgcagatggttgcatacactgtaggcatctaagcttagtttagattactgaaagttccatttgtagtgatatgattaacgcgacactgtgagagctagtttggaaactcaaatcctcttgggatccctgacttttcctagagtgaacaagccgtggaggtatcattc

SEQ ID NO: 36354 - DNA, 712 bp, Panicum virgatum
  misc_feature: Ceres CLONE 1985045
  misc_feature: Encodes the peptide sequence at SEQ ID NO. 36355
aaaaaggaaacccgcacaccgagctcgagctgcgcacacgtcccactgccgccaaacgcttgctctgctcacgcccaacgctacgatggctgcaagcactgcggcggcgccaggctgctacgacacgccggagggcgtggacgtccggggccggtacgacccggcgttcgcgtccgtcctgacccgcggcgcgctggcggtcgtggcgggcctgcagcgcgagttccgcggcgccgtccggcacgccatggagcagcggcgggaggcccagcggcggtacgacgcctgcgagtcgccgcggttcgacccggccacgaggttcgtccgggaggggagctggaggtgcgcgcccgtgccgccggccgtcgcggaccgcaccgtggagatcacgggccccgccgagccccggaagatggtcatcaacgcgctcaactccggtgccaaggtcttcatggctgacttcgaggacgcgctgtcgccgacgtgggagaacctgatgaacgggcaggtgaacctgcgcgacgcagtggccggcaccatcacctaccgcgacgcggcgcgcggccgggagtacaggctcaacgaccagaccgcgaagctcttcgtccggccccgcggctggcacctcccggaggcgcacatcctcatcgacggcgagccggccatcggctgcctcgtcgacttcggcctctacttcttccacaaccacgcc

SEQ ID NO: 36355 - protein, 208 aa, Panicum virgatum
  misc_feature: Ceres CLONE 1985045
  misc_feature (18)..(208): Pfam Name: Malate_synthase Pfam Description: Malate synthase
  misc_feature: SWISSPROT Homolog: EC 2.3.3.9 Malate synthase
MAASTAAAPGCYDTPEGVDVRGRYDPAFASVLTRGALAVVAGLQREFRGAVRHAMEQRREAQRRYDACESPRFDPATRFVREGSWRCAPVPPAVADRTVEITGPAEPRKMVINALNSGAKVFMADFEDALSPTWENLMNGQVNLRDAVAGTITYRDAARGREYRLNDQTAKLFVRPRGWHLPEAHILIDGEPAIGCLVDFGLYFFHNH

SEQ ID NO: 36356 - DNA, 702 bp, Panicum virgatum
  misc_feature: Ceres CLONE 1985057
  misc_feature: Encodes the peptide sequence at SEQ ID NO. 36357
gaccaccgcctcgccgcctcggacccgccgccctccactgctcgaatccgactcaccgccgcctggctcccgggcccattcgccgacccgtcgccagcgaaggcgcgccgcctcctcccgctgaaagcgaagcgcgccacctcggaggaattgtagccgccgtcctcctcctgtagacggcgcggggcggagatcccgccggaggtggggctgatccccccctttctctcgattcaaggcgctggtagtttattggagaagctcctggggggagggacatggacatggcattgccagttgtgaatgccacagcggcggtgctcgctcgtgtctcggctgcgttcaatgcccctcttgcccgtaccgtcgtcttcggggtacatattgatgggcacttggtcgtggaagggcttcttattgcagtcatagtgttccagctcaccaggaagagctacaaacccccaaagaagccactcactgaaaaggagattgatgagctatgtgatgaatgggagccagagctgctatgtcctccgatcaaggagggggccaggattgacactccaatgttggaaagtgctgccggaccgcatacaatcgttgatggtaaagaagttgtcaactttgcgtcggcaaactacctcggtttaattggcaatgagaagattattgattcttgcgttggttcacttgagaaatatg

SEQ ID NO: 36357 - protein, 141 aa, Panicum virgatum
  misc_feature: Ceres CLONE 1985057
  misc_feature: SWISSPROT Homolog: EC 2.3.1.50 Serine C-palmitoyltransferase
  misc_feature: Functional homolog of the protein sequence given in SEQ ID NO 50804
  misc_feature: Useful for making plants with modulated nitrogen use efficiency
MDMALPVVNATAAVLARVSAAFNAPLARTVVFGVHIDGHLVVEGLLIAVIVFQLTRKSYKPPKKPLTEKEIDELCDEWEPELLCPPIKEGARIDTPMLESAAGPHTIVDGKEVVNFASANYLGLIGNEKIIDSCVGSLEKY

SEQ ID NO: 36358 - DNA, 729 bp, Panicum virgatum
  misc_feature: Ceres CLONE 1985075
  misc_feature: Encodes the peptide sequence at SEQ ID NO. 36359
tttcaacaacctgtttatcgcgttcaggcctgtaaagctctgtgctttccaatccccatcatctctgtctcgattgtttacacctgacaatcagagcccttctcttttccagcggattaaaatcttcccctttgcgctaaagcagtccaggggcagcattgctggctcgtaagcctctgccctgcagctctagtctgtcgggccagcatttagctccgcctgcagcagctgaaagcctcatcctgatcttcggcgtcgaatccgacccgtttccatcagttcaccaatctccctggtgctctcgagctctaggatagagggcctgaccccaattccggccccaaaatccgatctttgctggtgattcctcggccggtccgatggggaagctcggggacaggctgcgcgccttctccacgaaccggtggctggggttcgtcgccgcaatgtggctgcagtccatggccggcatcggctacctcttcggcgccatctcgccggtggtcaaggcggccctcgggtacaaccagcgccaggtggccgcgctcggcgtcgccaaggaccttggcgactgcgtcggcttcttcgccggctcgctctcggccgtgctgccgtcgtgggcgatgctgctcatcggcgcggcgcagaacttcctcgggtacggctggctctggctcatcgtcaccaggcaggtgccgccgctgcccctctggttgatgtgtgttctta

SEQ ID NO: 36359 - protein, 116 aa, Panicum virgatum
  misc_feature: Ceres CLONE 1985075
  misc_feature (15)..(116): Pfam Name: Nodulin-like Pfam Description: Nodulin-like
MGKLGDRLRAFSTNRWLGFVAAMWLQSMAGIGYLFGAISPVVKAALGYNQRQVAALGVAKDLGDCVGFFAGSLSAVLPSWAMLLIGAAQNFLGYGWLWLIVTRQVPPLPLWLMCVL

SEQ ID NO: 36360 - DNA, 732 bp, Panicum virgatum
  misc_feature: Ceres CLONE 1985077
  misc_feature: Encodes the peptide sequence at SEQ ID NO. 36361
tgaacggagttgcctcccccggtcaacgccggcgcgtgcccttctccccgcgccgccgcctccgccggatcgctcgccgcctccgagccatgctcccctccgccgcggagccagaaggcgaagccgcctcgggcggcgagcgccgcgcgtgggagccgcccttcgacgcctccgcgccggcgccgcccatgtcctacccgatcacggacctcgccgcgctggcctcgcgcgcctacctctccgccgacgccaacttccacctccccttcaacagggcctccgtccctggtcccgcctccgcgctccccgcgcgccggcgcgtcctcgtgtgccacgacatggagggcggctaccgcgacgacgcggcgcctcagggcggggccaacccggacgcctacgcgctctggcactggcacctcgtcgacgtcttcgtctacttctcgcactacctcgtcaccctcccgccgccctgctggaccaacgccgcccacctacacggcgtcaaggtattgggaacattcatcacggagtgggataaaggcgcggaggtttgcaaggagatgctcgcgacggaggcttctgcacagatgtatgctgagagactcacagagctggctactgccttgggcttcgatggctggctgataaacattgaggttaaacttgatgctcagttcatcgataacatgaaagattttgtcaatcatctaaccaagacgatgcatgctgccg

SEQ ID NO: 36361 - protein, 214 aa, Panicum virgatum
  misc_feature: Ceres CLONE 1985077
  misc_feature (84)..(214): Pfam Name: Glyco_hydro_85 Pfam Description: Glycosyl hydrolase family 85
MLPSAAEPEGEAASGGERRAWEPPFDASAPAPPMSYPITDLAALASRAYLSADANFHLPFNRASVPGPASALPARRRVLVCHDMEGGYRDDAAPQGGANPDAYALWHWHLVDVFVYFSHYLVTLPPPCWTNAAHLHGVKVLGTFITEWDKGAEVCKEMLATEASAQMYAERLTELATALGFDGWLINIEVKLDAQFIDNMKDFVNHLTKTMHAA

SEQ ID NO: 36362 - DNA, 748 bp, Panicum virgatum
  misc_feature: Ceres CLONE 1985081
  misc_feature: Encodes the peptide sequence at SEQ ID NO. 36363
  misc_feature (668)..(668): n is a, c, t, g, unknown, or other
agcccgaaacgcgagcacaatcaaagcctgaccaccaccaccattgccgccgccgccgccggagcagcagcgctcgcaatggcagctcgtcttgcttaagcgtcgaggagcgaggagctaggagcgcgcattggcgccgccggcgcgggcgcgagctgttgcgccacgtgcgaccgcgcgacgccgatcgccggcgcgcattgcgtccgcggggtgggttggctggccgccaatctcgctagccagcggcgccgccgaggagcggagcggcgcccccgcaaatggcgggccgccgaatgacgctgccgctgctggtgctgctgctggcggccgtgttcttggccgccgccgccgccgccgctggcagcaacagcaagtcctcggcggtgttcgaactgatccaccgggagcagccgacctggacggagctggcgcgcaatgaccgggagcgcatggcgttcatctcctcgcccgggcgccgccgcgccgcggagacgggcacggccagggccacgcccagcaaggccgcgcccgcgtccgaggccttcgcgatgccgctctcctcgggcgcctacacgggcaccggccagtacttcgtccgcttccgcgtgggcacgcccgcgcagccgttcctgctcgtggccgacaccggcagcgacctgacctgngtcaagtgcctccgccccgccgcggccggcgagcccgccttcgacggcggctacggctccccgctcccgggccggccgac

SEQ ID NO: 36363 - protein, 155 aa, Panicum virgatum
  misc_feature: Ceres CLONE 1985081
  misc_feature: SWISSPROT Homolog: EC 3.4.23.12 Nepenthesin
  misc_feature (129)..(129): Xaa is any aa, unknown, or other
MAGRRMTLPLLVLLLAAVFLAAAAAAAGSNSKSSAVFELIHREQPTWTELARNDRERMAFISSPGRRRAAETGTARATPSKAAPASEAFAMPLSSGAYTGTGQYFVRFRVGTPAQPFLLVADTGSDLTXVKCLRPAAAGEPAFDGGYGSPLPGRP

SEQ ID NO: 36364 - DNA, 1407 bp, Panicum virgatum
  misc_feature: Ceres CLONE 1985100
  misc_feature: Encodes the peptide sequence at SEQ ID NO. 36365
agttccgcctccaaattacaccgagccattttttggtctcggcttctcctccccaaatcgagccggccaccgctcttcctcccctcctcctcgtcgccgcccggatccggctgcgcctcccctagttccttcggaccagcggtgagccggcggaggtagcgagcgctgtggcggcggcgacggcggtagggttgcggtccgggaattgatccgggggaagaagaggcgcgggcagcggtggcgcctggcatggcgggggcgcccggggtggggccgggtgcggatgcggggggcggaggcggaggcggcgccgcggcggggctcaagacctacttcaagacccccgaggggaggtacaagctgcagtacgagaagacgcactccgccgtcctgcactacagccacggcggcaagaccgtctcgcagttgacagtggcatacctcaaggagaagcctgctagccagggctctcagccatcaacaccaagctccagcagtgggatgcgctctgcggcagcaaggttgctgggcagtgggaatggtagcaaggcacttagctttggtgggggcaacggtgcaaaccgggctgttgctggaagcagccgtttaggaggaggtcttggtacatctacgaaccttggtggatcacaaggggtgacaaattatgatggcaagggcacatacattgtcttcaatgctgctgatacactattcattagtgatctcaattcacaggagaaggatccaataaagtccatccatttcagcaactcaaacccactgtgccatgcattcgatccagaggccaaagaggggcatgacctgatcattgggatgggatcaggggatgtctattcaatgtcgctgaggcaacagttacaagatcctggaagaaagcctgtggcagctcaacattataataagggtgataaagacagctcctccaatggcagtcggtgtacatctgttgcgtgggtgccagagcgtgaaggcattttcgtcgttagccattctgatggaaatttgtatgtttatgataaaaacaaggatgggaacacagactgtacatttccagccgtgaaggatcaatcccagtttatggttgcacatgcaaagtcgagtaagagcaacccaattgctagatggcatatctgtcaaggttcgatcaatgcaatttccttttcaccagatggcgcatacctggcgactgttgggagagatggttatttgagagtttttgatttttcaaaggaacaactaatatttggtggaagaagttattatggtgcactgctgtgttgcacttggagctcagatggaaaatatctattaacaggtggtgaagatgatcttgtgcaggtatggagcatggatgacagaaagatcgttgcatgggggtgaaggaca

SEQ ID NO: 36365 - protein, 383 aa, Panicum virgatum
  misc_feature: Ceres CLONE 1985100
  misc_feature (293)..(331): Pfam Name: WD40 Pfam Description: WD domain, G-beta repeat
  misc_feature (335)..(373): Pfam Name: WD40 Pfam Description: WD domain, G-beta repeat
MAGAPGVGPGADAGGGGGGGAAAGLKTYFKTPEGRYKLQYEKTHSAVLHYSHGGKTVSQLTVAYLKEKPASQGSQPSTPSSSSGMRSAAARLLGSGNGSKALSFGGGNGANRAVAGSSRLGGGLGTSTNLGGSQGVTNYDGKGTYIVFNAADTLFISDLNSQEKDPIKSIHFSNSNPLCHAFDPEAKEGHDLIIGMGSGDVYSMSLRQQLQDPGRKPVAAQHYNKGDKDSSSNGSRCTSVAWVPEREGIFVVSHSDGNLYVYDKNKDGNTDCTFPAVKDQSQFMVAHAKSSKSNPIARWHICQGSINAISFSPDGAYLATVGRDGYLRVFDFSKEQLIFGGRSYYGALLCCTWSSDGKYLLTGGEDDLVQVWSMDDRKIVAWG

SEQ ID NO: 36366 - DNA, 787 bp, Panicum virgatum
  misc_feature: Ceres CLONE 1985100-R
tggtccccaccaagttctgatggaagtggagaaaatgtctatcgctttggttctgttggtcaggacacccaactgcttctgtgggacctggcacttgatgagattgttgtcccactacgtcatccttcaagtgtctcaccgacatttagcggtgggagtccgtctgcacattgggacaacgcttgccctccaacaggtgttctccagccttctccaaggatgcgagatgtcccgaagctatcaccacttgttgcccaccgagtacatgccgatcccctctccggtctggtgttcactaatgaatcaatcctcaccatctgtcgtgagggcctcatcaaaatctgggccagaccggaccagagtgaaaacaaccagcaatcaaattcttctgaattcgttttaggtagccctgttccaaaggatagggtgatcacatctaataaagtaggtggctccagcttcaagaaaccatcgtctgttcttgtcacatgacgaaccgacaggatgttccttgtgggcatttttcgacatgatgttcattgtgggcgttttcctctgcttaccctgatcactgtggtggtcatgtttcttaccagcaccgtgtttgagggggaaactgaagttctcgaaagaaggccgccgttggaggaaaacatttgttcatagatgttcccgggcttacagaaatgctagcgttgccagttgtggcgcaaaagaataatggaatatgctcttgtacagatacatatatttaatgataaaattgtataaatgtattgtgtgttcc

SEQ ID NO: 36367 - DNA, 647 bp, Panicum virgatum
  misc_feature: Ceres CLONE 1985110
  misc_feature: Encodes the peptide sequence at SEQ ID NO. 36368
cactgcccgtcgaccccgtcggcgcaaccttcggccgcctcgccaacggcctcacctactacgtccgctccaaccccaagccgcgcatgcgcgccgcgctctcgctcgccgtcaaggtcgggtccgtggtggaggaggaggacgagcgcggggtggcgcacatcgtcgagcacctcgccttcagcgccacttccaggtacaccaaccacgacatcgtcaagttcctcgagagcatcggggccgagttcggtgcctgccagaacgcgctcacctcatccgacgagaccatctatgagctgcttgtgcccgtcgacaagccaggcctgctgtctcaggccatctctgtcctcgcagagttcagctccgaggtccgggtgtcggcagaggatttggagaaagagaggggtgctgtgctggaggagtacaggggcggacgcaatgccacgggccggatgcaggactcccactgggcactgttgtttgaaggttccaagtatgcagaacgcctgccaattggtactgagaaggtgattcgaactgttccacatgaaactgtgaagcgattttaccagaagtggtaccatctaagcaatatggctgtatttgctgtgggagatttcccagatacgcaggctgttgttgagttg

SEQ ID NO: 36368 - protein, 214 aa, Panicum virgatum
  misc_feature: Ceres CLONE 1985110
  misc_feature (20)..(163): Pfam Name: Peptidase_M16 Pfam Description: Insulinase (Peptidase family M16)
  misc_feature: SWISSPROT Homolog: EC 3.4.24.64 Mitochondrial processing peptidase
LPVDPVGATFGRLANGLTYYVRSNPKPRMRAALSLAVKVGSVVEEEDERGVAHIVEHLAFSATSRYTNHDIVKFLESIGAEFGACQNALTSSDETIYELLVPVDKPGLLSQAISVLAEFSSEVRVSAEDLEKERGAVLEEYRGGRNATGRMQDSHWALLFEGSKYAERLPIGTEKVIRTVPHETVKRFYQKWYHLSNMAVFAVGDFPDTQAVVE

SEQ ID NO: 36369 - DNA, 702 bp, Panicum virgatum
  misc_feature: Ceres CLONE 1985117
  misc_feature: Encodes the peptide sequence at SEQ ID NO. 36370
gctggtgatgtgtcctactagggagcttgcaaaccaagtggctgtcgaggccaggaagcttctcaagtatcatcgctcactgggcgtgcaggttgtaattggtggcacacgattaactcaagagcaacgaagcatgcaggctaacccatgtcagatccttgttgctacacctggaaggcttaaggatcatctggaaaacacacctggtttttctacccgactcaaaggggttaaggttcttgttcttgatgaagctgaccgcctactggatatgggatttagaagagatattgagaaaataatcgcttcaattcctagagaacgacagacactgttgttttctgctactgttccagaagaggtccgccaaatttcgcacgtggcaatgaagaaggattataggtttatcaacactgttaaagagggagatgaggagacacattcgcaggtgagccagacatacatggttgcaccgctagacctgcacttttctatcctatatgatgtattgaagaaacatgtggctgaagatgcagactacaaggttattatattctgtaccactgcaatggtcaccaaacttgtggctgaagttctttctcagctgaaactcaatataagagagatccattccagaaagtcacagtctgctagaactaaggtctcggatgaattcaggaaagtcaagggcttgatactggt

SEQ ID NO: 36370 - protein, 233 aa, Panicum virgatum
  misc_feature: Ceres CLONE 1985117
  misc_feature (1)..(124): Pfam Name: DEAD Pfam Description: DEAD/DEAH box helicase
LVMCPTRELANQVAVEARKLLKYHRSLGVQVVIGGTRLTQEQRSMQANPCQILVATPGRLKDHLENTPGFSTRLKGVKVLVLDEADRLLDMGFRRDIEKIIASIPRERQTLLFSATVPEEVRQISHVAMKKDYRFINTVKEGDEETHSQVSQTYMVAPLDLHFSILYDVLKKHVAEDADYKVIIFCTTAMVTKLVAEVLSQLKLNIREIHSRKSQSARTKVSDEFRKVKGLIL

SEQ ID NO: 36371 - DNA, 736 bp, Panicum virgatum
  misc_feature: Ceres CLONE 1985147
  misc_feature: Encodes the peptide sequence at SEQ ID NO. 36372
gtgcatgaccagtggacacggacggcggcggcctcctcctctcccatcgcctcgaccgtcgccgccggaggaagcctgccgctcgcgccgccgtatcgatacgaattgaatcgcgctctgttgatgggcagcttgcgcgctccgccggcgccgctcgttgggagcgccagggttttattcggttctgagctccgttttgcctccgccagagtcctcaaaaccagagggttgactcccagtagcgcgatgaagtcgtataggctgtccgagctcagcgacgccgaccttagcggcctcaaggctcgtccccgcattgacttctcgtccatatttggcacggtgaatccaattgttgaggatgtccgtgtcagaggcgatgctgcggttaaggattatacagagaagtttgacaaggtcacactcgatgatgttgttgtgctggttagcgatctcccagatgcagagcttgatccagctgtgaaggaagccttcgacgttgcatatgacaatatatatgccttccatgtttcacaaaagttacccgagaagacagttgagaatatgaaaggggtaagatgtaaaagaataacaagatgcattggctctgttgggctgtatgtcccaggtggcactgccgtcttgcccttcactgcgttgatgctttctgtgcctgcacagattgctggatgcaaaactattgttctttgcacaccgcctagtcatgatggtagcatat

SEQ ID NO: 36372 - protein, 204 aa, Panicum virgatum
  misc_feature: Ceres CLONE 1985147
  misc_feature (55)..(203): Pfam Name: Histidinol_dh Pfam Description: Histidinol dehydrogenase
  misc_feature: SWISSPROT Homolog: EC 1.1.1.23 Histidinol dehydrogenase
MGSLRAPPAPLVGSARVLFGSELRFASARVLKTRGLTPSSAMKSYRLSELSDADLSGLKARPRIDFSSIFGTVNPIVEDVRVRGDAAVKDYTEKFDKVTLDDVVVLVSDLPDAELDPAVKEAFDVAYDNIYAFHVSQKLPEKTVENMKGVRCKRITRCIGSVGLYVPGGTAVLPFTALMLSVPAQIAGCKTIVLCTPPSHDGSI

SEQ ID NO: 36373 - DNA, 1716 bp, Panicum virgatum
  misc_feature: Ceres CLONE 1985181
  misc_feature: Encodes the peptide sequence at SEQ ID NO. 36374
attattctttgtcagttgctagctgcttggcttccatcaggaggccttggcccccacagggaggactccatattccaattgggatgatcaggagccctttctgcatccactcctcattcccaattctcctgcagactccaatccttcctccagatacagtgcgagggagataattgccaggaagtcttcagtgctggaagctactgcacatgtgatgccttcaagttcttgttcagatccaagacttcgtgatctagatgatgaacgccaagaagattaagctgcacgaccaccactacggatcgccgctgtgcgacccacagatgttcccggccgccgccgccgccgctgggctctccttccacccggggctcgtgagctccttgccgcagcagcacggcggctctggcagctggctgcacgaggagtacaccccgactccgaggactgccccagcgacgcagggcagctgcgtcggcgccgacaccgccgcgttcttcgccaccgagcacctgctgggcatggtgcggttcgacttccctctcgggacgacgacgctgccggcgacgatgacaacggccaagacgccgccgttcatccggtcgccggaggccgggcagctgtaccggccagtcggcccgctgctgcaccgcgacaactcggtgaggacgtactacgtcaggccgcagcatcgggacgccccggaatcgcctcctgcgctcaagctgccattgcagcagcagcaagagcaagggcatgcgctgtacggcaacggttccaccggcaggctgctcggcggcgaacccaaagcccactccttttcacctcatgttacggccaacacgcttctcccggcgatggaagcgccgggcatgcagagcccaactgagaacccgctgtccaggagctgcagtatcggtgcgccggggacccacaccgggaacgtcgtcgccgcgcccgggcacggcgcgccgagcaagacgcggatccggtggacgcaggacctccacgagcggttcgtcgactgcgtgaaccagctcggcggcgcggacaaggcgactccaaaggggattctgaagctgatgaactctggtgtcctcacaatctaccacatcaagagccaccttcagaaataccgcatagccaagtacatgccggcatcgacatccgaagggaaacaggagaaaagagccaccggaaatgacgcgcagaatctcgaccccagcactggaatgcagatcactgaagcactacgcgtccagctcgacgtgcagaggcgcctccacgagcagctcgagatccagaggaatctgcagctgaggatcgaggcgcagggcaagaagctgcagaagatgttcgaggagcagctcaaggcgagcaggaccgtcagggagccgccggaggagcagccggtccagagcgccggcgctgccgccttcgccggcgtcggcgagcaggacgacgaggacgcgttcgacgacgtgcagctgctgtccgtggccggcagcggatataacgatgccaggttcccgtcgaagataagctagccactgctgcctgcctcgtgctagttaatctgattacagttaatctgctttgtaatcgtaggatttgacagcaaatattggtgtagttgtccatgtatgatacgcacaatgtcggggaaggagtgcctttgtttttgccaaatcgagctgtgaacttttcttttttcct

SEQ ID NO: 36374 - protein, 429 aa, Panicum virgatum
  misc_feature: Ceres CLONE 1985181
  misc_feature (243)..(294): Pfam Name: Myb_DNA-binding Pfam Description: Myb-like DNA-binding domain
  misc_feature: Functional homolog of the protein sequence given in SEQ ID NO 50243
  misc_feature: Useful for making plants with altered lignin content
  misc_feature: Useful for making plants with altered terpenoid content
  misc_feature: The sequence is a functional homolog of SEQ ID NO 1857 in the 10/374,780 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
MMNAKKIKLHDHHYGSPLCDPQMFPAAAAAAGLSFHPGLVSSLPQQHGGSGSWLHEEYTPTPRTAPATQGSCVGADTAAFFATEHLLGMVRFDFPLGTTTLPATMTTAKTPPFIRSPEAGQLYRPVGPLLHRDNSVRTYYVRPQHRDAPESPPALKLPLQQQQEQGHALYGNGSTGRLLGGEPKAHSFSPHVTANTLLPAMEAPGMQSPTENPLSRSCSIGAPGTHTGNVVAAPGHGAPSKTRIRWTQDLHERFVDCVNQLGGADKATPKGILKLMNSGVLTIYHIKSHLQKYRIAKYMPASTSEGKQEKRATGNDAQNLDPSTGMQITEALRVQLDVQRRLHEQLEIQRNLQLRIEAQGKKLQKMFEEQLKASRTVREPPEEQPVQSAGAAAFAGVGEQDDEDAFDDVQLLSVAGSGYNDARFPSKIS

SEQ ID NO: 36375 - DNA, 665 bp, Panicum virgatum
  misc_feature: Ceres CLONE 1985183
  misc_feature: Encodes the peptide sequence at SEQ ID NO. 36376
gtgaggccgtgtgatcaattcttccatcgtcaccgaccaaggacgatcgtcgatcacaatatttcccctctttgcatgttggaacctgtatgtttccattgctgaccaagctaggaagatcagcaggcatcgatggcgtcttccctgttgcttgtcctccacttcttcctcctcgtcgtgtggccgtacgccgccgtgtcggccgggcaagcttcctgctgctataagcgcctgttcagcttgggcgactccatcaccgacgccggcaacctcgccaaggtggctcccaacatctccgccctattgcccccctacggcgagaccttcttccaccgccccaccggccgctactgtgacggcaggctcatagttgacttcattgcggaggcgttgaagctgcccctcctgacaccgttcctcgtcggaaagacagcggaggacttccggcagggggcgaacttcgccgtgtccggcgcgacggcgctgagccaacagttcttcaaggacatggggctggacctgaccatcattccgcccttctcgctggacgttcaggtggagtggttcaagcgcgtactccacatgctcggcccaacggaacatgagcgcaaggacataatgtccagctctgtgttcctggtgggggagattgggggcaacgacta

SEQ ID NO: 36376 - protein, 177 aa, Panicum virgatum
  misc_feature: Ceres CLONE 1985183
  misc_feature: SWISSPROT Homolog: EC 3.2.1.51 Alpha-L-fucosidase
MASSLLLVLHFFLLVVWPYAAVSAGQASCCYKRLFSLGDSITDAGNLAKVAPNISALLPPYGETFFHRPTGRYCDGRLIVDFIAEALKLPLLTPFLVGKTAEDFRQGANFAVSGATALSQQFFKDMGLDLTIIPPFSLDVQVEWFKRVLHMLGPTEHERKDIMSSSVFLVGEIGGND

SEQ ID NO: 36377 - DNA, 675 bp, Panicum virgatum
  misc_feature: Ceres CLONE 1985184
  misc_feature: Encodes the peptide sequence at SEQ ID NO. 36378
accaccaccagtccaccgctccgctcctctccactaccgccgccaccacccccaaaaccctcgccccggccggaggggaggagagcgaccgaggaggaggaagcgagcgcgaccggccggcggagatgcagatcttcgtgaagacgctgacggggaagaccgtcacgctggaggtcgagagcagcgacaccatcgccaccgtcaaggccaagatccaggacaaggaaggcatcccaccggagcagcagcggctcatcttcgcggggaagcagctggaggacgaccgcacgctggccgactacagcatccagaaggagtccacgctgcacctggtgcttcgcctccgcggtggcggcaggggcggctaccctaccgtgaccgtaccgtgggacctcatcaaccttgcccgcaaacacaatgagaagaagatggtctgccgcagatggtacaattcctcatgcagccgaggaggttggttcattttggtggaaagatctgttgaagctatgtgaccaattcagaggtgtggctacatgtacggtgggagatggaaaaagtgttcttttctggttagatgtttggaataacaggctcctaaaggactcactttcaaggctctttagctttgcaaaaaaccagaatatatcggtggcacaattcctacaaaccaacact

SEQ ID NO: 36378 - protein, 128 aa, Panicum virgatum
  misc_feature: Ceres CLONE 1985184
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature: Functional homolog of the protein sequence given in SEQ ID NO 50134
  misc_feature: Useful for making plants with modulated cold sensitivity
  misc_feature: Useful for making plants with modulated flowering time
  misc_feature: Functional homolog of the protein sequence given in SEQ ID NO 50512
  misc_feature: Useful for making plants with modulated nitrogen use efficiency
MQIFVKTLTGKTVTLEVESSDTIATVKAKIQDKEGIPPEQQRLIFAGKQLEDDRTLADYSIQKESTLHLVLRLRGGGRGGYPTVTVPWDLINLARKHNEKKMVCRRWYNSSCSRGGWFILVERSVEAM

SEQ ID NO: 36379 - DNA, 709 bp, Panicum virgatum
  misc_feature: Ceres CLONE 1985196
  misc_feature: Encodes the peptide sequence at SEQ ID NO. 36380
ctctcttttccgccctccaccctcgcgagcccctccaaccccacacgacccacctcctcggcggctgcggtggcgatgcagatggcggcgaccaccaccgactcccaggcggccgtgccgcctcaccaccctcacgcgcacccccatgcgccgccacagcacgcgcctccgcaccaccacatgccgcagccgcggtgggtcgtcataccgtacccgccgccgccgcccatggtggccgcgccgccgccgccgccgcagttcgccaagcacttcgccgctgggccgcccccgccgccacaagctgcggcagggcgccgcacgccgaccccgcccgcggccggatccggcgggaacgggtgcgaggagaataagacgatttgggttggcgacctccagtactggatggacgagaactacctacacagctgcttcgggcccagcggcgaggtagtgacaataaaagttatccggaataggcaaactggacaatcggaggggtatggatttgtggagttcttttctcactcatctgcagaaaaagctcttcagaattttactggtcatgtgatgcctaacaccgatagagcatttaagttaaactgggcatcatatagtatgggtgaaaagcgatctgaagtagcttctgatcactcgatatttgttggtgatctagctgctgatgttaccgatgaaatgctgatggagcttt

SEQ ID NO: 36380 - protein, 211 aa, Panicum virgatum
  misc_feature: Ceres CLONE 1985196
  misc_feature (101)..(172): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MQMAATTTDSQAAVPPHHPHAHPHAPPQHAPPHHHMPQPRWVVIPYPPPPPMVAAPPPPPQFAKHFAAGPPPPPQAAAGRRTPTPPAAGSGGNGCEENKTIWVGDLQYWMDENYLHSCFGPSGEVVTIKVIRNRQTGQSEGYGFVEFFSHSSAEKALQNFTGHVMPNTDRAFKLNWASYSMGEKRSEVASDHSIFVGDLAADVTDEMLMEL

SEQ ID NO: 36381 - DNA, 1778 bp, Panicum virgatum
  misc_feature: Ceres CLONE 1985204
  misc_feature: Encodes the peptide sequence at SEQ ID NO. 36382
atcccaagcaagcacccagtgatcgattagcttcagcagctacctcgatcacacaccgatcgagagcagctagctagcaatggcggccatggagatcggcgcaccggggagctcgctgcacggcatgacggggcgcgagccgacgttcgccttctccacggaggatgccgcggcggcgagcaagttcgacctgccggtggactcggagcacaaggccaagaccatcaggctcttctccttcgccaacccgcacatgcggaccttccacctgtcgtggatctccttcttcacctgcttcgtctccaccttcgcggcggcgccgctggtgcccatcatccgcgacaacctcaacctcaccaaggccgacatcggcaacgccggcgtggcctccgtgtcgggctccatcttctcccgtctcgccatgggcgccgtctgcgacctcctgggcccgcgctacggctgcgcgttcctcatcatgctcgccgcgcccaccgtgttctgcatgtcgctcatcgacaacgccgcgggctacatcgccgtcaggttcctgatcggcttctcgctggcgacgttcgtgtcgtgccagtactggatgagcaccatgttcaacagcaagatcatcggcaccgtcaacgggctggccgccggctgggggaacatgggcggcggcgccacgcagctcatcatgccgctcgtctacgacgtcatccgcaagtgcggcgccacgcccttcacggcgtggcggctcgcctacttcgtgccggggtcgctgcacatcctgatgggcgtcctcgtgctcaccctcgggcaggacctccccgacggcaatctcaggaccctgcagaagaagggcggcgccaacaaggacaagttctccaaggtgatgtggtacgcggtgaccaactaccggacatggatcttcgtcctcctctacggctactgcatgggcgtcgagctcaccaccgacaacgtcatcgccgagtactactacgaccacttcgacctggacctccgcgtcgccggcatcatcgccgcctgcttcggcatggccaacatcgtggcgcggcccctgggcgggatcctctccgacgtcggcgcgcgctactggggcatgcgcgcgcgcctctggaacatctggatcctccagacagccggcggcgccttctgcctctggctcggccgcgccagcacgctcccggcctccatcaccgccatggtgctcttctccttctgcgtgcaggcggcctgcggcgccatcttcggcgtcaccccgttcgtgtcccggcgctccctcggcatcatctccggcatgaccggcgccggcggcaacttcggcgcggggctgacgcagctgctattcttcacgtcgtccaagtactccacggggacggggctggagtacatggggatcatgatcatggcctgcacgctgccggtggtgctggtgcacttcccgcagtggggatccatgttcttccctcccagctccggcgccgccgaggagcactactacgggtcggagtggagcgaggaggagaagagcaaggggctccacagcgccagcctcaagttcgccgagaacagccgctccgagcgcggaaggcgcaacgtcatcgaggccgccgccgccgccacgccgccaaacaacacgccggagcacgtctgaggcgtacagtaagagcatatataggcgcctgctgtttgtgcgcatgaatcttcctatatacatgtatacggcagcaattcaataaaggttgtgaggcacatatgtacgtact

SEQ ID NO: 36382 - protein, 528 aa, Panicum virgatum
  misc_feature: Ceres CLONE 1985204
  misc_feature (65)..(424): Pfam Name: MFS_1 Pfam Description: Major Facilitator Superfamily
  misc_feature: Functional homolog of the protein sequence given in SEQ ID NO 51522
  misc_feature: Useful for making plants with altered carbon content
  misc_feature: Useful for making plants with altered nitrogen content
  misc_feature: Useful for making plants with modulated carbon-nitrogen partitioning
MAAMEIGAPGSSLHGMTGREPTFAFSTEDAAAASKFDLPVDSEHKAKTIRLFSFANPHMRTFHLSWISFFTCFVSTFAAAPLVPIIRDNLNLTKADIGNAGVASVSGSIFSRLAMGAVCDLLGPRYGCAFLIMLAAPTVFCMSLIDNAAGYIAVRFLIGFSLATFVSCQYWMSTMFNSKIIGTVNGLAAGWGNMGGGATQLIMPLVYDVIRKCGATPFTAWRLAYFVPGSLHILMGVLVLTLGQDLPDGNLRTLQKKGGANKDKFSKVMWYAVTNYRTWIFVLLYGYCMGVELTTDNVIAEYYYDHFDLDLRVAGIIAACFGMANIVARPLGGILSDVGARYWGMRARLWNIWILQTAGGAFCLWLGRASTLPASITAMVLFSFCVQAACGAIFGVTPFVSRRSLGIISGMTGAGGNFGAGLTQLLFFTSSKYSTGTGLEYMGIMIMACTLPVVLVHFPQWGSMFFPPSSGAAEEHYYGSEWSEEEKSKGLHSASLKFAENSRSERGRRNVIEAAAAATPPNNTPEHV

SEQ ID NO: 36383 - DNA, 331 bp, Panicum virgatum
  misc_feature: Ceres CLONE 1985222
  misc_feature: Encodes the peptide sequence at SEQ ID NO. 36384
gcatcgtcaccgccgaggacgccaggaaggccgtggaggttggggcggccggcgtgatcgtgtccaaccacggcgcccggcagctggactacgcgccgcccaccatctccgtgctcgaagaggtcgttaaggcggtggcgggggccgtgccggtgctggtggacggcggggtccggcggggcaccgacgtgttcaaggcgctggcgctgggcgccacggcagtcatggtggggaggccgtgttgtatttgttgatttattttgccgtgatgtttgtatgaggcctctgctgctcttttctaaagcaatgtagcaaattatctttgccgttc

SEQ ID NO: 36384 - protein, 83 aa, Panicum virgatum
  misc_feature: Ceres CLONE 1985222
  misc_feature: SWISSPROT Homolog: EC 1.1.3.15 (S)-2-hydroxy-acid oxidase
IVTAEDARKAVEVGAAGVIVSNHGARQLDYAPPTISVLEEVVKAVAGAVPVLVDGGVRRGTDVFKALALGATAVMVGRPCCIC

SEQ ID NO: 36385 - DNA, 725 bp, Panicum virgatum
  misc_feature: Ceres CLONE 1985223
  misc_feature: Encodes the peptide sequence at SEQ ID NO. 36386
gaggcggtctcccatttccctccctcctcctcaacttcccgcgtcctcccgtggtttcctcgcaaccgccccgcgccgccggcggtgaccacccccgccgcacatgacgcggccctgccatgggctgcatcctcggtaagctcgccaccgcgcccggctcctccctcttcttccccgccgccgcggccgccgcgggaggaggggacaaggcagcagaggtgcagctccaggcgccgcagcaggagcacatagcggcggtgaggaaggacgcgtccgggtggccgctctggctctccgaagccgccggcgacgcgctccgcggatgggcgccccgcggcgccgacgccttccacaagctcgagaagataggttcagggacatacagcaacgtgtacaaggcgattgacgtggacagcggccgcgtggtggcgctgaagaaggtgagggtggatggcgtcggcgaggccgagagcgcgcggttcatggcgcgggagatcgccctgctccgccgcctcggcgaccacccccacatcgtccgcctccacggcctcgtcacctcccgcctcaacaccgcgccgtccctctacctcgtcttcgagtacatggaacatgacctcaccggcctcaccgcctgcgcaactgcctccggccgccgcctgtcccttgctcaggtcaaatgctacatgaaacaattacttttccgggattgaacactgtcataacaa

SEQ ID NO: 36386 - protein, 196 aa, Panicum virgatum
  misc_feature: Ceres CLONE 1985223
  misc_feature (77)..(194): Pfam Name: Pkinase_Tyr Pfam Description: Protein tyrosine kinase
  misc_feature: SWISSPROT Homolog: EC 2.7.11.22 Cyclin-dependent kinase
MGCILGKLATAPGSSLFFPAAAAAAGGGDKAAEVQLQAPQQEHIAAVRKDASGWPLWLSEAAGDALRGWAPRGADAFHKLEKIGSGTYSNVYKAIDVDSGRVVALKKVRVDGVGEAESARFMAREIALLRRLGDHPHIVRLHGLVTSRLNTAPSLYLVFEYMEHDLTGLTACATASGRRLSLAQVKCYMKQLLFRD

SEQ ID NO: 36387 - DNA, 1653 bp, Panicum virgatum
  misc_feature: Ceres CLONE 1985233
  misc_feature: Encodes the peptide sequence at SEQ ID NO. 36388
attcgttccgacgcaccgcatccatcctgctcacctcccatggcggcggccgccgccgcgggggccacgccggcgactgcgaggaagaccctcttcaccgccaccgccaccgccaccctcttttcgtcctcactcacacgcgacagccgcggccgcggccgccgcagcttctcctgctcggccgcggccgccccgcgcctcgcgccgcagccgccggacctggtccggtgggtgcagcgcgagggcgggttcgtccaccctgccctccgcgtcacggaccacccggaacacggactcggggtctctgccgccgctgccgacggcgacatcccccctggggacgtccttatcacgctcccgggccgcctcccactacgactccgccgccccaccggcgctgcggacgacctgctcgtgcagcttgcccaacaagtaccggatgaactttgggctatgaagctgggcttgaggttgcttcaagaaagggccaaacctgattcattttggtggccatatattgccaatttgccagagacatttactgttccaatcttctttcctggggatgacattaaaaacttgcagaaaagatgccgttttcttcttgaattcgagaaagaggtgcgacagaagcttgatactgtgcccttgggtgatcatcctttttatggacaagatgtaaattcatcttcccttggatgggctatgtcggctgtgtcttctcgtgcatttcgtttgcatggggaaatcccaatgctgttgcgtctgattgatatgtacaaccatagtttcaacccaaatgctaggattgtccaggaaggaagtgtaaacagctcagacatgtcagttaaggttgttgctgagactaagattgagcaaaatgcagcaataacactgaattatggttgccaccccaatgatttctttcttcttgattatggatttgtgataacaccaaacccgtatgatcaagtggaactgagctatgatggaacacttcttgatgctgctagcatggcagcagggatctcttctcccaccttttcagcaccagccaagtggcaagaagatatcttgtcacagctaaacctgcttggagagggcgccattttgaaggtaagcttaggaggcccagacatagttgatggacgcttgttagctgctctacgggtgcttcttgcagctgatccagaggctgtgcacaagcatgacctgaaaactttgatgtcccttaacgcacaagctcctttaggcccaacagttgaagcctcagcacttcgaacagttcttgcactctgtgcgattgctctccaacacttccacacaaagataatggaagacaaagccattctaaaaggggaactgcctcttaccactgaactggccgtccagtttagattgcagaagaagtttatgattgttgacgtgatgcaaaatatctcccggagaatcaagatgttgtcgccacagaaatccaccacgtagttctttgctttcttcttcagacaatcaaataccgttctgaactggttactgcagataatagaagccccaatttcaattctgcaccatatctgcattgaaaagttcgtcgagcttacgtttatgtactgattgttgtggataatgatgaatccccaattttgactctgc

SEQ ID NO: 36388 - protein, 481 aa, Panicum virgatum
  misc_feature: Ceres CLONE 1985233
  misc_feature (335)..(460): Pfam Name: Rubis-subs-bind Pfam Description: Rubisco LSMT substrate-binding
  misc_feature (59)..(295): Pfam Name: SET Pfam Description: SET domain
  misc_feature: SWISSPROT Homolog: EC 2.1.1.127 [Ribulose-bisphosphate carboxylase]-lysine N-methyltransferase
MAAAAAAGATPATARKTLFTATATATLFSSSLTRDSRGRGRRSFSCSAAAAPRLAPQPPDLVRWVQREGGFVHPALRVTDHPEHGLGVSAAAADGDIPPGDVLITLPGRLPLRLRRPTGAADDLLVQLAQQVPDELWAMKLGLRLLQERAKPDSFWWPYIANLPETFTVPIFFPGDDIKNLQKRCRFLLEFEKEVRQKLDTVPLGDHPFYGQDVNSSSLGWAMSAVSSRAFRLHGEIPMLLRLIDMYNHSFNPNARIVQEGSVNSSDMSVKVVAETKIEQNAAITLNYGCHPNDFFLLDYGFVITPNPYDQVELSYDGTLLDAASMAAGISSPTFSAPAKWQEDILSQLNLLGEGAILKVSLGGPDIVDGRLLAALRVLLAADPEAVHKHDLKTLMSLNAQAPLGPTVEASALRTVLALCAIALQHFHTKIMEDKAILKGELPLTTELAVQFRLQKKFMIVDVMQNISRRIKMLSPQKSTT

SEQ ID NO: 36389 - DNA, 702 bp, Panicum virgatum
  misc_feature: Ceres CLONE 1985237
  misc_feature: Encodes the peptide sequence at SEQ ID NO. 36390
  misc_feature (624)..(624): n is a, c, t, g, unknown, or other
aaccagcagctcgcacacgcgccgcggccaactccgtgaggccgtccccccgcccgcccgcgccgcgcgagagagagaaccgcagaggagccgggcatgcagcgcctcgcctcctcctcctcccggaggctcctcggggccgcgctcgcccccgcccgggccaactccagcctctccgcggccgtcgccgccgcgtccccgaagatgccgggcttcgactacacgccgccgccctacgacgggccgcgggccgaggatatcttccggaagcgggccgagttcctcagcccgtccctcttccacttctacgaccgccccttgaacatagttgatggaaagatgcagtatttatttgatgaggatggtcgtcgttacctggatgcttttggtggcattgcaacagtttgctgtgggcactgccatcctgatgtggttgaagccatagtaaaccaggcaaagaggatccaacactccacagttctgtatctcaatcatgccattgtggattttgcagagtcattggcatccaaaatgcctggtgatttgaaggtagttttcttcacaaattcaggcacggaggcgaatgagctcgcactgatgattgcacgtctttacactggttgncatgacattatctccctcaggaatggataccatgggaatgcttctggaacaatgggtgctactgctcaatccaattgg

SEQ ID NO: 36390 - protein, 165 aa, Panicum virgatum
  misc_feature: Ceres CLONE 1985237
  misc_feature: SWISSPROT Homolog: EC 2.6.1.44 Alanine--glyoxylate transaminase
  misc_feature (140)..(140): Xaa is any aa, unknown, or other
MPGFDYTPPPYDGPRAEDIFRKRAEFLSPSLFHFYDRPLNIVDGKMQYLFDEDGRRYLDAFGGIATVCCGHCHPDVVEAIVNQAKRIQHSTVLYLNHAIVDFAESLASKMPGDLKVVFFTNSGTEANELALMIARLYTGXHDIISLRNGYHGNASGTMGATAQSN

SEQ ID NO: 36391 - DNA, 1851 bp, Panicum virgatum
  misc_feature: Ceres CLONE 1985251
  misc_feature: Encodes the peptide sequence at SEQ ID NO. 36392
gggggtctcctgacattcacgtcgtcctcctcgcaagtcgcatcccagcagtagaggaaataaatccaatctcgcggcggctgggccggtgatcgtgaatccggcgagcgcggcgccatggcgagcaacagggcaggcggcggcggctacgagagcggcagcgatcacgacggcgcgctgcagaagccgctgctgcccaacagcgggagctggtaccggatggggatggggtcgcgccagtccagcctcaacgccggcacctcctccatggccgtcctgcgcgagtcccacgtctccgccttgctctgcacgctcatcgtcgcgctcggccccatccagttcggcttcaccggcggctactcctccccgacgcaggacggcatcatccgggacctcaacctctccatctctgagttctctgtgttcggttcgctgtccaatgtcggcgccatggtcggggccatcgccagcgggcagatggctgagtacgttggccgtaaagggtcattgatgattgcagcgattccgaatgtcattggttggcttgcaatctcctttgcaaaagactcttcgtttctgtatatgggacgattgcttgaaggatttggtgttggtatcatttcctatgtggtaccagtatacatagcagagatatctcctcagaatatgagaggagctcttggctctgtgaaccagttgtctgtaacccttggcatcatgtttgcctatttgctcggcatgtttgttccttggagacttcttgcagtaataggaaccctgccttgcatagtgttgatacctggcctattcttcattccagaatctccaagatggctggcaaagatgaatatgatggatgattgcgagacttctctacaagttctgaggggattcgatgctgacatcactgcagaagttaatgatataaagagagcagtaacatcagcaaataaaaggactacaatccgttttcaagaattgaaccaaaagaaataccgcacaccccttatgctaggaattggccttcttgtgttgcaacaactaagtggagtaaacggtatcctgttttatgcaagcagcatcttcaaggctgcagggctcaagaacagtgacctggacacatttgcacttggagctattcaggttcttgccactggtgtcacaaccacgttcttggacagagcgggccgacgaatcctccttattatttctgctgctgggatgactctaagccttcttgcagttgctgttgtatttttcatcaaggataatgtttcacatgactctgacttgtacaacatcttaagtatggtgtccttggttggtctagtggcttatatcattgccttctcctttggcatgggtgccattccatggatcataatgtctgagattctccctgttagcatcaagagtcttgcaggaagcttcgcaacactggccaactggttgacatcctttggaataacaatgacagcaaatttgctgctcagctggagtgctggaggtacatttgctgcctacatgattgtgagtgctttcactcttgtgttcgtcatcatttgggtgccagagacaaagggaagaacccttgaggagatacaatggtcgttccgttgaggtccggcattcgtcaatgtatgcagtgttccttgctattcttttccaactcgaatcactggataaaggccacgcattctttctgttcatacaatgttttgtacatgagattttacacaatcttgtttagcatttcccataatagacatgtaaatgcttgtgcagtgacttttaattgcctcccccctcaacattgtacgatcaacagcaaaataaaaggcagagattggt

SEQ ID NO: 36392 - protein, 500 aa, Panicum virgatum
  misc_feature: Ceres CLONE 1985251
  misc_feature (64)..(499): Pfam Name: Sugar_tr Pfam Description: Sugar (and other) transporter
  misc_feature: Functional homolog of the protein sequence given in SEQ ID NO 51016
  misc_feature: Useful for biocontainment applications
MASNRAGGGGYESGSDHDGALQKPLLPNSGSWYRMGMGSRQSSLNAGTSSMAVLRESHVSALLCTLIVALGPIQFGFTGGYSSPTQDGIIRDLNLSISEFSVFGSLSNVGAMVGAIASGQMAEYVGRKGSLMIAAIPNVIGWLAISFAKDSSFLYMGRLLEGFGVGIISYVVPVYIAEISPQNMRGALGSVNQLSVTLGIMFAYLLGMFVPWRLLAVIGTLPCIVLIPGLFFIPESPRWLAKMNMMDDCETSLQVLRGFDADITAEVNDIKRAVTSANKRTTIRFQELNQKKYRTPLMLGIGLLVLQQLSGVNGILFYASSIFKAAGLKNSDLDTFALGAIQVLATGVTTTFLDRAGRRILLIISAAGMTLSLLAVAVVFFIKDNVSHDSDLYNILSMVSLVGLVAYIIAFSFGMGAIPWIIMSEILPVSIKSLAGSFATLANWLTSFGITMTANLLLSWSAGGTFAAYMIVSAFTLVFVIIWVPETKGRTLEEIQWSFR

SEQ ID NO: 36393 - DNA, 677 bp, Panicum virgatum
  misc_feature: Ceres CLONE 1985276
  misc_feature: Encodes the peptide sequence at SEQ ID NO. 36394
tacatcttgggagccgaagtagaaaggttaagcatcacaagggaatgtcatctgagtctgcccatgacgacagtaacgatgattcatctagtgaaaccacattgaactctaaccagaaggctaaggaatcaaaagcaactgggggcagtgctcaaaggagtgctgaaaatgagcattatagcagtgagagtgatggtagggaattcgtatcggagcccaaaagactcagtagtgatgagactgctggagttaaacttaagtatgcattatctgagttgcctgctgatgccaggcctctcttagtttttatcaacaagagaagtggggctcagcgtggagattcgctcaagcacaagctacatttccttttgaatccggtgcaggtttttgaattgagtccttcacaagggccagaaacaggattaattctgttcagaaaggtaccacatttcagaatacttgtgtgtggtggtgatggtacggttggttgggttcttgatgcgatagataagcaaaattatgaatcacctccccctgttgcaatccttccagctggcacaggcaatgatctttcaagagttttatcatggggaggtggccttggtgctgttgagaagcaaggtggtctctgcacagttttacatgacatagagcatgcagcagtcactatcctagat

SEQ ID NO: 36394 - protein, 224 aa, Panicum virgatum
  misc_feature: Ceres CLONE 1985276
  misc_feature (98)..(219): Pfam Name: DAGK_cat Pfam Description: Diacylglycerol kinase catalytic domain (presumed)
  misc_feature: SWISSPROT Homolog: EC 2.7.1.107 Diacylglycerol kinase
HLGSRSRKVKHHKGMSSESAHDDSNDDSSSETTLNSNQKAKESKATGGSAQRSAENEHYSSESDGREFVSEPKRLSSDETAGVKLKYALSELPADARPLLVFINKRSGAQRGDSLKHKLHFLLNPVQVFELSPSQGPETGLILFRKVPHFRILVCGGDGTVGWVLDAIDKQNYESPPPVAILPAGTGNDLSRVLSWGGGLGAVEKQGGLCTVLHDIEHAAVTIL

SEQ ID NO: 36395 - DNA, 711 bp, Panicum virgatum
  misc_feature: Ceres CLONE 1985297
  misc_feature: Encodes the peptide sequence at SEQ ID NO. 36396
gcaatcgtgatgtcattgatgaaatgtcaagcacaaatgcagctgttttgacttcagtactcaagcttattgataaatatgatctatatgggcaggtggcatatcccaagcatcataagcaatcagaagttcctgatatttatcgtttagcggcgagaacaaagggggtttttatcaattgtgcgttcattgaaccatttggacttaccttgattgaggctgctgcatatggtttaccaatggttgccacacaaaatggtgggcccgtcgacatacatcgggttcttgataatggaattcttgttgatccccacaatcaaaatgaaatagctgaagcactttataagcttgtatcagataagcatttgtgggcacaatgccgacagaatggtctgaaaaacatccatcaattttcatggcctgaacattgcaagaactacttgtcacgtgttggcacactcaagcctagacatccccgctggcaaaagaataatgatgcaactgaaatatctgaagcagattcacctgaagactctctaagggacgttcatgacatatctcttaacttaaagctttccttggacagtgaaaaatcaggcagcaaagaaggaaattcgaatattgtgagaagacatcttgaggatgcagtacaaaagttgtcaggaggtgttaatgccagcagtgtggaggggttaagtgagaatggtagat

SEQ ID NO: 36396 - protein, 236 aa, Panicum virgatum
  misc_feature: Ceres CLONE 1985297
  misc_feature (2)..(133): Pfam Name: Glycos_transf_1 Pfam Description: Glycosyl transferases group 1
  misc_feature: SWISSPROT Homolog: EC 2.4.1.14 Sucrose-phosphate synthase
  misc_feature: Functional homolog of the protein sequence given in SEQ ID NO 50680
  misc_feature: Useful for making plants with altered cell wall content and/or composition
  misc_feature: Useful for making plants with modulated biomass
  misc_feature: Useful for making plants with modulated carbohydrate content
NRDVIDEMSSTNAAVLTSVLKLIDKYDLYGQVAYPKHHKQSEVPDIYRLAARTKGVFINCAFIEPFGLTLIEAAAYGLPMVATQNGGPVDIHRVLDNGILVDPHNQNEIAEALYKLVSDKHLWAQCRQNGLKNIHQFSWPEHCKNYLSRVGTLKPRHPRWQKNNDATEISEADSPEDSLRDVHDISLNLKLSLDSEKSGSKEGNSNIVRRHLEDAVQKLSGGVNASSVEGLSENGR

SEQ ID NO: 36397 - DNA, 755 bp, Panicum virgatum
  misc_feature: Ceres CLONE 1985302
  misc_feature: Encodes the peptide sequence at SEQ ID NO. 36398
actcatcactgcccacacctaagccctcctgcatcattgtactactcatctgtctaggccggccattgttccagaagccatcatggctggcgccgcagttatcgccggcctggtgctcctcgccgccgccgccgcggctccggcgtccgccacggattacgtggtcggcgactcgtccgggtggaacagtggcgtggactacaccacctgggcgaaaggcaagaccttcagcgttggcgacaacctggtgttccagtacagcgcgatgcacacggtggcggaggtgagctcggcggactacagcgcgtgctcggccagcaactcgctgcagtcgtacagcgaccagaacaccaagatcgcgctcaccgcgcccggcacgcgctacttcatctgcggcaccgcgggccactgcagcggcggcatgaagctcgcccacgaccaggtccacctcgaccagcaccgccgtcgtccccgcccgccgacgacggtacgcccccggagaccaccacgccgtccgcgtcgacgccccccgcgacgacgacgacggcgcccacgaccaggtccacctcgccctgatggcctaggcaagaggcagtgctctgctgtccgtccccgtggcttctccgtttggttgcggtcggttgttttacgcgctctcaattcacgtctctgtgtcgcgaacgtctgctcgtgttgtgtacctgtacctgtacctgtacgatcattctagatttagaaggaactactgttctctg

SEQ ID NO: 36398 - protein, 215 aa, Panicum virgatum
  misc_feature: Ceres CLONE 1985302
  misc_feature (34)..(114): Pfam Name: Cu_bind_like Pfam Description: Plastocyanin-like domain
MAGAAVIAGLVLLAAAAAAPASATDYVVGDSSGWNSGVDYTTWAKGKTFSVGDNLVFQYSAMHTVAEVSSADYSACSASNSLQSYSDQNTKIALTAPGTRYFICGTAGHCSGGMKLAHDQVHLDQHRRRPRPPTTVRPRRPPRRPRRRPPRRRRRRPRPGPPRPDGLGKRQCSAVRPRGFSVWLRSVVLRALNSRLCVANVCSCCVPVPVPVRSF

SEQ ID NO: 36399 - DNA, 628 bp, Panicum virgatum
  misc_feature: Ceres CLONE 1985307
  misc_feature: Encodes the peptide sequence at SEQ ID NO. 36400
aaaagagcagagcacgatggggacccgagctgccagagcacgcacgagccctccccttcccgcccccatggccgcgccgcccctcctcctgctgctcctgctcgccgccgtatccttctcccgcgccgccgcggccggggctcgcgtggtgggggaggactacgtccggccgccgccggcgcggccccaccgcaaggcgctcctgagcatcttcccctggagcaagaaggaggcctccgcatctgacccgcagcaggtgcacatatcgctagcgggagaaaagcacatgagaataacatggattacagatgataactctgccccctctgtggtggactatggaaccaaagaaggagcatacacaatgacatctcaaggagaaagcacatcctacagctacttattgtatagctcaggaaaaattcatcatgtagttattggacctcttgaggacaacactatttattactaccgatgtggagggcaaggtccggaattccaatttaagacccctccatcccaatttccgttgtcattggctgttgttggtgatcttgggcagactagttggacaaaatcaactctggatcacattaagcagtgtgagcatgatatgcttttactccct

SEQ ID NO: 36400 - protein, 186 aa, Panicum virgatum
  misc_feature: Ceres CLONE 1985307
  misc_feature: SWISSPROT Homolog: EC 3.1.3.2 Acid phosphatase
MAAPPLLLLLLLAAVSFSRAAAAGARVVGEDYVRPPPARPHRKALLSIFPWSKKEASASDPQQVHISLAGEKHMRITWITDDNSAPSVVDYGTKEGAYTMTSQGESTSYSYLLYSSGKIHHVVIGPLEDNTIYYYRCGGQGPEFQFKTPPSQFPLSLAVVGDLGQTSWTKSTLDHIKQCEHDMLLL

SEQ ID NO: 36401 - DNA, 669 bp, Panicum virgatum
  misc_feature: Ceres CLONE 1985321
  misc_feature: Encodes the peptide sequence at SEQ ID NO. 36402
gtactcggcgtgcaagagcctgcagcgcttccggatcaacaagaaccagttcaccggcagcctcccggagggtctgtgggggctccccgcggcgacgatcatcgacgtctccgacaacgggttcaccggaaccatgtcgccgctgatcggccaggcgcagaacctgaaccagctgtggctgcagaacaacaacctcggcggcgcgataccgccggagatcggccggctcgggcaggtgcagaagctctacctgtccaacaactcgttctccggctcgatcccggcggagatcgggagcctgtcgcagctgacggcgctgcacctggaggacaacgcgctgaccggcgcgttgccggcggacatcggcggctgcgtcaggctcgtcgagatcgacgtctcccggaacgcgctgacggggtcggtcccggcctcgctgtcgctgctgtcgtcgctcaactcgctgaacctgtcgcacaaccagctcgccggggcgatcccgacgagcctccaggcgctcaagctcagctccgtcgacttctcctcgaaccggctgaccgggaacgtgccgccggggctgctggtgatcaccggcgaccagccgttcgcggggaaccccgggctctgcgtggacggcaggtccgagctcggcggcgtctgccacgtggacgg

SEQ ID NO: 36402 - protein, 222 aa, Panicum virgatum
  misc_feature: Ceres CLONE 1985321
  misc_feature: SWISSPROT Homolog: EC 2.7.11.1 Non-specific serine/threonine protein kinase
YSACKSLQRFRINKNQFTGSLPEGLWGLPAATIIDVSDNGFTGTMSPLIGQAQNLNQLWLQNNNLGGAIPPEIGRLGQVQKLYLSNNSFSGSIPAEIGSLSQLTALHLEDNALTGALPADIGGCVRLVEIDVSRNALTGSVPASLSLLSSLNSLNLSHNQLAGAIPTSLQALKLSSVDFSSNRLTGNVPPGLLVITGDQPFAGNPGLCVDGRSELGGVCHVD

SEQ ID NO: 36403 - DNA, 666 bp, Panicum virgatum
  misc_feature: Ceres CLONE 1985341
  misc_feature: Encodes the peptide sequence at SEQ ID NO. 36404
ggcgacaagacgtggttcagctattagcaagccggaaattgttcacctggttgacatgcgacgagcaaacaattgcgagataatgcttactaaatttaaaatgcctctgcctgatatgattagtgcaatattgactttggatacttctgttcttgataatgaccaagtggaaaatctcattaaattttgccctacaaaggaagagattgagatgttaaagggctatagtggcaacaaagaaatgcttgggaaatgcgaacagttcttcctggagctaatgaaagttccacgtgtggaagccaagctaagagtttttgcttttagaattactttctcaacacaggtagatgatctaagaactaacctaaccaccataaacgatgcaacaaaggaggtcaaagagtctttgaagttaaggcagataatgcagacaattctcacattaggaaatgcgttgaatcaagggacagcacgaggatctgctgttggcttcagattagacagccttcttaaactatcggatactcgagctagaaataataagatgacgctgatgcattatttatgcaagcttcttgctgagaaaatgcctgaacttcttgattttgacaaagacctaatccatttggaagcagcttctaagatccagctgaagttgcttgcgga

SEQ ID NO: 36404 - protein, 221 aa, Panicum virgatum
  misc_feature: Ceres CLONE 1985341
  misc_feature (1)..(221): Pfam Name: FH2 Pfam Description: Formin Homology 2 Domain
ATRRGSAISKPEIVHLVDMRRANNCEIMLTKFKMPLPDMISAILTLDTSVLDNDQVENLIKFCPTKEEIEMLKGYSGNKEMLGKCEQFFLELMKVPRVEAKLRVFAFRITFSTQVDDLRTNLTTINDATKEVKESLKLRQIMQTILTLGNALNQGTARGSAVGFRLDSLLKLSDTRARNNKMTLMHYLCKLLAEKMPELLDFDKDLIHLEAASKIQLKLLA

SEQ ID NO: 36405 - DNA, 1396 bp, Panicum virgatum
  misc_feature: Ceres CLONE 1985342
  misc_feature: Encodes the peptide sequence at SEQ ID NO. 36406
gtttaaggaagaaaaagccaacaatgtcgcatttcgacaaaaagaaagcaaaggacgaagaggaagttagtttaccttttgttggcttgaagaaaggtgctgtcatccaaaatgtccgaatgttcagctcccctaaactcaatgtcaaagagtgctactatctcctgacaaaaatactttatatcctcaatggtcagggcgagtctttcacagaggacgaagcaaccgcagttttcatcgctgttacaaaattgtttcaatctcaagatgctggattacgacgaatgatgtttcttttattaaaagaactcggatccaagtctggagaaacaattatggcttttgcaagtttggttaaagatgtaaatagtgacgttgaggttaaccgagccaactctattcgtgttatctgtggattaatggattccaaacttttatcttcaaccatggaaagatatctcaaacaagctattgttgatcgagaaccatatgttgctactgctgcactcgttgcaggttctcatttagctagtcattcaatggacgttgttaaaagatggacaagtgaaattcaagaagctcttaattctccatctgtcatggtccaataccatgcattaggattacttcatagaattaaaagtcacgatcgtcttgctgtaaccaaactcgttaagactctctcaagagacgtccttcgctcacaccttggccactgcctcttaattcgctacgcaacacaggtcttagaagagattggagaacttgacgctgatttatttggttatattgaaaactgccttagacataaaagtgaagttgtagtttatgaagcagcaagatcaatctgtggattaagaaacataacaccaaaagatttatcagcagcaatctccgttcttcaatgtctgctagtctcatcgaaaccaacgacaagattcgcagcagttaaaactcttaataaggttgctacaagatttccttctgcaatcactagcagctgtatgtttgaaatggaatctcttattactgatgtaaatcgctcaatcgcaaccctcgcaattacaaccctcttaaaggttgaaactgagtcaaatgttgatagattaatgaaacaaatttcaggatttatttcggatatcggagatgaagataaattagttgttgttgatggaattacaacattatcatcaaaatatcctggaaaacattatacaatcatgaactacttatcttcaatgttaagaagtgaaggaggaaaagaatataaaacggcattagtcgaagcaattctcggcatagtccaaaaaattcctgaggccaaagaaacaggacttgaacatctttgcgagtttattgaggattgcgagtttccaggattggcgactcaagtctt

SEQ ID NO: 36406 - protein, 457 aa, Panicum virgatum
  misc_feature: Ceres CLONE 1985342
  misc_feature (23)..(456): Pfam Name: Adaptin_N Pfam Description: Adaptin N terminal region
MSHFDKKKAKDEEEVSLPFVGLKKGAVIQNVRMFSSPKLNVKECYYLLTKILYILNGQGESFTEDEATAVFIAVTKLFQSQDAGLRRMMFLLLKELGSKSGETIMAFASLVKDVNSDVEVNRANSIRVICGLMDSKLLSSTMERYLKQAIVDREPYVATAALVAGSHLASHSMDVVKRWTSEIQEALNSPSVMVQYHALGLLHRIKSHDRLAVTKLVKTLSRDVLRSHLGHCLLIRYATQVLEEIGELDADLFGYIENCLRHKSEVVVYEAARSICGLRNITPKDLSAAISVLQCLLVSSKPTTRFAAVKTLNKVATRFPSAITSSCMFEMESLITDVNRSIATLAITTLLKVETESNVDRLMKQISGFISDIGDEDKLVVVDGITTLSSKYPGKHYTIMNYLSSMLRSEGGKEYKTALVEAILGIVQKIPEAKETGLEHLCEFIEDCEFPGLATQV

SEQ ID NO: 36407 - DNA, 607 bp, Panicum virgatum
  misc_feature: Ceres CLONE 1985342-R
  misc_feature: Encodes the peptide sequence at SEQ ID NO. 36408
attagtctcaaccagattctcagtcaacctccaatacaacgtccatgaagtcgacccatccactggggaagagcaagaggagggttatccggatgaggctagattggatgaggttgagtttggtttaggggattatatgacaaaacttgttcatccagaatggtcaactgcatttgatgcattccctgaagacaaacaaggaaaatcaacattcaaaaaaccagccggagcaaaccaatcctctcctttatctcaagcgacaacggagatggtgagttttttggggttggcaccttgtgatgattctgggaaactacctgcaggagcaacaaaacatatcctctatctctctgggaaattcatggatgtacctctccctcctccagaaggaacaaaaccaggaatccctgttcttgcaagaataagaatgagattcgtacaaggacaaggtgttattttggaattagttgtgagatcaagtaatgttgatttatcaaatgctgttgctaatgcaatttttgcctaaaaatggaaaatcaaacgaaaagggaaaaaaaaacaaacttttagattccaaaaaagaatttaaataaatcagaaatttgac

SEQ ID NO: 36408 - protein, 174 aa, Panicum virgatum
  misc_feature: Ceres CLONE 1985342-R
  misc_feature (1)..(173): Pfam Name: Gamma-COP Pfam Description: Coatomer gamma subunit appendage domain
LVSTRFSVNLQYNVHEVDPSTGEEQEEGYPDEARLDEVEFGLGDYMTKLVHPEWSTAFDAFPEDKQGKSTFKKPAGANQSSPLSQATTEMVSFLGLAPCDDSGKLPAGATKHILYLSGKFMDVPLPPPEGTKPGIPVLARIRMRFVQGQGVILELVVRSSNVDLSNAVANAIFA

SEQ ID NO: 36409 - DNA, 1466 bp, Panicum virgatum
  misc_feature: Ceres CLONE 1985346
  misc_feature: Encodes the peptide sequence at SEQ ID NO. 36410
gcacacaaacctcagcaaaagcaagccaagcccgtcgtgcgccttgctgcgacactgatccatggggtccaccgagcagcagccgccggagccggtggccgccgcctccgccgtggtggaggcgtcgccggagatcatcttccggtccaagctcccggacatcgccatcaccaacaccctcccgctgcaccgctactgcttcgagcggctcgccgaggtggccgaccgcccctgcctcattgacggcgccacgggcttcgtccgcacctacgccgaggtcgaccgcctcacccgccgcctcgcggcggcgctccgtcgcgagccgttcgggctcggccgcggcgcggtggtcatgaacctggtgctcaactcggcggagttcgtgctctccttcttcgccgcgtcgcgcgtcggcgccgcggtcaccaccgccaacccgatgtccacgccgcacgacatcgccaaccagatcgcggcgtcgggcgccacggtcgtgttcaccgagtccatggccgcggacaagctccccggcggcctcacggtcgtcctcatcgacgcgcgccgcgacggctgcctccacttctgggacgacgtcatggccagcgtccccgacgacgaggccgccgccgccgccggcgaccaggaggcgggcgacagcgagttcgaccccgacgacgtggcggcgctgccgtactcgtccggcacgacggggctccccaagggcgtgatgctgacgcaccggagcctgagcaccagcgtggcgcagcaggtcgacggcgacaaccccaacatcggcttcaccgccgccgacgtcatcctctgctccctccccatgttccacatctactcgctcaacaccatcctgatgtgcgggctccgcgtcggcgccgccatcgtggtcatgcgccgcttcgacctcgccaggatgatggagctcgtggcgcggcaccggatcaccgtcgcgccgctcgtgccgcccatcgtcgtcgccgtggccaagagcgaccaggccgcggcgcacgacctgtcgtcggtcaggatggtgctctccggcgccgcgcccatgggcaaggacctcgaggacgcgttcatggccaagctccccggcgccgtgctcggacagggctacggcatgacggaggccggtccggtgctgtccatgtgcctggcgttcgccaaggagcccttcaaggtgaagtccggcgcctgcggcacggtggtgcgcaacgccgagctgaatatcgtcgaccccgacaccggcaagtccctcggccgcaaccagcccggggagatctgcatcagggggcaacagatcatgaaaggttacctgaacaacccggaggccacgaagaacagcatcgacgctgacgggtggctgcacaccggcgacgtcgggttcgtggatgacgacgacgagatcttcatagtcgacaggctcaaggagatcatcaagtacaagggcctac

SEQ ID NO: 36410 - protein, 468 aa, Panicum virgatum
  misc_feature: Ceres CLONE 1985346
  misc_feature (69)..(468): Pfam Name: AMP-binding Pfam Description: AMP-binding enzyme
  misc_feature: SWISSPROT Homolog: EC 6.2.1.12 4-coumarate--CoA ligase
  misc_feature: Functional homolog of the protein sequence given in SEQ ID NO 50770
  misc_feature: Useful for making plants with altered carbohydrate content
  misc_feature: Functional homolog of the protein sequence given in SEQ ID NO 51137
  misc_feature: Useful for making plants with altered lignin content
  misc_feature: Functional homolog of the protein sequence given in SEQ ID NO 51138
  misc_feature: Useful for making plants with altered cell wall content and/or composition
MGSTEQQPPEPVAAASAVVEASPEIIFRSKLPDIAITNTLPLHRYCFERLAEVADRPCLIDGATGFVRTYAEVDRLTRRLAAALRREPFGLGRGAVVMNLVLNSAEFVLSFFAASRVGAAVTTANPMSTPHDIANQIAASGATVVFTESMAADKLPGGLTVVLIDARRDGCLHFWDDVMASVPDDEAAAAAGDQEAGDSEFDPDDVAALPYSSGTTGLPKGVMLTHRSLSTSVAQQVDGDNPNIGFTAADVILCSLPMFHIYSLNTILMCGLRVGAAIVVMRRFDLARMMELVARHRITVAPLVPPIVVAVAKSDQAAAHDLSSVRMVLSGAAPMGKDLEDAFMAKLPGAVLGQGYGMTEAGPVLSMCLAFAKEPFKVKSGACGTVVRNAELNIVDPDTGKSLGRNQPGEICIRGQQIMKGYLNNPEATKNSIDADGWLHTGDVGFVDDDDEIFIVDRLKEIIKYKGL

SEQ ID NO: 36411 - DNA, 610 bp, Panicum virgatum
  misc_feature: Ceres CLONE 1985346-R
  misc_feature: Encodes the peptide sequence at SEQ ID NO. 36412
ttggaggcccttctcatcactcacccgagcatcgtcgacgctgccgttgttgggaaacaagtcgagccagaaattggcgaaatcccggtcgcctttgtggccaaggcagaagggagtgagctcagcgaagatgacgtgaagcaatttgtggcaaaggaggtgatctactacaagaaggtccgcgaggtgatttttgttgacaagatccccaaggcgccatcgggcaagatccttcgcaaggagctaaggaaacagcaccagcagcagcacccacaatctgtgtgaccatctgatcagatcagaccatgcatcgctcggtattcatgattcgttcggatgttgacatgtggaggaagaacttaattcagaggcacatagtgtttttatctgttatgttgtgtaatgtatctagctatagctggtgaggcagagaggatcgattgagtggaaattggatttttgaagtacatatgttggggagtcatgtttgttagagtttcttaccgtatgtttgttgccgttcgtgactcgcgatgcttgtccgatatgtttggttgtcaacgaaccgaaagctgttaattattatatggatacaagcacgcaataattc

SEQ ID NO: 36412 - protein, 94 aa, Panicum virgatum
  misc_feature: Ceres CLONE 1985346-R
  misc_feature: SWISSPROT Homolog: EC 6.2.1.12 4-coumarate--CoA ligase
  misc_feature: Functional homolog of the protein sequence given in SEQ ID NO 51523
  misc_feature: Useful for making plants with altered carbohydrate content
  misc_feature: Functional homolog of the protein sequence given in SEQ ID NO 50496
  misc_feature: Useful for making plants with altered lignin content
  misc_feature: Functional homolog of the protein sequence given in SEQ ID NO 50497
  misc_feature: Useful for making plants with altered cell wall content and/or composition
LEALLITHPSIVDAAVVGKQVEPEIGEIPVAFVAKAEGSELSEDDVKQFVAKEVIYYKKVREVIFVDKIPKAPSGKILRKELRKQHQQQHPQSV

SEQ ID NO: 36413 - DNA, 1403 bp, Panicum virgatum
  misc_feature: Ceres CLONE 1985353
  misc_feature: Encodes the peptide sequence at SEQ ID NO. 36414
ccaccaggccaccaccactcactcgggctctccgttcctgcatcccccctccgtcctcgtgccgcggcctcccctcgcccgctcctccgatccggatggcgcccaccgagtccggcccggcggcctagcgcagctcgggctcggcccgggcccaggctccagccgcgccgtccccgcagtcgtcagctcgagcccccgaggtgcgtgccgcgcggatccgtgctcctgccccggcgattctttggggctgtcgttcttcagcgttttcggtttggttcgcgcggaaaggagaggtttttaggccgttcctcctgctgattccgccgggtgtggtggatttgatggagacgggctcgttttttaggagattttgtgggattggtgtcaaaggcaggcgctttcgactgttcccgtagttgactttcgcaggatttggctgctagagatggtttttctactcattttttggggggcaaccatcgtcgtatgcggtggaacaaatgctgctccaccgttctgttaaataatttgtgactgtgctcattttcgtgcgcctcctgggctgcatctgatttgcttctcttaatgcaacaatccctggcaccagttatatttggtttcatatgagcattattgctcatgttaacatgtgatgcatatgcttctgctattgttgtactgttttgtctcttttctttttgtgtgtagtggttactagtggaagttaacatgttgcagtgggatcctgaccaaatcgagtgtccatccaaccaacccaactaactgtactcaagtctcgttgattttaggatggtacagtttagtaaattgaggttggtgggctggtggccatactaggggaaggtacatgtttgttctttattggtggtgacctgacctcaacttgaggatttttcccttgatgataggctgtcatagaattagtgcacccgagctttatgctggtttgatcaccatgtcagtaaaatctggttgctaatagtagaaacaatctttgtctagcggatgtgttgaaattgacattgtgcttgctttgtatggcatactgtccatttactacatatggggggttacttttttaatttaatcttacatggaggtaggttgctagatgtaggaaaaggacatggctgaccacatgtttctctccagagggaatcgcaataaattgttactaacagactaatacatcttgcaggtctttatattcagctaagagagatgcttgtccatctctaggagcccccttttttggtacttcggcagtgctctttcctttttggagtagatgtcatttcgtagcattgtgcgcgatgtaagggatggcttcgggagcttatctaagaggggattcgaggtcaggcttctgggtcatcgcagag

SEQ ID NO: 36414 - protein, 31 aa, Panicum virgatum
  misc_feature: Ceres CLONE 1985353
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
MSFRSIVRDVRDGFGSLSKRGFEVRLLGHRR

SEQ ID NO: 36415 - DNA, 643 bp, Panicum virgatum
  misc_feature: Ceres CLONE 1985353-R
  misc_feature: Encodes the peptide sequence at SEQ ID NO. 36416
gaacactgttcgacgatgaagagtgcaacgacaggcctttggtcctccgcaacaaggctccaagatggcacgagcagcttcagtgctggtgcctcaacttccgtggtcgggtcacggttgcttcagtcaagaacttccagctggtggctgcgacacaaccttccgtgggagcccccacgccgtcccagccagccccagcgcctccaccggaccaagacaaggtcatacttcagttcgggaaggtcgccaaggacatgttcaccatggactaccgctacccgctgtcagcattccaggccttcgccatctgcctaagcagcttcgacaccaagctggcatgcgaataaaatctgccagttgcatgagcatcgcccaccagtgcttatcggagatcaaagtagctgactgcccccaagtatatctgggggtaccattctacttcaggttgtgctgccctattaacgcagaaacagccccagaaatgcatggggctctttcagctgaacacccttctgataatctgtagctgctgccgtagcatatgttgtactgcattcccattttttttgtttttcagttgtgtagtttcccttccctgtaacaataactctgtatgcgtattcggatgattcttgcgttcttc

SEQ ID NO: 36416 - protein, 114 aa, Panicum virgatum
  misc_feature: Ceres CLONE 1985353-R
  misc_feature (1)..(108): Pfam Name: Tub Pfam Description: Tub family
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 462 in the 10/666,642 US patent application
  misc_feature: The sequence is a functional homolog of SEQ ID NO 458 in the 10/666,642 US patent application
TLFDDEECNDRPLVLRNKAPRWHEQLQCWCLNFRGRVTVASVKNFQLVAATQPSVGAPTPSQPAPAPPPDQDKVILQFGKVAKDMFTMDYRYPLSAFQAFAICLSSFDTKLACE

SEQ ID NO: 36417 - DNA, 1796 bp, Panicum virgatum
  misc_feature: Ceres CLONE 1985368
  misc_feature: Encodes the peptide sequence at SEQ ID NO. 36418
gtcatttttttggttcaaccaaaatggaacaacaggagtcaatgcctgcaagaaatgatatccaagaaaatggcggctctccaagtcctttcgacgatctcgccagagaaattttcgaacatggactcaaatttgaaagcagtgatccctcacaatccttctgctatttttgccttgctgcacaacaaaattatgtccctgcaatacaccgtcttggtctttgctatcaagaaggcaatggttgtaaaagtaatgcagctttagcatccaacattttcaaaaacaaatactctggaaatcaacagtctcctaccgaattaattgaacgaaatatcaccaagacagacgtggagttgggatcaggatacaacggaactgtttggaaaggaattctaaaagatggaaacaatgatcgaattgtggccatcaaaattcttgatgttgcaaaaagcgcccttcatcacaaagaaattaagatactatccaaactccaaaaccatccaaatgttgttcacatgtttggagttttcaaaaattggattgttatggagttcgttgaaaatggaaatttaaatgattatcttaatgatacatctcacttcattccatttagtctccaattatcgattgcaatcgatgttggaaatggacttgcctttttacattctcgaggcatcctgcatcgagatttaaagtcttctaatgtgcttttggattggaggttgagagcaaaactagcagattttgggctctcaagagccacagatcaagaaagtagctctgaattacgaagtaaagtgggaacattacgttggaaggcacctgagagcctgcaatgttccgagaatcggttccaagcttctgctgatgtttattccttaggtctgattttatggcagctttccgcaaggagaggcccctatgactgggaagatagtgctactgttataactttctggattacttctttcaaaaccgaaaatattccagatggttgtccttattcatcagtcatccaagattgttggaaaccagaccctctgtctcggcctagttcgagtaatgttaccaaatcacttattgaactgcgtttaaagactcgcccattgggatcccttaatagtttggctagtttgaaagattggttgaaactccattatgagcaacacagatattctcatattggtttattttctcaaactaaagatcgacctttttctcagttatttaccgaattgtccatgacaagatatgaagaaaataatccaggaaagcagaaattaatcagatttgatcaaattctttcccttttcaactctcgccaaacaagccttgttcttgaaggatatgcagggtccggaaaatcgactctttgtaaatattttgctcgagaacaatactttgaaagccgattcagtgctgttatcatgattgaactacctctattattttcaatttgggagcagaaaaaacttcaagttgacattaatgtaccagaccttcttcttcactattttgaatgcactgatacctcttttataaattccacctctgaagcaatcacaaaatctccttcaagtatcctatggatttttgatgcatttgatgaaattaacaatcatattctgttttcgttcttcatagaaaaactcattcattccaaaatagattggtgtaaacattttattatctcatctcgagaagaaagacaagtacgattagatcgatacattcatttgaggctagaaccttggaacaaggatcaaatccaacaatatgtatcgaggtttatgtgc

SEQ ID NO: 36418 - protein, 590 aa, Panicum virgatum
  misc_feature: Ceres CLONE 1985368
  misc_feature (105)..(352): Pfam Name: Pkinase Pfam Description: Protein kinase domain
  misc_feature: SWISSPROT Homolog: EC 2.7.11.1 Non-specific serine/threonine protein kinase
MEQQESMPARNDIQENGGSPSPFDDLAREIFEHGLKFESSDPSQSFCYFCLAAQQNYVPAIHRLGLCYQEGNGCKSNAALASNIFKNKYSGNQQSPTELIERNITKTDVELGSGYNGTVWKGILKDGNNDRIVAIKILDVAKSALHHKEIKILSKLQNHPNVVHMFGVFKNWIVMEFVENGNLNDYLNDTSHFIPFSLQLSIAIDVGNGLAFLHSRGILHRDLKSSNVLLDWRLRAKLADFGLSRATDQESSSELRSKVGTLRWKAPESLQCSENRFQASADVYSLGLILWQLSARRGPYDWEDSATVITFWITSFKTENIPDGCPYSSVIQDCWKPDPLSRPSSSNVTKSLIELRLKTRPLGSLNSLASLKDWLKLHYEQHRYSHIGLFSQTKDRPFSQLFTELSMTRYEENNPGKQKLIRFDQILSLFNSRQTSLVLEGYAGSGKSTLCKYFAREQYFESRFSAVIMIELPLLFSIWEQKKLQVDINVPDLLLHYFECTDTSFINSTSEAITKSPSSILWIFDAFDEINNHILFSFFIEKLIHSKIDWCKHFIISSREERQVRLDRYIHLRLEPWNKDQIQQYVSRFM

SEQ ID NO: 36419 - DNA, 670 bp, Panicum virgatum
  misc_feature: Ceres CLONE 1985372
  misc_feature: Encodes the peptide sequence at SEQ ID NO. 36420
cattcacggaagtctctttcaactggactgggttttggagcgccatggcgtccaatctgaccaaccaatcaaggaatgtcctcagcaagaaactcctggccggtgacaaggatgctatggatgacatcaacctcttctcagtgatcactatactgtcatttctgctgtcttgtcctctgatgctgttcgcagaaggcatcaagttcaccccagggtacctccagagcacgggtttgaacctccaagaactctgcgtcagggcagcacttgcagggttttgcttccatggctatcagaagctctcctacttgatcttgtcgagggtgtcaccggtgacccactccgtcgccaactgcgtgaagcgcgtggttgtcatcgtctcttcagttatcttcttcagcacccccatttcgcctgtcaatgcactaggaactggtgctgcattagggggagttttcctgtactctaggctgacgagaacaaagaagccgaagaatgcatgagggatggattacagtagtacgtgaaaaaatcttgtatacacaacttcgaggtatacagagtagatcgggatatattattgaggagctaatcaagcatagtttccacagtagatgagggcacaggcagctcgtttgcacagctgcaacatacacgaatgaatatattc

SEQ ID NO: 36420 - protein, 166 aa, Panicum virgatum
  misc_feature: Ceres CLONE 1985372
  misc_feature (10)..(156): Pfam Name: TPT Pfam Description: Triose-phosphate Transporter family
FTEVSFNWTGFWSAMASNLTNQSRNVLSKKLLAGDKDAMDDINLFSVITILSFLLSCPLMLFAEGIKFTPGYLQSTGLNLQELCVRAALAGFCFHGYQKLSYLILSRVSPVTHSVANCVKRVVVIVSSVIFFSTPISPVNALGTGAALGGVFLYSRLTRTKKPKNA

SEQ ID NO: 36421 - DNA, 725 bp, Panicum virgatum
  misc_feature: Ceres CLONE 1985379
  misc_feature: Encodes the peptide sequence at SEQ ID NO. 36422
aggagcaagcaactgcagcggggaggaagatgagggcggtggtgatcacgcgcggcggcggacctgaggtgctagaggcccaggacgtggaggacccggcaccgctgggggaaggcgaggtgctcctccaggtcgccgccgcgggcgtcaaccgcgccgacacgctccagcgccacggccgccacccgccgcccgccggcgcgtccccgtacccggggctcgagtgctccggcaccatcctcgcgctcggtcccaacgtgccctcgcgatggtccgtcggcgacaaggtgtgcgcgttgctaagcggcggcgggtacgcagagaaagtggtggttccggcggggcagctgctgcctgtgccggagggggtgtcgctaacggttgcagccggcttgcccgaggtggcctgcaccgtctggtcgaccgtgttcatgaccagccacctctcgcccggcgaatcattccttgtccatggaggatcaagtggaattggtactttcgctattcagattgcaaagcacctcggaattaaggtttttgtgactgcaggaagcgaagaaaaactagcagcctgcaaagatttgggtgctgatgtatgcataaactacaaaactgaagacttcgttgaacgtgtcaaacaggaaaccaatggaaagggtgttgatgtcattctggacaatattggaggatcatatctccagcgtaacctgaacagcttaggtgtt

SEQ ID NO: 36422 - protein, 231 aa, Panicum virgatum
  misc_feature: Ceres CLONE 1985379
  misc_feature (141)..(229): Pfam Name: ADH_zinc_N Pfam Description: Zinc-binding dehydrogenase
  misc_feature (28)..(110): Pfam Name: ADH_N Pfam Description: Alcohol dehydrogenase GroES-like domain
  misc_feature: SWISSPROT Homolog: EC 1.6.5.5 NADPH:quinone reductase
MRAVVITRGGGPEVLEAQDVEDPAPLGEGEVLLQVAAAGVNRADTLQRHGRHPPPAGASPYPGLECSGTILALGPNVPSRWSVGDKVCALLSGGGYAEKVVVPAGQLLPVPEGVSLTVAAGLPEVACTVWSTVFMTSHLSPGESFLVHGGSSGIGTFAIQIAKHLGIKVFVTAGSEEKLAACKDLGADVCINYKTEDFVERVKQETNGKGVDVILDNIGGSYLQRNLNSLG

SEQ ID NO: 36423 - DNA, 711 bp, Panicum virgatum
  misc_feature: Ceres CLONE 1985390
  misc_feature: Encodes the peptide sequence at SEQ ID NO. 36424
gagcctccactttgtccttctccctcaggcatagtcgtccgttccccttctcagcttctccctccactccgagcaaacaccgcgacgattctccacgacaaacagcaacccgactcacagaaggtaccctgcatgctggggaagacaaatagatgttggctgtcatgtgaaaatgctttgcagtcaggattttgcttgaaagaagatgaatggtgagtctagtagttatgataaggtggagagcctgttacaaggtggaagttcagaaccacacaatgtgccactagagtatttgagaaacatcacaaacaacttctctaatgagctactgcttggtgaaggtgcttttggcacagtatataaaggagtgctacaaaatggggaaacgattgccgtgaagaaacttaagttgtcaataccaggagttcatgataggcaatttgagaatgaagccagtcatcttatgaggcttaaacacccaaatgtagtgctacttgtaggctggtgttctgaaacacagtatatacctatggagtacaacggaacatacgtctgcgctgagaagccagaaaggttgctttgcttggagtacatgcctaaaggaaatcttcgtgggtttctttcagatgaatcttctggacttggttgggacacacgctacaaaataattcagggtatctgttatggtttacgttatctccacgaggaatg

SEQ ID NO: 36424 - protein, 168 aa, Panicum virgatum
  misc_feature: Ceres CLONE 1985390
  misc_feature (37)..(168): Pfam Name: Pkinase_Tyr Pfam Description: Protein tyrosine kinase
  misc_feature: SWISSPROT Homolog: EC 2.7.11.1 Non-specific serine/threonine protein kinase
MNGESSSYDKVESLLQGGSSEPHNVPLEYLRNITNNFSNELLLGEGAFGTVYKGVLQNGETIAVKKLKLSIPGVHDRQFENEASHLMRLKHPNVVLLVGWCSETQYIPMEYNGTYVCAEKPERLLCLEYMPKGNLRGFLSDESSGLGWDTRYKIIQGICYGLRYLHEE

SEQ ID NO: 36425 - DNA, 729 bp, Panicum virgatum
  misc_feature: Ceres CLONE 1985396
  misc_feature: Encodes the peptide sequence at SEQ ID NO. 36426
tgactcgtccgtgaccgcgccccttccctcgggagaaaaacacgcacaaagcaaagagaaacccgcaagccatccgcccgccggctcgccgcggtcaaacttgtcggcggctgcggcggcgggggccggcgggggcgactggccgcggggcgcgcccggtctcgtgggatcccttcggacctccgcagattcccgcgcggggggtgttttgatttgaatgagaggagcccggcggcgggatgggctcctcctcgcagggttcggcggccgtggcggcggcccgggtggacctctgcgcgctcgacttcgtgcccgtcttcgccaaggagatgattgccggcggcgtcgctggggccttctccaagaccgccatcgcgccgctcgagcgcgtcaagatactgctgcagactagaacaaatgagtttggatctcttggagttctcaaatcattgaagaaagtgagacaacatgatggaatcaagggattttacaagggaaatggtgccagtgtgctgagaattgttccttatgctgcactacatttcatggcatatgagcggtaccggtgttggatcttgaataactgcccctcactggggacagggcctttagtggatcttttagctggctcagcatcagggggaactgctgtattgtgtacttatcccttggatttggcccggactaagcttgctttccaggtttttacttcgccacttatgatgtctt

SEQ ID NO: 36426 - protein, 163 aa, Panicum virgatum
  misc_feature: Ceres CLONE 1985396
  misc_feature (26)..(116): Pfam Name: Mito_carr Pfam Description: Mitochondrial carrier protein
MGSSSQGSAAVAAARVDLCALDFVPVFAKEMIAGGVAGAFSKTAIAPLERVKILLQTRTNEFGSLGVLKSLKKVRQHDGIKGFYKGNGASVLRIVPYAALHFMAYERYRCWILNNCPSLGTGPLVDLLAGSASGGTAVLCTYPLDLARTKLAFQVFTSPLMMS

SEQ ID NO: 36427 - DNA, 766 bp, Panicum virgatum
  misc_feature: Ceres CLONE 1985406
  misc_feature: Encodes the peptide sequence at SEQ ID NO. 36428
gtcgtcccccatcctcacatcccacgccacaccctcccatcccctcgcatccccaacgaccgcgccgcagcagtacgtgtgcgattcgttaggggggcgggcgggcgagcgagcgcgcaaagatgtcgacgtgcgcggcggacctcgcgccgctgctgggcccggcggcggcgaacgccacggactacctctgcagccagttcgcggacacggcgtcggcggtggacgccacgtacctgctcttctcggcgtacctcgtcttcgccatgcagctcggcttcgccatgctctgcgcgggctccgtccgcgccaagaacaccatgaacatcatgctcaccaacgtgctcgacgccgccgcgggggcgctcttctactacctcttcggcttcgccttcgccttcggcacgccctccaacggcttcatcgggaagcagttcttcggcctcaagcacctgcccaggaccggcttcgactacgacttcttcctctaccagtgggccttcgccatcgccgccgcgggcatcacgtcgggctccatcgccgagaggacgcagttcgtcgcctacctcatctactccgccttcctcacgggcttcgtgtacccggtcgtgtcgcactggttctggtccgccgacgggtgggccgccgcgagccgcacgtccggcccgctcctcttcggctcccgcgtcatcgactttgccggctccgggggtgtccacatggtcggcggcgtcgccgggctctggggcgcgctcatcgagggccc

SEQ ID NO: 36428 - protein, 214 aa, Panicum virgatum
  misc_feature: Ceres CLONE 1985406
  misc_feature (36)..(214): Pfam Name: Ammonium_transp Pfam Description: Ammonium Transporter Family
  misc_feature: Functional homolog of the protein sequence given in SEQ ID NO 51423
  misc_feature: Useful for making plants with modulated carbon-nitrogen partitioning
  misc_feature: Functional homolog of the protein sequence given in SEQ ID NO 51424
  misc_feature: Useful for making plants with altered carbon content
  misc_feature: Useful for making plants with altered nitrogen content
MSTCAADLAPLLGPAAANATDYLCSQFADTASAVDATYLLFSAYLVFAMQLGFAMLCAGSVRAKNTMNIMLTNVLDAAAGALFYYLFGFAFAFGTPSNGFIGKQFFGLKHLPRTGFDYDFFLYQWAFAIAAAGITSGSIAERTQFVAYLIYSAFLTGFVYPVVSHWFWSADGWAAASRTSGPLLFGSRVIDFAGSGGVHMVGGVAGLWGALIEG

SEQ ID NO: 36429 - DNA, 750 bp, Panicum virgatum
  misc_feature: Ceres CLONE 1985408
  misc_feature: Encodes the peptide sequence at SEQ ID NO. 36430
acatgctaaactgtcttttctgcgatgtttcagtatgagaaggcggcacagtcgctcagcaagcacgacccaccgattgttctcgctaaggttgatgccaacgaggacaagaacaggccgcttgctaccaagtacgaggtccaagggttcccgaccctcaagatcttcaggaaccagggcaagaacattcaagagtacaagggaccaagggaggccgagggcatcgttgagtacctgaagaagcaagtcggccctgcctccaaggagatcaagtccccggaagatgcggcatcccttatcgatgacaaaaagatctacatcgttggtgtcttcacagaattcagtggcactgagtttacaaatttcatggaggttgctgagaagctgaggtctgactacgactttggccacactctgcacgccaaccacctcccacgtggtgatgctgcggtggagaggccattggttaggctgttgaagccatttgatgagcttgttgttgacagcaaggattttgatattgctgctctggagaagtttattgatgctagcagcaccccccgagttgttacttttgacaagaaccctgacaaccacccataccttttgaagttcttccaaagctcagcccccaaggctatgctatttgtgaacttctccactggaccttttgactcccttcagtctacttatgctgctgccgcagaggagttcaggacaaggaaactcagttcctcattggtgacattg

SEQ ID NO: 36430 - protein, 241 aa, Panicum virgatum
  misc_feature: Ceres CLONE 1985408
  misc_feature (2)..(74): Pfam Name: Thioredoxin Pfam Description: Thioredoxin
  misc_feature: SWISSPROT Homolog: EC 5.3.4.1 Protein disulfide-isomerase
MFQYEKAAQSLSKHDPPIVLAKVDANEDKNRPLATKYEVQGFPTLKIFRNQGKNIQEYKGPREAEGIVEYLKKQVGPASKEIKSPEDAASLIDDKKIYIVGVFTEFSGTEFTNFMEVAEKLRSDYDFGHTLHANHLPRGDAAVERPLVRLLKPFDELVVDSKDFDIAALEKFIDASSTPRVVTFDKNPDNHPYLLKFFQSSAPKAMLFVNFSTGPFDSLQSTYAAAAEEFRTRKLSSSLVT

SEQ ID NO: 36431 - DNA, 683 bp, Panicum virgatum
  misc_feature: Ceres CLONE 1985412
  misc_feature: Encodes the peptide sequence at SEQ ID NO. 36432
atgcattgctgaattcgatctcgacgtcagttttgcaggctcttctgatccttccctcgcacgcttggggcggatacttgcgcgcgcgcagaggtttgcagctgaactaggcgcgccgcggacatggcggcgtggtctaggatcgggaggggcacgcagctgtcgctgtcgcagtccctgtcgaggatcgtctccgagggcggcgcgtctccgacggaggcggcgtccgcgctgcgcggtgccgctgcgctgtcacgcgcccgggggcagcacgcgtcgtcgctccacggcctcgcgttcgcggggctcgcgggcaggagcgcggccgccggggcccacctcctcccgccgccgagaaccaggggcgtcggcaccacgcccgcgaggctgcgcccagcgtcgtcggcggcggtggcggcggagctctcggacgcggagacgagggagcccgatgccgcggcggcggcgcctcctcgtcccgtgccgaggctcgggccgacgacgcccgcggagaagccccgcttggtggtgctgggcaccgggtgggcggcgtgccggctgctcaaggacgtggacacgagcgcctacgacgtggtgtgcgtctccccccggaaccacatggtgttcacgccgctgctcgcgtccacgtgcgtcggcacgctcgagttccgctccgtcgtcga

SEQ ID NO: 36432 - protein, 186 aa, Panicum virgatum
  misc_feature: Ceres CLONE 1985412
  misc_feature: SWISSPROT Homolog: EC 1.6.5.3 NADH dehydrogenase (ubiquinone)
MAAWSRIGRGTQLSLSQSLSRIVSEGGASPTEAASALRGAAALSRARGQHASSLHGLAFAGLAGRSAAAGAHLLPPPRTRGVGTTPARLRPASSAAVAAELSDAETREPDAAAAAPPRPVPRLGPTTPAEKPRLVVLGTGWAACRLLKDVDTSAYDVVCVSPRNHMVFTPLLASTCVGTLEFRSVV

SEQ ID NO: 36433 - DNA, 1346 bp, Panicum virgatum
  misc_feature: Ceres CLONE 1985414
  misc_feature: Encodes the peptide sequence at SEQ ID NO. 36434
atttttgacttgaccggcttttttataattttatttggcacaaagtaagcaaccatgtctgacggatacgaagaacccgaatacgaagaatttggtgatcccgacgaagactataacgaagattcaaatgggataaacaactctttttcccgcagttgttctcttcagccaactcttttgaaaaaaggatccacactcttcgttaccattgaggatattaaacaacttatcacccagaaatgcaaggacatctgcgaactattgggaactcctacagatgaagccatcattatatataaccactttagatggcgaaaagatcttgttgaaggagaatatttcggcgacgaagaaaacatccgcaaaaaggccggtcttgagccccaagagaaggctgccgagcccgcaggagataacttgacctgtcttttgtgttttgatgagaaaccaagagcagatttcgaagcgttgaaatgcaatcattatctttgtaaagactgctggaaagaatatatcgagtataatgtgactcgcccagagaattttttcttttggaaatgtccaatggaaggctgcaacatgattgttccaaattcattcaatctcaaatatatcgccaacaaggaccaagaatatttgttttacaaaaaaatggccgtggcatatgccgataacagtaaatctttgaratggkgtcctgcggccgattgcgaatatggcgctgaagtaraaagcgtcggcgtgaaatgtattgaatgtccttgcggatggatgttttgttttaaatgcgggcttgaaaatcataggccttgcaattgtcctttagcggttgaatggacaaaaaaggacaaagcaggcggcgcaaaccctaaatggctttgggggaatccaaaaaactgccctaaatgtaaaaaaccgattgaaaaaaatcaaggctgtaattatatgagatgcaaacttccgggctgtcagtatgaattttgttggttttgccttggagatgggaaaactcttaatgatcttttcaaatgtaacaaattcaacaatctgagcaaggaaaaaaaggataaattgcctaattcggaacaggataaaagacaggagttacaaaaatacgtgttttattatgagagatttatgaataataatatggccattgaaagtgctaataaaatcttgaggaatttgaaaaaggagcaaaagggaaatcgcattaaatctggccttgacgttacttcagcttgagtttttggagaatggttgtcaggccttgagaaatgccaaaaaaccattgaaatggccttatgcttatgggttctatttgaccattgattttcaaggaaatt

SEQ ID NO: 36434 - protein, 396 aa, Panicum virgatum
  misc_feature: Ceres CLONE 1985414
  misc_feature (195)..(255): Pfam Name: IBR Pfam Description: IBR domain
  misc_feature (212)..(212): Xaa is any aa, unknown, or other
  misc_feature (214)..(214): Xaa is any aa, unknown, or other
  misc_feature (226)..(226): Xaa is any aa, unknown, or other
MSDGYEEPEYEEFGDPDEDYNEDSNGINNSFSRSCSLQPTLLKKGSTLFVTIEDIKQLITQKCKDICELLGTPTDEAIIIYNHFRWRKDLVEGEYFGDEENIRKKAGLEPQEKAAEPAGDNLTCLLCFDEKPRADFEALKCNHYLCKDCWKEYIEYNVTRPENFFFWKCPMEGCNMIVPNSFNLKYIANKDQEYLFYKKMAVAYADNSKSLXWXPAADCEYGAEVXSVGVKCIECPCGWMFCFKCGLENHRPCNCPLAVEWTKKDKAGGANPKWLWGNPKNCPKCKKPIEKNQGCNYMRCKLPGCQYEFCWFCLGDGKTLNDLFKCNKFNNLSKEKKDKLPNSEQDKRQELQKYVFYYERFMNNNMAIESANKILRNLKKEQKGNRIKSGLDVTSA

SEQ ID NO: 36435 - DNA, 1403 bp, Panicum virgatum
  misc_feature: Ceres CLONE 1985417
  misc_feature: Encodes the peptide sequence at SEQ ID NO. 36436
cttcttgccgagctgccaaccatcttctcttccggtcatctccactctcgccgttcccccagcttcgtttgactcacgcgtgagagaggaacggagagccgctcgtagccgtctcgtctcgcgtgcggcgatcgctgcagggttcgatccagaggctctccgtcgccggccatggtgattctggaccgcacgccgggggtcacctccagcccgctccagatgtcctctcctagggttccgcgggaggaggcctcgccgccctccgaccccattctcccgtacctcaggtctatcagcagggcgatggatgagcttgggacagggccacagtgtgacccatcagccttagaccagctcaagtgttacttgaccgaatgcattagaaaatatggggatgagtaccagtactccactgatccacgcctcctgaagatctggattctctatgcagatgcaactgatgccttccccaaggtttacaagcagctggaagagaaacgaatgttcttggagcatgcactgctctatgaatcatatgcattgtatctatgtgctgaagggaaactgcaggaggctgacaaggtgtatgcgattggtatctccaggaaagcggagcccctcgaccatttgcagaaaacacacttgacatttctgaaacatctggagaattttgtagaagaggcagacgtggatgcacagccatcaaaaaaacagaagaatgaacctagtgtggtagatccgtggtctgtatcttctaggaacactttactggaaacagttaacgatgacctcaggacgtttgctggctatcacaagagtaacaaggtctactacggaaaggtggccttaacttcttcacagcatattttaagaaacaaggtcattgaattaggtggcagaaagtatcagatcaaaggatctactggcactggcacttttgctaaagtatacaaagccactgttgatggtaatgcagaagaaattgttgctctgaagattcagaatcccccatttccttgggaattttacatgtatcgccaacttgatatgcgtatacctgaagttgagcgaccaagctttggatacgcgcatgaagtgcatatcttctctgatgttagcgtgctagtctgtgattacctgccatatggaacgcttctggatgtcataaactcccacatagtagttgagcggcatatggatgaagttttatgcatgtattataccattgagatgctgagaatgctggaaacactgcatagtgttggcataatccatggtgatttcaaacctgacaacatgctcgtttgctatccaagtggggatatcacagaagaaaccttcagaagcgaaacaagagacgtgcagaatcaggggctctgccttgttgactggggccgcggcat

SEQ ID NO: 36436 - protein, 410 aa, Panicum virgatum
  misc_feature: Ceres CLONE 1985417
  misc_feature (11)..(143): Pfam Name: Mad3_BUB1_I Pfam Description: Mad3/BUB1 homology region 1
  misc_feature: SWISSPROT Homolog: EC 2.7.11.1 Non-specific serine/threonine protein kinase
MVILDRTPGVTSSPLQMSSPRVPREEASPPSDPILPYLRSISRAMDELGTGPQCDPSALDQLKCYLTECIRKYGDEYQYSTDPRLLKIWILYADATDAFPKVYKQLEEKRMFLEHALLYESYALYLCAEGKLQEADKVYAIGISRKAEPLDHLQKTHLTFLKHLENFVEEADVDAQPSKKQKNEPSVVDPWSVSSRNTLLETVNDDLRTFAGYHKSNKVYYGKVALTSSQHILRNKVIELGGRKYQIKGSTGTGTFAKVYKATVDGNAEEIVALKIQNPPFPWEFYMYRQLDMRIPEVERPSFGYAHEVHIFSDVSVLVCDYLPYGTLLDVINSHIVVERHMDEVLCMYYTIEMLRMLETLHSVGIIHGDFKPDNMLVCYPSGDITEETFRSETRDVQNQGLCLVDWGRG

SEQ ID NO: 36437 - DNA, 1491 bp, Panicum virgatum
  misc_feature: Ceres CLONE 1985421
  misc_feature: Encodes the peptide sequence at SEQ ID NO. 36438
aaaaggcccaatttttctcgtccccgcggctcgtttttttcctttttttttctccgataaatggcttcttttcctctacagtttacaccacaccgatccagccatcaatccccatcactgagcagtcgtcgtcttcccccgtcgcactcgctctccctccacccccttgaagggtctctcttctttccttcctacccctcttcagctgaggcccggtccttgggcttggagtaccgcggtccgtgagtcgtttcttgctggtcaaaagagattcaagaatcgcctggggactcctatttcttgatgtggatgacatgacaacaccgaatacaatggtgataaagatggcaggatctgctccctgctaagtttttacctacaagttcaccaaggatagtatgtcagctagggattctaaccgtccatatgaaatttcagaagattctcaaatgccgtactacaataactcagcaactgtagaagaaaatgataggtttcatgtgatgcaaaataatctagatcatcaccactcttctcccgatgatggatcgcagaagattaatagttccaacactcaaatatttgaagcacagtactgcactctggaatcatcctcagcaaatggtgtttatcctgcacaaagctccacatcttctcacagcatttcccctttaagtgggagccccctgtctcagcatgatagccattcmgaccgcacatatagttctcccccaagtgcctcctgtcttactgaagttgcggatctccaaattaaactaaaagagttagagaatgccattcttggacctgaattggacattacttctgacagccctgagagcttcttacaagccaatgttcaattgagaccagacaactggagacaacttctgggaattgatgcaggagacttgaagcaagtaatcattgcatgtggtaaggctgttgcagagaatgatgtctttgcaacagaattgcttatatctgagctgggtcagctcgtatctgtatcaggagatccaatgcaacgacttggagcatatatgttggaaggaattgttgcaagactttcttcctctggcagtatgctatataaatctttgaaatgtaaagaacctacaagctctgagctcatgtcatacatgcatctcctttatgagatctgtccattcttcaagtttggttatatgtcagcgaatggtgccattgccgaggctattaagggagagaactttgttcacatcattgacttccaaattgctcaggggagccagtggattactctgatacaggcccttgctgcaaggcctgggggtccaccatacattaaaatcactggtattgatgactcaaattctgcttatgccagagggggcgggcttgatatagttgggaggagattgcatagtgttgctcagtcgtgtggtcttccctttgagttcaatgctgttccagctgctagccatgaggttcagcttgcgcatcttgcgg

SEQ ID NO: 36438 - protein, 364 aa, Panicum virgatum
  misc_feature: Ceres CLONE 1985421
  misc_feature (146)..(364): Pfam Name: GRAS Pfam Description: GRAS family transcription factor
  misc_feature: The sequence is a functional homolog of SEQ ID NO 474 in the 10/666,642 US patent application
  misc_feature: Functional homolog of the protein sequence given in SEQ ID NO 50758
  misc_feature: Useful for making plants with modulated light quality sensitivity
  misc_feature: Functional homolog of the protein sequence given in SEQ ID NO 50759
  misc_feature: Useful for making plants with modulated low light sensitivity
MSARDSNRPYEISEDSQMPYYNNSATVEENDRFHVMQNNLDHHHSSPDDGSQKINSSNTQIFEAQYCTLESSSANGVYPAQSSTSSHSISPLSGSPLSQHDSHSDRTYSSPPSASCLTEVADLQIKLKELENAILGPELDITSDSPESFLQANVQLRPDNWRQLLGIDAGDLKQVIIACGKAVAENDVFATELLISELGQLVSVSGDPMQRLGAYMLEGIVARLSSSGSMLYKSLKCKEPTSSELMSYMHLLYEICPFFKFGYMSANGAIAEAIKGENFVHIIDFQIAQGSQWITLIQALAARPGGPPYIKITGIDDSNSAYARGGGLDIVGRRLHSVAQSCGLPFEFNAVPAASHEVQLAHLA

SEQ ID NO: 36439 - DNA, 1323 bp, Panicum virgatum
  misc_feature: Ceres CLONE 1985430
  misc_feature: Encodes the peptide sequence at SEQ ID NO. 36440
agcgcacaccaccattcggttgctctgcttgagtcagtgcctgcagccagatcagcgcccaccaccgggacgaggcgtgcgtgcgtgaggcttgcgcgcgcgtgccccaggccacagctcgatcgtctcgacctgctcgagcccccggccgctgcttggtggtttgctcaggaacaggaaggtagccgggagaagatggcggggggcgagggcggcagggacctgccgtcgacgccgacgtgggcggtggcgctggtgtgcgccgtcatcgtgctcgtctccgtcgccatggagcacggcctccacaagctcggacactggttccaaacgaggcagaagaaggccatgcgggaggcgctcgagaagatcaaagcagagctgatgctgatgggcttcatctccctgctgctcgccgtgggtcaaacgcccatctccaagatatgcatccctgccaaggctggcagcgtcatgctgccgtgcaaacccaagggcggcgacaaaagcggcgacggcgatggccaccggaggctcctctggtaccctggagaagaccatcgccggttcttggccggcgccggggctggggacgactattgcgtcaaaaaaggcaaggtgtcactcatctccacgaacggcgtccaccagctgcatatattcatctttgtgctcgcggtgttccatgtcgtttacagtgtcgccacgatggctttagcacgtctgaaaatgaggagatggaagaaatgggaacaagagaccaactcactggagtatcagttcgcaacagatccttcacgattccgattcacaaaccaaacgtcgttcgtgaagcggcacctgggcctcccgagcacacctggagtcagatggatagtggcattcttcaggcagttctttgcttcggtgaccaaggtggattacctgaccatgcgccaaggcttcatcaacgctcatctgtcgcccaatgctaagttcgatttccaaaagtacatcaagcgatcgttggaggacgatttcaaagtcgttgttggcatcagcctcccgctgtggtttgtcgccatcttcattctcttcatcgatatccgaggactcggcacgcttatttggatctctttcgtcccactcgttatcctcttgttagttggcaccaagctagagattgtcatcatggagatggccaaggagatacaggacaaggcgactgtgatcaagggggcacctatcgtggagccaagcaacaggttcttctggttcaaccggcctgagtgggtcctgtttctcatacacctgacgctcttccagaatgcattccagatggcgcatttc

SEQ ID NO: 36440 - protein, 375 aa, Panicum virgatum
  misc_feature: Ceres CLONE 1985430
  misc_feature (5)..(375): Pfam Name: Mlo Pfam Description: Mlo family
MAGGEGGRDLPSTPTWAVALVCAVIVLVSVAMEHGLHKLGHWFQTRQKKAMREALEKIKAELMLMGFISLLLAVGQTPISKICIPAKAGSVMLPCKPKGGDKSGDGDGHRRLLWYPGEDHRRFLAGAGAGDDYCVKKGKVSLISTNGVHQLHIFIFVLAVFHVVYSVATMALARLKMRRWKKWEQETNSLEYQFATDPSRFRFTNQTSFVKRHLGLPSTPGVRWIVAFFRQFFASVTKVDYLTMRQGFINAHLSPNAKFDFQKYIKRSLEDDFKVVVGISLPLWFVAIFILFIDIRGLGTLIWISFVPLVILLLVGTKLEIVIMEMAKEIQDKATVIKGAPIVEPSNRFFWFNRPEWVLFLIHLTLFQNAFQMAH

SEQ ID NO: 36441 - DNA, 670 bp, Panicum virgatum
  misc_feature: Ceres CLONE 1985434
  misc_feature: Encodes the peptide sequence at SEQ ID NO. 36442
agcctcagctgtcagctccaccctcgcctcctccgtctacctcttcatctcctccacgccgcccgccgccgcgccgctccggcgctccgccttcctccgctccaaggcccgtgccctctcagccaccaccgcaacccccgtccggatctacgtctacgacctccccgcccgcttcaaccgcgactgggtctccgccgacgcgcgctgcgcccgccacctcttcgcggccgaggtggccgtgcacgaggcgctgctggcctacgccggccgcgccccgcgccccgaggacgccgacctcttcttcgtccccgtctacgtctcctgcaacttctccacgcccaacgggttcccctcgctctcgcacgcgcggggcctgctcgccgaggccgtccacctcctctggacccagatgccctactggaatcgctccgccggagccgaccacgtcttcgtcgcctcgcacgacttcggcgcctgcttccatcccatggaggatgtggccatcgccgacggcataccagagttcctcaagagatccatcctgctgcagacatttggtgtgcagggccatcacgtatgtcaggaggtggagcatgtggtgatcccacctcatgtgccaccagaagtggctcatgagctaccggagccggagaaggtgcggagggacatt

SEQ ID NO: 36442 - protein, 222 aa, Panicum virgatum
  misc_feature: Ceres CLONE 1985434
  misc_feature (49)..(222): Pfam Name: Exostosin Pfam Description: Exostosin family
  misc_feature: Functional homolog of the protein sequence given in SEQ ID NO 51524
  misc_feature: Useful for making plants with altered carbohydrate content
  misc_feature: Functional homolog of the protein sequence given in SEQ ID NO 51525
  misc_feature: Useful for making plants with altered cell wall content and/or composition
ASAVSSTLASSVYLFISSTPPAAAPLRRSAFLRSKARALSATTATPVRIYVYDLPARFNRDWVSADARCARHLFAAEVAVHEALLAYAGRAPRPEDADLFFVPVYVSCNFSTPNGFPSLSHARGLLAEAVHLLWTQMPYWNRSAGADHVFVASHDFGACFHPMEDVAIADGIPEFLKRSILLQTFGVQGHHVCQEVEHVVIPPHVPPEVAHELPEPEKVRRD

SEQ ID NO: 36443 - DNA, 567 bp, Panicum virgatum
  misc_feature: Ceres CLONE 1985471
  misc_feature: Encodes the peptide sequence at SEQ ID NO. 36444
tgggagtacgtccccaaccgcatcgaccaccccgactacctccggatcttctacaccacgctccgcgacggcgagccgtcccccggcgccaccatgaccagcgccgagaagctcgtcgtggcccgccagctcgcccgcctcggcgtcgacatcatccaggccggcttcccggcctcctcccccgacgacctcgacgccgtgcgctccatcgccatcgaggtcgggaacgcgcccgtcggggaggacggccacgtgcccgtcaggcacgcgcgccggccgaggatacacaccttcatcgccaccagctagatccacatgcagcacaagctcaggaagacgcccgagcaggtggtggccattgccagggagatggtggcgtacgcccgcaccctgggatgctctgatgtcgaattcatccctgaggatgctggaaggtcaaatagagagtttctgtatcatatattacgggaggtcataaaagctggagctacaactctgaatatcgccggacactgttggatactaccttccctatgaatttgggaacttaattgctgacataaaggc

SEQ ID NO: 36444 - protein, 102 aa, Panicum virgatum
  misc_feature: Ceres CLONE 1985471
  misc_feature: SWISSPROT Homolog: EC 2.3.3.13 2-isopropylmalate synthase
WEYVPNRIDHPDYLRIFYTTLRDGEPSPGATMTSAEKLVVARQLARLGVDIIQAGFPASSPDDLDAVRSIAIEVGNAPVGEDGHVPVRHARRPRIHTFIATS

SEQ ID NO: 36445 - DNA, 728 bp, Panicum virgatum
  misc_feature: Ceres CLONE 1985474
  misc_feature: Encodes the peptide sequence at SEQ ID NO. 36446
aggcagctcgtccccaatcgcagtcgcagcgcggctcttgcctcttgtaggttgtagccatagcgaaagagagagcgccatggccaaggctcacatcctcgtgctgccggtgccggcccagggccacgtcaccccgctcatggagctctcccaccgcttggtcgaccacggcttcgaggtcacgttcgtcaacaccgaaacgcatcacgcgcgggtcgtcggcgcgctgcaggcggcgggcggcacggcggcgctggccggcatccacctggcatccatctcggacgggtcggacgataacgacgacagcggcaagatcttcgactcctactcccggcacatgccggggcacctggagcggctcatcgccggaatggaggcggccggcaggcccaaggtgaagtggcttgtgtgcgacgtgttcatgtggtggctcttggacgttgccaaaaagttgggcatccgcgtggccgcattctggccgctgccggcggcttgcttagccatttgtctcaagatccccaatttgacagaggatgggctcctcaacaacaagggttaagctctcccgggatctctccatttttattcgattttagattggatcggacgatctctcaatgtgaatggcacacgtactttgcggcagggtggccagagcgtgatgagacgttccagcttgcccccgggattccacgctgcacacgtcgcagctgccgtggatgcat

SEQ ID NO: 36446 - protein, 160 aa, Panicum virgatum
  misc_feature: Ceres CLONE 1985474
  misc_feature: SWISSPROT Homolog: EC 2.4.1.195 N-hydroxythioamide S-beta-glucosyltransferase
  misc_feature: Functional homolog of the protein sequence given in SEQ ID NO 50296
  misc_feature: Useful for making plants with altered carbohydrate content
MAKAHILVLPVPAQGHVTPLMELSHRLVDHGFEVTFVNTETHHARVVGALQAAGGTAALAGIHLASISDGSDDNDDSGKIFDSYSRHMPGHLERLIAGMEAAGRPKVKWLVCDVFMWWLLDVAKKLGIRVAAFWPLPAACLAICLKIPNLTEDGLLNNKG

SEQ ID NO: 36447 - DNA, 1215 bp, Panicum virgatum
  misc_feature: Ceres CLONE 1985482
  misc_feature: Encodes the peptide sequence at SEQ ID NO. 36448
atcgacctccccacccattggattttaggaataaagattcctgttgcgatatactccccccaattcccctccttctcgtcccaacaacaatctggtcgatcactcccgccaaaaccgaaacgaaaacccagttcagttccatcccaatccgatcccacaaaagcagagaaagaacccaacaccatcccagttcagctcgatcgccgttggccaatcacccagaccggaaggaaacgatggccttcagcgtggctcagagcgccgccgccgctgcggcgtccgtcgcgcccggcacgcctcgacgcgcgccggcgccggcactggcgcccgcgtcgtccgtctccgtgaggaaagccggcggcgcgccgtcggacagcctcaggctgcagacttcggtgccgccggcgcgtccggtggcgtgccgggcggsggcggcggcggcggccgagcgcgcctcgaggaggagtgcgggggtgccggtgttcgtcatgatgccgctcgacaccgtcaccaagtgcggcaccgcgctgaaccaccggaaggccgtccaggcgagcctggcggcgctcaagagcgcgggcgtcgagggcgtcatggtggacgtgtggtggggcatcgccgagagcgacggccccgggaggtacaacttcgccgggtacatggagctcatggagatggcgcgcaagacggggctcaaggtccaggccgtcatgtccttccaccagtgcggcggcaacgtcggcgactccgtcaccatcccgctgccgcgctgggtcctggaggagatggaggaggaccgggacctctgctacaccgaccagtggggccgccgcaactgcgagtacgtctccctcggctgcgacgccatgcccgtcctcaagggccgcacccccgtcgagtgctacaccgacttcatgcgcgccttccgcgaccatttcgccgactacctcggcaacaccatcgtcgaaatccaagtcggcatgggccccgccggcgagctgcgctacccgtcctacccggagagcaacggcacctggaggttccccggcatcggcgccttccaatgcaacgacaggtacatgcttagcagcctgaaggaggcggcggcggcggccggcaagccggagtggggccacggcgggccgaccgacgccggcagctacaacaactggccggaggacaccatcttcttccgccgcgagaacggcgggtgga

SEQ ID NO: 36448 - protein, 326 aa, Panicum virgatum
  misc_feature: Ceres CLONE 1985482
  misc_feature (83)..(326): Pfam Name: Glyco_hydro_14 Pfam Description: Glycosyl hydrolase family 14
  misc_feature: SWISSPROT Homolog: EC 3.2.1.2 Beta-amylase
  misc_feature (65)..(65): Xaa is any aa, unknown, or other
MAFSVAQSAAAAAASVAPGTPRRAPAPALAPASSVSVRKAGGAPSDSLRLQTSVPPARPVACRAXAAAAAERASRRSAGVPVFVMMPLDTVTKCGTALNHRKAVQASLAALKSAGVEGVMVDVWWGIAESDGPGRYNFAGYMELMEMARKTGLKVQAVMSFHQCGGNVGDSVTIPLPRWVLEEMEEDRDLCYTDQWGRRNCEYVSLGCDAMPVLKGRTPVECYTDFMRAFRDHFADYLGNTIVEIQVGMGPAGELRYPSYPESNGTWRFPGIGAFQCNDRYMLSSLKEAAAAAGKPEWGHGGPTDAGSYNNWPEDTIFFRRENGGW

SEQ ID NO: 36449 - DNA, 159 bp, Panicum virgatum
  misc_feature: Ceres CLONE 1985482-R
gggggcgccggggcgcgcgcccccggcgcgggccaggccggcgagaacgcgcccccccggaacgacggcgcggcgcacgaccagggggaggccacggccgccgagcgcgccgccgaggaccggaggggggcccccacccaccggcgcaggggcgccgac

SEQ ID NO: 36450 - DNA, 767 bp, Panicum virgatum
  misc_feature: Ceres CLONE 1985484
  misc_feature: Encodes the peptide sequence at SEQ ID NO. 36451
  misc_feature (669)..(669): n is a, c, t, g, unknown, or other
atctccgtccccctccaggcctccactcccacctccctccctctgcgagaggggcaaagcaaagcaagccgcgaagaccccctcctttccacaccccacgcctcgtcactgtgccgcccgtgccctcccgtcccaccaccaataatccatccacccccaccccgctgcagcggcgatgtgcggcggcgccatcctctccggcttcatccggccgtccgggccggcggccaagaagcagcagcagcagctactgcagcaccagccccgccgggtcacggccgacttgctgtggccggggcccggcaggaagggagcccccgtgggggatgacttcgaggccgacttccgcgagttcgtgcgcgggctcggcgaggacgacggcgcggacgccgccggcgacgacggggtccaggaggtccccccgccggagccggcgatgtacgccttcgccgccgcggccaaggcggcgacccccgcagttgatggtgtgatgactccaaagactgttcaacatgatgaacctactgctacctcagcaaagcgcaaccggaagaatcagtacagggggatccgccagcgtccctggggcaaatgggcggctgagatccgagaccctagcaagggtgtccgtgtttggcttggaacttacaacacggctgaagaggccgncagggcatatgacgctgaagctcgaaagattcgtggcaagaaggcaaaggtcaattttcctgatgaagcaccagatgctcagaaatcaattcctaaaa

SEQ ID NO: 36451 - protein, 197 aa, Panicum virgatum
  misc_feature: Ceres CLONE 1985484
  misc_feature (127)..(178): Pfam Name: AP2 Pfam Description: AP2 domain
  misc_feature (165)..(165): Xaa is any aa, unknown, or other
MCGGAILSGFIRPSGPAAKKQQQQLLQHQPRRVTADLLWPGPGRKGAPVGDDFEADFREFVRGLGEDDGADAAGDDGVQEVPPPEPAMYAFAAAAKAATPAVDGVMTPKTVQHDEPTATSAKRNRKNQYRGIRQRPWGKWAAEIRDPSKGVRVWLGTYNTAEEAXRAYDAEARKIRGKKAKVNFPDEAPDAQKSIPK

SEQ ID NO: 36452 - DNA, 756 bp, Panicum virgatum
  misc_feature: Ceres CLONE 1985498
  misc_feature: Encodes the peptide sequence at SEQ ID NO. 36453
accagctcaactcatcactcgaccacccacttcaatccttccattccatttcagtcacctccagccggcgtcggtgtcccgatggagcttccacttccaccatgggcgcctttcctcggcgtggtgctggccaccgtgatgcttctcaaggccgtcctcggccggcgcagccgccgcgcgtacaacctcccgccggggcccaagccgtggccgatcatcggcaacctcgacctgatgggcgcgctcccgcaccgctccatccacgagctctccaggaagtacggccagctgatgcagctccggttcgggtccttccccgtggtcgtcggctcgtcggtggacatggccaagttcttcctcaagacccacgacgtggtgttcacggaccggcccaagaccgccgccggcaagtacaccacctacaactaccgggacatcacctggtccccctacggcgcctactggcggcaggcgcgcaagatgtgcctcaccgagctcttcagcgccaagcgtctcgagtcgtacgagtacatccgcgccgccgaggtgcgcgcgctgctgcgcgacctgcacgccgcgtctggctccggccgcgccgtcatgctcaaggactacctgtccacggtgagcctgaacgtgatcacgcgcatggtgctcggcaagaagtacctggacaaggaggtggcggtggccggcggatcctccgtgaccacgccggaagagtttcagtggatgctcgacgagctgttcctgctc

SEQ ID NO: 36453 - protein, 224 aa, Panicum virgatum
  misc_feature: Ceres CLONE 1985498
  misc_feature: SWISSPROT Homolog: EC 1.14.13.21 Flavonoid 3'-monooxygenase
  misc_feature: Functional homolog of the protein sequence given in SEQ ID NO 50304
  misc_feature: Useful for making plants with altered carbohydrate content
MELPLPPWAPFLGVVLATVMLLKAVLGRRSRRAYNLPPGPKPWPIIGNLDLMGALPHRSIHELSRKYGQLMQLRFGSFPVVVGSSVDMAKFFLKTHDVVFTDRPKTAAGKYTTYNYRDITWSPYGAYWRQARKMCLTELFSAKRLESYEYIRAAEVRALLRDLHAASGSGRAVMLKDYLSTVSLNVITRMVLGKKYLDKEVAVAGGSSVTTPEEFQWMLDELFL

SEQ ID NO: 36454 - DNA, 1275 bp, Panicum virgatum
  misc_feature: Ceres CLONE 1985502
  misc_feature: Encodes the peptide sequence at SEQ ID NO. 36455
accaacgccgttaaaatttccgtctcctcttgtatctcatccacacgcgcctcatccagagctggcgcacgccatgtgctcgacgatttgccgctgacacgagtccatggcgcttgctctcctcctgccctcccccgcatcccaccgccgctcgcttcgttctgtctcctctccgcctctcgcgcgtgtcaccaccgccgccagcttcggcctcgcgtttttctcccatccctcctccggctgctgctctctgcagaggactggcgccgcgggcggcgacggcgatggcgccggcgagacctcatcggaagagccgatggctggatggctcgacacggacctgctcaggcaggtctcaggcgcggggaatgcggaccaggcgctggacattgtcgcagagtcggcgggaggttcgggcgccgctctggaagcgcccgaatgcaacgcgatcatcgccgcggcacttgaccgaggcaacgtcgagctcgcgctctcggtgttcgaagccatgcgatccggctttgcgggagtaggaggctgggggtgggcgagaccggacattcggacatatgccttgctcgtacaggggttggcagcctccctgcgtgtttctgatgcaatcaggataatcgattatgtgtcttgcgctggtgtttcttctacagaggagattcctttcgggattattgttcgctgtccaacctgcatggtagcagttgctgttgctcaaccgcaggatggaactcaggttgtttcctgttcgaagtgtcgatatcaatatgaattattttctggagacattacgagcattgaatctgaagaagttaggatctcctcctgccgaacgcagcatggatatttcagctctggagaaggcattgagattcattaatataagaaaagatggtcttctagctgctgttcactctattgtggtagatttcctttcaaaatatccgcgcaccttcaggaatagcacgcactcatagatttgctacccagaatgtagaactccctgctcgagaaggagaaagagtaaccatttcgttggcagccccatccaatatttatcttgaagagcgtcccctcaagattgccgcacactcacaaggaattaaaccagaaaaacctatgtgtctgacttatgacagaattgaactaatctcaaatttgctaaaagctccatcaaagaatgaaggatcaattttccttaactcatatgtattggtcggtgctcttgctttgcttgcttctggaaatgctgattccatatta

SEQ ID NO: 36455 - protein, 191 aa, Panicum virgatum
  misc_feature: Ceres CLONE 1985502
  misc_feature: Functional homolog of the protein sequence given in SEQ ID NO 51009
  misc_feature: Useful for making plants with altered lignin content
MAGWLDTDLLRQVSGAGNADQALDIVAESAGGSGAALEAPECNAIIAAALDRGNVELALSVFEAMRSGFAGVGGWGWARPDIRTYALLVQGLAASLRVSDAIRIIDYVSCAGVSSTEEIPFGIIVRCPTCMVAVAVAQPQDGTQVVSCSKCRYQYELFSGDITSIESEEVRISSCRTQHGYFSSGEGIEIH

SEQ ID NO: 36456 - DNA, 734 bp, Panicum virgatum
  misc_feature: Ceres CLONE 1985502-R
  misc_feature: Encodes the peptide sequence at SEQ ID NO. 36457
caagtggtcctgccagaaattcaaaagcttccacaaaaggcggtggatatagttgctgtacggcagcagcttttgtctcagtatgacattcttcagagccgtcttaaggaactgaaacagtttgcacaaaaagaggtgtggatgctcgcaaggatgtgtcaattggacaacaaaatactagcagtgggcgaaccatcttatcgtgctagacgaggtagagtaaagagggtacgggaaagcttggaaagcacactctctgcaaggattgagctaatggaaagttatgcaaaattgtgttcaatgattgaaattgaaattgagatggactctgatgttattgctgctgaagcggcaagcagtgcagagaggatatctgagcaaatacaacaattaatggagatcgatagtcttgaagagcaatggcgtatacaagctgaagctaatgatgaagctgaaaggcttctgagttctgattcttcagaaacattgcctgctggacatatgtaatgcaattttggtaatgcgcaagcattattctcctatttcctatttagatatttatatctctgcaattttaatgttctttaccaaattacaaacaaatttctagtttaggattttgaaggaaaatattgctacagaacattagaaaaaacgaaccgtatgataacagtgagatgacatcatgaatcctgcaacagaataatacagaatattgattggaaccgtgtagc

SEQ ID NO: 36457 - protein, 168 aa, Panicum virgatum
  misc_feature: Ceres CLONE 1985502-R
  misc_feature: Functional homolog of the protein sequence given in SEQ ID NO 51009
  misc_feature: Useful for making plants with altered lignin content
QVVLPEIQKLPQKAVDIVAVRQQLLSQYDILQSRLKELKQFAQKEVWMLARMCQLDNKILAVGEPSYRARRGRVKRVRESLESTLSARIELMESYAKLCSMIEIEIEMDSDVIAAEAASSAERISEQIQQLMEIDSLEEQWRIQAEANDEAERLLSSDSSETLPAGHM

SEQ ID NO: 36458 - DNA, 1394 bp, Panicum virgatum
  misc_feature: Ceres CLONE 1985503
  misc_feature: Encodes the peptide sequence at SEQ ID NO. 36459
actctataaatagtttgctccttcccctctcttctcccacacagcctcctctcccgcctctctcagcctcatcacttgcctcctgagctcttcccaagttctgatacctcactccgacgaggaggacgaaagcccactatagcccagagagggagttctctttctctagcccagtggccatggcagtgcacgacggagtgaacaacaagcacgaggcggccgtggcgccgatggaggtgtcggtggaggccggcaacttccaggaggccgaccggctagacgacgacggccgcccctgccgcaagggcacgttctggacggccagcgcgcacatcatcaccgccgtcatcggctccggcgtgctctcgctcgcctgggccatcgcgcagctcggctgggtcgccggccccgccgccatgctgctcttcgccttcgtcacgtactacaccgccacgctgctcgccgactgctaccgcaccggcgacccggagacgggcaagcgcaactacacctacatggacgccgtgcgctccaacctcggcggcgccaaggtggtgttctgcggcgtcatccagtacgccaacctcgtcggcgtcgccatcggatacaccatcgcgtcgtccatcagcatgaaggccatcaggagagccggctgctttcacaccaatggccacgccgacccctgcaaaagctccagcaccccgtacatgatcctcttcggcgttgtggagatcctcttctcgcagataccagactttgatcagatttggtggctctccatcgtcgccgccgtcatgtccttcacctactcttccatcgggctcgccctcggcatcgcccagaccatttccaatggtggattcaagggaagcctcaccggcatcagcatcggcgccgacgtcacctccacgcagaagatctggcacaccctgcaggccttcggtgacatcgccttcgcctactccttctccaacatcctcatcgaaatccaagacacgatcaaggcgccgccgccgtctgaggcgaaggtgatgaagaaagcaacgagccttagcgtggcaacaaccaccgttttctacatgctgtgcgggtgcatgggctacgccgcgttcggcgacaacgcgccggacaacctcctcaccgggttcggcttctacgagcccttctggctcctcgacgtcgccaacgtcgccatcgtcgtgcacctcgtcggtgcctaccaggtcttctgccagcccatcttcgccttcgtcgagcgccgcgccgccgcggcctggccggacagcgccttcatctcccgggagctccgcgccggccccttcgcgctcagcgtgttccgcctcacgtggagaacggcgttcgtgtgcgtcaccaccgtcgtgggcatgctcctc

SEQ ID NO: 36459 - protein, 404 aa, Panicum virgatum
  misc_feature: Ceres CLONE 1985503
  misc_feature (41)..(404): Pfam Name: Aa_trans Pfam Description: Transmembrane amino acid transporter protein
MAVHDGVNNKHEAAVAPMEVSVEAGNFQEADRLDDDGRPCRKGTFWTASAHIITAVIGSGVLSLAWAIAQLGWVAGPAAMLLFAFVTYYTATLLADCYRTGDPETGKRNYTYMDAVRSNLGGAKVVFCGVIQYANLVGVAIGYTIASSISMKAIRRAGCFHTNGHADPCKSSSTPYMILFGVVEILFSQIPDFDQIWWLSIVAAVMSFTYSSIGLALGIAQTISNGGFKGSLTGISIGADVTSTQKIWHTLQAFGDIAFAYSFSNILIEIQDTIKAPPPSEAKVMKKATSLSVATTTVFYMLCGCMGYAAFGDNAPDNLLTGFGFYEPFWLLDVANVAIVVHLVGAYQVFCQPIFAFVERRAAAAWPDSAFISRELRAGPFALSVFRLTWRTAFVCVTTVVGML

SEQ ID NO: 36460 - DNA, 1447 bp, Panicum virgatum
  misc_feature: Ceres CLONE 1985537
  misc_feature: Encodes the peptide sequence at SEQ ID NO. 36461
gatacttctagtagtcagagtcactagctagcgaggggtgggtggtttgctcctgctcggcgctctcttcgcttgccacctgccatctacaccgccggccacgatgatgggaggaggggcgctggtgctggatcagcgcatgccggcggacgacaaggcccccctctttggcttcgggccaggcgagtgcttcctcggcgagggcgacctcgtcaacccggcgccggcgcacgacgacatgatgagcggcttccccgacggcgacgagagcgacgacgacgtgggcggcatcgaggagctggagcgccgcatgtggcgcgaccgcctgcgcctcaggcgcctcaaggagcagcagggcggcaaggaggcggcgccgcggcaggagcaggcgcgccgcaagaagatgtcctgcgcgcaggacggcatcctcaagtacatgctcaagatgatggaggtctgcaacgcgcagggcttcgtctacggcatcatcccggagaacggcaagcccgtcaccggcgcctccgacaacctccgagcctggtggaaggacaaggtccgcttcgaccgcaacggccccgcggccgccgccaggtaccaggccgacaacgccgcgccgggcgggggcgccgccgcggcggccgcgccgccagggccgcactccctgcacgagctgcaggacaccacgctgggctcgctgctctcggcgctcatgcagcactgcgacccgccgcagcgccgcttcccgctcgacaagggcgtgccgccgccgtggtggcccgaggccggcgtgcccggggacctgggcccgccgccgtacaagaagccgcacgacctcaagaaggcctggaaggtggccgtgctcactgccgtgatcaagcacatgtcccccgacgtcgacaaggtccgacgcctcgtgcgccagtccaagtgcttgcaggacaagatgaccgccagggagatcgtcacctggctcgccgtgctcaagcaggaggaggacctgtacctcatgcagcacccgggcgccctccccccgccgtcctccaacgccgccgtgctcccgttcagcaccagttccggcgagtacgacgtggacggcgccgacgacggcgaagagaccggccggaacccgaagccggcctccaacgccgcacccgcgttcgtggacctttcgtcgtccatggatgctacggcggtgctgataaaggaggagaccgccaagctcgagttcttccagaagaggagcgcggcggccggcgtggagccggagccggagctgatgctgagcaacagcttccgcgcgtacacctgcagcaacgcgccgtgcccgcacagcagcgtgcacgggttcctcgaccgcggcgagcgcaacgcgcaccagtacacctgccagttcaacacccccgctgatagcaacaagctggcaccgtccgtcttccccccggcaggt

SEQ ID NO: 36461 - protein, 447 aa, Panicum virgatum
  misc_feature: Ceres CLONE 1985537
  misc_feature (45)..(426): Pfam Name: EIN3 Pfam Description: Ethylene insensitive 3
  misc_feature: The sequence is a functional homolog of SEQ ID NO 1358 in the 11/479,226 US patent application
  misc_feature: Functional homolog of the protein sequence given in SEQ ID NO 51126
  misc_feature: Useful for making plants with modulated biomass
  misc_feature: The sequence is a functional homolog of SEQ ID NO 1350 in the 11/479,226 US patent application
  misc_feature: The sequence is a functional homolog of SEQ ID NO 2464 in the 10/374,780 US patent application
  misc_feature: The sequence is a functional homolog of SEQ ID NO 632 in the 10/412,699 US patent application
  misc_feature: The sequence is a functional homolog of SEQ ID NO 818 in the 10/225,066 US patent application
MMGGGALVLDQRMPADDKAPLFGFGPGECFLGEGDLVNPAPAHDDMMSGFPDGDESDDDVGGIEELERRMWRDRLRLRRLKEQQGGKEAAPRQEQARRKKMSCAQDGILKYMLKMMEVCNAQGFVYGIIPENGKPVTGASDNLRAWWKDKVRFDRNGPAAAARYQADNAAPGGGAAAAAAPPGPHSLHELQDTTLGSLLSALMQHCDPPQRRFPLDKGVPPPWWPEAGVPGDLGPPPYKKPHDLKKAWKVAVLTAVIKHMSPDVDKVRRLVRQSKCLQDKMTAREIVTWLAVLKQEEDLYLMQHPGALPPPSSNAAVLPFSTSSGEYDVDGADDGEETGRNPKPASNAAPAFVDLSSSMDATAVLIKEETAKLEFFQKRSAAAGVEPEPELMLSNSFRAYTCSNAPCPHSSVHGFLDRGERNAHQYTCQFNTPADSNKLAPSVFPPA

SEQ ID NO: 36462 - DNA, 1449 bp, Panicum virgatum
  misc_feature: Ceres CLONE 1985538
  misc_feature: Encodes the peptide sequence at SEQ ID NO. 36463
agagctcggcccagctcggctcgcccctcccccctcccctccctgatgcgcgtgcccccatgcgcggctccgacacagttaggccccctctggggctgcgtccgcggcggcggcgatgaagcggccgctgcggcgctccttcgcagtgctcctcttcgtcgtgctcgtcggcgcggcctcgttctccgccgcgctccgccgcgccgtggcccccgcgcccgcgcgggagccgcccctcccggcgctcgaccaggcgcgcctcaacgccacgctgctccgcctcgccgccgtcgatccctcggaggccccgctgcggcgggacgtggacgacctcctcgagggccgcctcccggtctccgcggcgcgcgaccgcgcccgcgcgtggcgccgcgaccggctcctccacccgctccacctccaccaccaccgcttcccgctgccccgccgcggccgctacccggacgaggaccacgacaccctgctccacccgctcccgcgccacgaccagcagctccacatcgaccccgccctccgccgcgcgctccgctcctggcaccgcctccgccgctacgatcccgccgtcctcggcagccttccctccctcctctccctgcccggccgcatcccatcctgcgcggttgtcggcaacagcggcatcctcctccgggcggaccatggcgctctcatcgactcccacgacgccgtgttccgcctcaacaacgcccgcatcgcagggtacgccgcgcacgtcggcagcaagaccaacttctccttcatcaacagcaacgtccttcacctctgcgcgcgccggcccggctgcttctgccacccctacggccatggcgtccccatcctgctctacatctgccaggccacccatttcctcgacatcgcagcctgcaacaccacctcatcctctcgccacggctcccctatctccgtcaccgacgcccgcctcgacgtcctctgctcccgcatcgtcaagtactactccctccgccgattcgtcgcggagactggccgcgcggctgaggactgggaccgcgcacacgacgccgctatgttccactactcgtccgggatgcaggccatcatggtcgcggtgggagtttgtgacagagtcagcgtgttcggcttcgggaaatcctccgatgcaaagcaccattaccatagcaaccagaaggcggagctggatctccatgactacgaggcggagtacgccttctatcacgacctcgccgagcacccgcaggtagtccccttcctcaaggatgctggattcgctgtcccgcccgttgtcttctaccattaggccagcttcgtaaagcgcggcatgtgctcgacgttatgtggcacgggtgttttttttttttcttttcgggggttttgattagtaagtgcgatgtaaaacttgttggtgtcggtgggttgatctattttgattagatg

SEQ ID NO: 36463 - protein, 398 aa, Panicum virgatum
  misc_feature: Ceres CLONE 1985538
  misc_feature (102)..(386): Pfam Name: Glyco_transf_29 Pfam Description: Glycosyltransferase family 29 (sialyltransferase)
  misc_feature: SWISSPROT Homolog: EC 2.4.99.4 Beta-galactoside alpha-2,3-sialyltransferase
MKRPLRRSFAVLLFVVLVGAASFSAALRRAVAPAPAREPPLPALDQARLNATLLRLAAVDPSEAPLRRDVDDLLEGRLPVSAARDRARAWRRDRLLHPLHLHHHRFPLPRRGRYPDEDHDTLLHPLPRHDQQLHIDPALRRALRSWHRLRRYDPAVLGSLPSLLSLPGRIPSCAVVGNSGILLRADHGALIDSHDAVFRLNNARIAGYAAHVGSKTNFSFINSNVLHLCARRPGCFCHPYGHGVPILLYICQATHFLDIAACNTTSSSRHGSPISVTDARLDVLCSRIVKYYSLRRFVAETGRAAEDWDRAHDAAMFHYSSGMQAIMVAVGVCDRVSVFGFGKSSDAKHHYHSNQKAELDLHDYEAEYAFYHDLAEHPQVVPFLKDAGFAVPPVVFYH

SEQ ID NO: 36464 - DNA, 759 bp, Panicum virgatum
  misc_feature: Ceres CLONE 1985561
  misc_feature: Encodes the peptide sequence at SEQ ID NO. 36465
gtggattagtcgctgtcacgttcggctaatgtactccactccccgcggtcgccgcgccgagctgttcttgctctgtcctcctaacgtcctccctaccatccccaagatttgatctttagacccagttcctgcgcccagttcttcctaaggcggaggggtggttgcttctccgggctctgaggttggaatcttgtcccgctcacaaggtttagtcttgattggtctcatctgctcagctgtctggttgcaagcttagaactggaaggaataatttgactagagaaatgggacagtgttgcagcagagctacggccccagattctggacggggaggtgccaatgggtatggctattctaaccaggcaaagccagcacaaacacttcccagttacaatgctcctcagccacaggccgaggtacggtacacgccgccggcgatgaaccctccggtagtcccacctgtaattgtcccaccgaagcccactgcagacacaattcttggcaagccgtatgaggatgtgcgcacagtctactccctcgggaaggagcttggccgcggccagttcggggtgacgtacctctgcacagagattgctactggtaggcagtacgcgtgcaaatccatctctaaacgcaagctcaccagcaaggcagacagggaggacattcgcagggagatccagatcatgcagcacttgtctgggcagccaaacattgttgagttccgaggaacgtacgaggataagagcaatgtgcatg

SEQ ID NO: 36465 - protein, 158 aa, Panicum virgatum
  misc_feature: Ceres CLONE 1985561
  misc_feature: SWISSPROT Homolog: EC 2.7.11.1 Non-specific serine/threonine protein kinase
MGQCCSRATAPDSGRGGANGYGYSNQAKPAQTLPSYNAPQPQAEVRYTPPAMNPPVVPPVIVPPKPTADTILGKPYEDVRTVYSLGKELGRGQFGVTYLCTEIATGRQYACKSISKRKLTSKADREDIRREIQIMQHLSGQPNIVEFRGTYEDKSNVH

SEQ ID NO: 36466 - DNA, 699 bp, Panicum virgatum
  misc_feature: Ceres CLONE 1985578
  misc_feature: Encodes the peptide sequence at SEQ ID NO. 36467
caagcgaaagaaatacatcaggaccagcttcaagttctaagaacaccattgatactgaaggtgctgaaagtactgatcttcagagtcataaagatactgctggtcctgaactggagagacaagactcatctaaatccatacataataatcagcatcttagacacgagaataagcaaccaaaaatcattaagaaggtactaacaactctaagagaggagagcaagttcagggaaagcagttcaccagtgagagctagccgtgtaaagctaaattcacccagcaacagggagcgctcatctgatgaatcaaagcacagtgatatttcctccagttcaaggtctagtgaagtgatgtcacatgaatcggcaagggtaagctttgaagaacctgtgaaacggggacaagcatctcctcccttgaaacatttgtcaccaattgttgagcattcacagacagttaaaaataaattagatgagcggccaaatccagatcctgccaagcagtttgggcaagatgttgatgctgctgctgcagggaagtctaagaacaaaacaccaccgagttttattagatgcacaagtattcctgctcggaggcaaggagtagcgagtccaagtcgtcaacacactgggataaaacgagctcacaataaggtcgttatggctgagcatgcaaaaagtcatttccgacctccccata

SEQ ID NO: 36467 - protein, 232 aa, Panicum virgatum
  misc_feature: Ceres CLONE 1985578
  misc_feature: SWISSPROT Homolog: EC 2.7.11.1 Non-specific serine/threonine protein kinase
SERNTSGPASSSKNTIDTEGAESTDLQSHKDTAGPELERQDSSKSIHNNQHLRHENKQPKIIKKVLTTLREESKFRESSSPVRASRVKLNSPSNRERSSDESKHSDISSSSRSSEVMSHESARVSFEEPVKRGQASPPLKHLSPIVEHSQTVKNKLDERPNPDPAKQFGQDVDAAAAGKSKNKTPPSFIRCTSIPARRQGVASPSRQHTGIKRAHNKVVMAEHAKSHFRPPH

SEQ ID NO: 36468 - DNA, 742 bp, Panicum virgatum
  misc_feature: Ceres CLONE 1985582
  misc_feature: Encodes the peptide sequence at SEQ ID NO. 36469
accgctccctcctcctcctcctccctgtttgttttatactactagctagtatctgtttgagcagccaagtgctggagctaacaatggcgcccgctcaatgtgtggcttcgcagagggtgttccccttcggcaagggcaagagcgagggcaacaggggcatgaaggatctgctgggcgggaagggcgcgaacctggcggagatgtcgagcatcgggctgtcggtgccgccggggttcacggtgtcgacggaggcgtgccagcagtaccaggaggccgggcgcgcgctgccggcggggctctgggcggagatcctcgacggcctggcgtgggtggaggagtacatgggcgcgcgcctcggcgacccacagcgcccgctcctgctctccgtccgctccggcgccgcggtgtcgatgcccggcatgatggacacggtgctcaacctggggctcaacgacgaggtggccgccggcctggccgccaagagcggcgagcgcttcgcctacgactcgtaccgccgcttcctcgacatgttcggcaacgtcgtcatggacattccccatgcactgttcgaggagaagcttgagcacatgaaggaagccaagggggtggagcttgacaatgacctgactgccgctgacctcaaagagctggtggctcagtacaaggatgtctacgtccaggccaagggggagccattcccctcagaccccaagaagcagcttgagttggcagtgttggctgt

SEQ ID NO: 36469 - protein, 219 aa, Panicum virgatum
  misc_feature: Ceres CLONE 1985582
  misc_feature (11)..(216): Pfam Name: PPDK_N Pfam Description: Pyruvate phosphate dikinase, PEP/pyruvate binding domain
  misc_feature: SWISSPROT Homolog: EC 2.7.9.1 Pyruvate, phosphate dikinase
MAPAQCVASQRVFPFGKGKSEGNRGMKDLLGGKGANLAEMSSIGLSVPPGFTVSTEACQQYQEAGRALPAGLWAEILDGLAWVEEYMGARLGDPQRPLLLSVRSGAAVSMPGMMDTVLNLGLNDEVAAGLAAKSGERFAYDSYRRFLDMFGNVVMDIPHALFEEKLEHMKEAKGVELDNDLTAADLKELVAQYKDVYVQAKGEPFPSDPKKQLELAVLA

SEQ ID NO: 36470 - DNA, 1354 bp, Panicum virgatum
  misc_feature: Ceres CLONE 1985620
  misc_feature: Encodes the peptide sequence at SEQ ID NO. 36471
gccgacatcgccagcgagcggctgcccccctcctcattatccccgatggggcagataatcaagccccattcttgcagcatccgtggtgttgatttccttccccttctactctgtccatttggcctgacagtaacctccagcggggcaccattattaggatgataatgatcctccttcccactagtggcatgtcattgatgccatcttgactgttactgtaccctccaacctcttgcccccgtttgctcttccagatctcatccacttctcatcctgtttcttgctgctcctctccgcgtgtgatttgagtctgacatcgttctgtagggcttcttgctttgtttcttggctgctcctgcccgcgttcttgggtgcggtggaagagcggagatgggtttttttcagcactgtgctgggtttctttgggtttggagtcggactgaccttggggcttgggattgggtactacatcttcatctacttccagcccagcgatgtgaagcaccctgtgatcaggccacttgttgagcttgatacaaaatcactggaaaacatgcttcctgagattcctctttggataaaaaatccagacttcgatcggattgattggctaaacaagttcattgagactatgtggccctatcttgacaaggcaatctgtaaaatggcaaaggaaatcgccaaaccaattattgctgagagcactgcaaagtataagattgattcagttgaatttgagacattaacattaggctcattgccgccaacatttcaagggatgaaggtctacaccactgatgaacaagaacttataatggaaccttcagtaaagtgggctgggaatcctaatatcactgttctagtcaaagcatatgggctaaaagcaacggcacaggtaattgatttgcaagtatttgctctaccacgcataaccttgaagccactggttcctagctttccatgttttgctaaaatactcgtttcacttatggagaagccccatgttgattttggtctgaaactcttaggagcagatctcatggctatccctggcctttatggatttgtccaggaaactatcaagacccaggtagcaaatatgtacttgtggcccaaagtactcgaggtgcaaatcatggatcctgcaaaagcacaaaagaagcctgttggaattctctatgttaatgtagtacgggctgttaaactcaccaagaaagatctgttgggcaaatcagatccatatgtgaagttaaagctaacagaggacaaacttccgtcgaaaaaaacatcagtgaagcgaagcaacctgaaccctgaatggaatgaggaattcaaattagttgttaaagaccca

SEQ ID NO: 36471 - protein, 266 aa, Panicum virgatum
  misc_feature: Ceres CLONE 1985620
  misc_feature (208)..(266): Pfam Name: C2 Pfam Description: C2 domain
  misc_feature: SWISSPROT Homolog: EC 2.7.11.13 Protein kinase C
MLPEIPLWIKNPDFDRIDWLNKFIETMWPYLDKAICKMAKEIAKPIIAESTAKYKIDSVEFETLTLGSLPPTFQGMKVYTTDEQELIMEPSVKWAGNPNITVLVKAYGLKATAQVIDLQVFALPRITLKPLVPSFPCFAKILVSLMEKPHVDFGLKLLGADLMAIPGLYGFVQETIKTQVANMYLWPKVLEVQIMDPAKAQKKPVGILYVNVVRAVKLTKKDLLGKSDPYVKLKLTEDKLPSKKTSVKRSNLNPEWNEEFKLVVKD

SEQ ID NO: 36472 - DNA, 727 bp, Panicum virgatum
  misc_feature: Ceres CLONE 1985620-R
  misc_feature: Encodes the peptide sequence at SEQ ID NO. 36473
ggggacagctcaccgttgatgtaacatataagccgttcaaggaaggtgattctgatattgagacgactgatgagtctggtgtcattgaaaaggctcctgatggcacaccagaaggtggtggcttgctggtagttattgtccatgaagcacaggatgttgaaggaaagcaccacaccaatccatatgcacgaattttgttcaaaggtgaagaaaggaagacaaagcatattaagaagaatagagatccacgatgggaacaagaatttgggtttgtttgtgaggaaccacctataaatgaaaaaatgcaagttgaagtcattagcaggccatcaagtcttggcatacattcgaaggaaagtcttggctatattgtcattagccttgccgatgttataaacaacaagaggatcaatgagaaataccatctcattgactcgaaaaatggccgcattcagttggaattgcagtggagaacatcctaaaagacctcacgcgctggagccgtgaacctgtaaagtttgtttctatttgaaacttaccacacatgtaagcataagcatttgtggacatctattttagttatttaatatttctttttattataatttccaaattgttttggacatcatgtttctccagttttggtagatatggttaagaacggaaagagtttgtcgagatgaataacagaattgatattatgtaaagtggttcttcggtgagtgtc

SEQ ID NO: 36473 - protein, 159 aa, Panicum virgatum
  misc_feature: Ceres CLONE 1985620-R
  misc_feature (42)..(124): Pfam Name: C2 Pfam Description: C2 domain
GQLTVDVTYKPFKEGDSDIETTDESGVIEKAPDGTPEGGGLLVVIVHEAQDVEGKHHTNPYARILFKGEERKTKHIKKNRDPRWEQEFGFVCEEPPINEKMQVEVISRPSSLGIHSKESLGYIVISLADVINNKRINEKYHLIDSKNGRIQLELQWRTS

SEQ ID NO: 36474 - DNA, 1570 bp, Panicum virgatum
  misc_feature: Ceres CLONE 1985643
  misc_feature: Encodes the peptide sequence at SEQ ID NO. 36475
gtcatcatcttgaaacctttgacctcctcttttacattacgatggcggatctgaacaaggctgttgctgatctcttggctcgcttggacgccgtgaacgggcgcctgcagaaggtcgaaacacagattgcatcgggagctggcgcttccagctctgcttcttcctccagctcttcgtcgtcggctggtggtgatgctgcctctattgctgcttttgacgatcttgtcaacgagcacctcaagccttgggagcagctgagtggtgtcatcggcaccgatcgcctgaagaaccaggttgctgacttcctgaccgctgttgccggcctgcgcagcatcatcggcgttgctgctcaatcgaagaagcccgctgacgtttccagcctgcctgtcgttgccagcttcctggccgcctcacagaaggttgtggctgccaagtctggtccccgcaagggtgatgccgacttcaaccacatctctgctgtctctgaggctgtggctggtctctcctggttcttctgggccaagggcgacccacagatggaccgtgttccctccgccgccgtcaatgatggtctcgatggcgctgtgttctacctgaaccccattctcgttgctcacaagcctggtgctgctgctgagaaccccgaccagatcaagtgggtcaaccagctcaaggccttcttcaaggagctgcaggcctacgttgtcaagaaccacaccacctctctcacctggaaccccaacggtggtgatgctgctgctgcccccgctgctgctgcccctgtccagtcgagtggtggtgctcctgctcctcctcctcctggtcctcctcctcctcctgctcccgctgatgataaggctgccgcctctgccgctgctcgcactggtctgtttgccgccctgaacaagggtgatttggactctgcttcctccgcattcggtctcaagagggtcaccaaggacatgcagacccacaagaaccccgagcttcgtgctggtggtgttgtcaagactgtcgagcctaaggcccctgctcgtgctgccacctcctcggcacccgcccgtgtccgccctcctttgaccgagctgcagggcaacaagtggctcgtcgagtggcacaagggtaacaagggaatcgtcatcaaggatgccgagcccaagcacactctctactgctacaagctcgaggactgcgtcgtccaggtcaccgaccccaagatcaacgcaatcaccctcgacaactgcaagaagaccgccgtcgtcttccacactgtcatctctggtgttgaggttgtcaactgccagtcgcttgaggtccaggctcagggcgtcgtccctaacttcgccattgacaagtgctcttcgatcactgtctacctctccaaggattcccttacctcgcagttcgtcgtttccaagagcgatgccctcaacgtcatcatccccgatggtgattccggtgaggtcaaggaactctacgttcccgaacagtttgtttccactatcgtcaatggcgctcttgtcaccaagactctcgaacacgagtaaattcgccctcttttttttttttt

SEQ ID NO: 36475 - protein, 501 aa, Panicum virgatum
  misc_feature: Ceres CLONE 1985643
  misc_feature (342)..(501): Pfam Name: CAP_C Pfam Description: DE   Adenylate cyclase associated (CAP) C terminal
  misc_feature (8)..(339): Pfam Name: CAP_N Pfam Description: Adenylate cyclase associated (CAP) N terminal
MADLNKAVADLLARLDAVNGRLQKVETQIASGAGASSSASSSSSSSSAGGDAASIAAFDDLVNEHLKPWEQLSGVIGTDRLKNQVADFLTAVAGLRSIIGVAAQSKKPADVSSLPVVASFLAASQKVVAAKSGPRKGDADFNHISAVSEAVAGLSWFFWAKGDPQMDRVPSAAVNDGLDGAVFYLNPILVAHKPGAAAENPDQIKWVNQLKAFFKELQAYVVKNHTTSLTWNPNGGDAAAAPAAAAPVQSSGGAPAPPPPGPPPPPAPADDKAAASAAARTGLFAALNKGDLDSASSAFGLKRVTKDMQTHKNPELRAGGVVKTVEPKAPARAATSSAPARVRPPLTELQGNKWLVEWHKGNKGIVIKDAEPKHTLYCYKLEDCVVQVTDPKINAITLDNCKKTAVVFHTVISGVEVVNCQSLEVQAQGVVPNFAIDKCSSITVYLSKDSLTSQFVVSKSDALNVIIPDGDSGEVKELYVPEQFVSTIVNGALVTKTLEHE

SEQ ID NO: 36476 - DNA, 1756 bp, Panicum virgatum
  misc_feature: Ceres CLONE 1985675
  misc_feature: Encodes the peptide sequence at SEQ ID NO. 36477
agagaccaccactccagcctcgtgcagtctgccgagagcaaggcggcgggggttttcctagtagctgcagtcgattgcttggcatctttatcagctcgcgatctccctgctccctcctatagttatctccagatattgcagcgaaggtggaagcagcacttgagagagagagagagagagagagagagagagagagagagagagagagagagagttcttggacgaatccatccagggagtggggagcggtcgagggagaagagaagaggaacagaggggatggagacggacagcccgcggagccccgaggcggagatcgggcaccgggtggaggacctctgggaggtggcggagccgcagctctcgccgtccgagaagctcaactcctgcttcgaggacatccccgtcgcgtccttcccccgcacgcacccctcgcaagtaattgagataccctctgatgccagtcttgctgaaactgttgaaatattgtccaaaaacaaaatcctgagtgcacccataagaaacgttgaggctccagaagatgctagttggatggacaaatacatcggtattgtggaatttgctggtattgccatgtggctgctcagtcagtctgatgctgcagctaatgggacggctggttctggaataggatcacctgtctccaatctagtttctaggttgggttccttcacattcagaaggacatcatccggcagggtagaaactgctactgattctgaatcagatgaagctgcatcggttggaggaagttttttcgaaaccctaacttcctctgagttctacaagaatacaaaggttggcgatatctcagggagcttccggtgggcaccatttcttgcactgcagacgtctgacacattccttaccatgttgctgcttctgtctaagtacagaatgaagagcctgccagtagtagaagttggaggagataagattgagaacatcatcacacaatcttctgttatgcacatgcttgcagagtgtgttgggctcccatggtttgagagctggggaactaagaaactttctgagcttgggcttcctatcatgaaaccatccaaacttgtcaaggtaaatgaagatcagccggttctaaaagccttccaactgatgagggaaaaaggagttggtggtctaccagtcatggacacgagtggagcaaaagcaattggtaacatcagtatcagagatgttcaatatcttctaactgcccccaagatatacaaagagcacaggacaatcacaacaaaggattttctcactgcggtgcgacagcatctccaggagcaacatgagacctcaccctttctgcacgatgtgatcacttgcaaaaaggacgacacgatcaaggacattatactgaagctggactctgagaagattcacaggatctacgttgtagatgacaaagggaacactgagggggtcatcacattgagggacataatctccaagctggtgcacgagcctcgccactactttggggatttcttcgatggtgttgttcccctgcctgcaaatagcactgtatgagacaaaatcgtggtccaatcgcactgatgtacctgtgcaaatgtatattatgaaccgttctcttcggaggttccttgctgtgtatttcttttcccaacctcctcatgtgaacagagtatgaacaagaaagtaaaaaagaccaattcgctaatgaatggaaatggtggaccctggataacttgggagctgcctgagtctt

SEQ ID NO: 36477 - protein, 425 aa, Panicum virgatum; identical to SEQ ID NO: 21009
  misc_feature: Ceres CLONE 1985675
  misc_feature (264)..(402): Pfam Name: CBS Pfam Description: CBS domain pair
  misc_feature (48)..(241): Pfam Name: CBS Pfam Description: CBS domain pair

SEQ ID NO: 36478 - DNA, 1748 bp, Panicum virgatum
  misc_feature: Ceres CLONE 1985677
  misc_feature: Encodes the peptide sequence at SEQ ID NO. 36479
gactctccctcttcacttcctcgtcggcatacctgattcgagcaatcacctgccactttcaaactttcatcaagcgcaagtcgccagtttcgttcttaagaacaacaacaccgtcaaaatgggcaaggaagagaagctccacctcaacgtcgtcgtcattgggcacgtcgactccggcaagtctacgactaccggccatcttatctacaagtgcggtggtatcgacaagcgtaccatcgagaagttcgagaaggaagccgctgagctcggcaagggttccttcaagtatgcgtgggttcttgacaagctcaaggccgagcgtgagcgtggtatcaccatcgatatcgccctctggaagttcgagacccccaagtactatgtcaccgtcatcgacgcccccggtcatcgtgacttcatcaagaacatgattactggtacctcccaggccgattgcgctattctcatcatcgccgctggtactggtgagttcgaggctggtatctccaaggatggccagacccgtgagcacgctctgctcgcctacaccctgggtgtcaagcagctcatcgtcgccatcaacaagatggacaccaccaagtggtccgaggaccgttacaaggagatcatcaaggagacctccaacttcatcaagaaggttggctacaaccccaagagcgttgccttcgtccccatctctggcttcaacggcgacaacatgcttgaggtcaccaccaacgctccttggtacaagggctgggagagggaggtcaagagcggcaagctcaccggcaagaccctccttgaggccatcgactccatcgagccccccaagcgtcccaccgacaagccgctccgtcttcccctccaggatgtgtacaagatcggtggtattggaacggtccctgtcggccgtatcgagactggtatcctgaagcccggcatggttgtcaccttcgctccttccaacgtcactacggaagtcaagtccgtcgagatgcaccacgagcagcttaccgagggtgttcccggcgacaacgttggtttcaacgtcaagaacgtctccgtcaaggagattcgtcgtggcaacgttgccggtgactccaagaacgacccgccccttggtgctgcgtcgttcgacgctcaggtcattgtcctgaaccaccccggtcaggttggtgctggctatgcccccgtcctcgactgccacaccgcccacattgcctgcaagttcgccgagcttcgcgagaagatcgaccgccgtaccggcaagtccgttgaagacgcccccaagttcatcaagtctggtgatgccgccatcgtcaagatggttccctccaagcccatgtgcgttgaggctttcaccgactaccctcctcttggtcgtttcgccgtccgcgacatgcgtcagaccgtcgccgtcggtgtcatcaagagcgttgagaaggccgttgccggttccggcaaggtcaccaagtccgctgccaaggctggtgccaagaagtaaacagcttcttgctcaagcaaacaaaaatctcacttccagggattcggggccgcttggctctcacgcgagatcgcgtcgcggttttggccgcgatgctacgattgacatgagcacttgggtcgttttgtgatggggcacatttgagggggttaatggtcggggtttctgcgcatcaaaaacttctcaccatgtgcttagtacaaaatagagtctcctagaagtgatcacgaaggtcatgattccc

SEQ ID NO: 36479 - protein, 461 aa, Panicum virgatum
  misc_feature: Ceres CLONE 1985677
  misc_feature (6)..(236): Pfam Name: GTP_EFTU Pfam Description: Elongation factor Tu GTP binding domain
  misc_feature (333)..(441): Pfam Name: GTP_EFTU_D3 Pfam Description: Elongation factor Tu C-terminal domain
  misc_feature (259)..(326): Pfam Name: GTP_EFTU_D2 Pfam Description: Elongation factor Tu domain 2
  misc_feature: SWISSPROT Homolog: EC 2.7.7.4 Sulfate adenylyltransferase
MGKEEKLHLNVVVIGHVDSGKSTTTGHLIYKCGGIDKRTIEKFEKEAAELGKGSFKYAWVLDKLKAERERGITIDIALWKFETPKYYVTVIDAPGHRDFIKNMITGTSQADCAILIIAAGTGEFEAGISKDGQTREHALLAYTLGVKQLIVAINKMDTTKWSEDRYKEIIKETSNFIKKVGYNPKSVAFVPISGFNGDNMLEVTTNAPWYKGWEREVKSGKLTGKTLLEAIDSIEPPKRPTDKPLRLPLQDVYKIGGIGTVPVGRIETGILKPGMVVTFAPSNVTTEVKSVEMHHEQLTEGVPGDNVGFNVKNVSVKEIRRGNVAGDSKNDPPLGAASFDAQVIVLNHPGQVGAGYAPVLDCHTAHIACKFAELREKIDRRTGKSVEDAPKFIKSGDAAIVKMVPSKPMCVEAFTDYPPLGRFAVRDMRQTVAVGVIKSVEKAVAGSGKVTKSAAKAGAKK

SEQ ID NO: 36480 - DNA, 674 bp, Panicum virgatum
  misc_feature: Ceres CLONE 1985678
  misc_feature: Encodes the peptide sequence at SEQ ID NO. 36481
atctaccgcaccgcatacctcgtacgattcgatcaggaaagcgttcgagtccacagcaaagtcgagtgctcgttaatcaaaaaaaaagtcgagtgctcgagtcacgtcagctcctcgaagtctctctcctctgcattcttcgcggggcatggagacgctcctggtcggcaaccccgccaacggcgtggcgaagccgatgtgcaccggcgtcggcgcgctgcccgtggccaactcccacgccgtcatcgacgcgccgccgccggccgcggtggccccggcgggcgccacgctcggccgccacctggcgcgccggctcgtgcagatcggcgcctccgacatcttcgccgtccccggggacttcaacctcaccctgctcgactacctcatcgccgagccggggctcaccctcgtcggctgctgcaacgagctcaacgacgggtacgccgccgacggctacgcgcgctccaggggcgtcagcgcctgtgccgtcaccttcaccgtcgggggcctcaacgagctcagcgccatcgccggcgcgtacagcgagaacctccccgtcatctgcatcgtccgccggcccgactcccacgactacgggaccaaccgcgtcctccaccaaaccatcggtctcccggacttctctcaggagctccgctgcttccaggccatcacct

SEQ ID NO: 36481 - protein, 175 aa, Panicum virgatum
  misc_feature: Ceres CLONE 1985678
  misc_feature (46)..(175): Pfam Name: TPP_enzyme_N Pfam Description: Thiamine pyrophosphate enzyme, N-terminal TPP binding domain
  misc_feature: SWISSPROT Homolog: EC 4.1.1.1 Pyruvate decarboxylase
METLLVGNPANGVAKPMCTGVGALPVANSHAVIDAPPPAAVAPAGATLGRHLARRLVQIGASDIFAVPGDFNLTLLDYLIAEPGLTLVGCCNELNDGYAADGYARSRGVSACAVTFTVGGLNELSAIAGAYSENLPVICIVRRPDSHDYGTNRVLHQTIGLPDFSQELRCFQAIT

SEQ ID NO: 36482 - DNA, 1440 bp, Panicum virgatum
  misc_feature: Ceres CLONE 1985681
  misc_feature: Encodes the peptide sequence at SEQ ID NO. 36483
aaaacactgcaacaggggatatcgagtgacttctctctcacttgcactttcggggataaccactcagacgacaacagagcgagatactgtggcgcatcacccatccggtgctgcggacagcgtaagattaaagccataccgcgaagcaatgactctaacacaaagaacaagtcaccgtaacccggatgaattccccacggtccagctatttctgctagccattgtccgtcttgccgagcccatcgcgctcacctccatcttcccgtatgcctgggccctcatcaagcgattcgaggtcggtaacgaagatgacgcctcgttctatgccggtctgctcatctcggccttctccctggcggaggccctgatgggcatgtactggggcggtctgtcagaccgcgtcggacgcaagcctgtcctgctgcttggatgcatcggcaccatgttcagcatggtcatggtcggctttgccgagaacatctgggtggctctgatcggccgggccctcggtggtctgctaaacggcaacatcggcgtcatccagaccatggttggcgagctggttacgaagccagagcatgagccccgtgcatactccatcatgccttttgtttggagcatcggtaccatcatcggtcccatggttggcggtctcttcgcggacccgcacgtgtcgtaccccaatctcttccccaagggctctctcttcgaccacttcccctacctcctaccaaatctcatctgtgccgccatgcttctcgtgagcattgtgctcgggtattttctcctcgaagaaacccatccggacatgcagccgcgcgtcctactccccgatgacaccttcctctctgagaacacccctctcatagaaacgtccgacgccatgaagcgccccgccgtcgatctccgcgacgagaactacggcactatgcgctcgcgcgacgcggctcccccggcctcgcccagctggaccaaggagcaacagccccctatcagcatcttctgcaggcgcatcatggccatcatcctggccctctccatcttcacctaccactccatgaccttcgaccacctcctgcccatcttcttcaaagacgaccgcatccccaacaacaacatccccaccaccctcgccctcgccagcggcaaccccttctactcccccggcgggctaggcatgtcgctgcaggcggtcggcgtcgtcatggcagtgcagggcgccatcgcgctcttcatgcaggcggtcgtgtttcccatcatggcggaccgcgtcggcatctaccgcctcttcctcttcatcacggtgctgcacccgctcgtgtacctgctcgtgccgtggctgctgtacgtacccgaggccgccctgtggcccgccatctacgccgtgctcgccgtccgcaacttcttctctatcctgctctacccgctgctgctcatcct

SEQ ID NO: 36483 - protein, 430 aa, Panicum virgatum
  misc_feature: Ceres CLONE 1985681
  misc_feature (23)..(426): Pfam Name: MFS_1 Pfam Description: Major Facilitator Superfamily
MTLTQRTSHRNPDEFPTVQLFLLAIVRLAEPIALTSIFPYAWALIKRFEVGNEDDASFYAGLLISAFSLAEALMGMYWGGLSDRVGRKPVLLLGCIGTMFSMVMVGFAENIWVALIGRALGGLLNGNIGVIQTMVGELVTKPEHEPRAYSIMPFVWSIGTIIGPMVGGLFADPHVSYPNLFPKGSLFDHFPYLLPNLICAAMLLVSIVLGYFLLEETHPDMQPRVLLPDDTFLSENTPLIETSDAMKRPAVDLRDENYGTMRSRDAAPPASPSWTKEQQPPISIFCRRIMAIILALSIFTYHSMTFDHLLPIFFKDDRIPNNNIPTTLALASGNPFYSPGGLGMSLQAVGVVMAVQGAIALFMQAVVFPIMADRVGIYRLFLFITVLHPLVYLLVPWLLYVPEAALWPAIYAVLAVRNFFSILLYPLLLI

SEQ ID NO: 36484 - DNA, 761 bp, Panicum virgatum
  misc_feature: Ceres CLONE 1985707
  misc_feature: Encodes the peptide sequence at SEQ ID NO. 36485
  misc_feature (665)..(665): n is a, c, t, g, unknown, or other
ggaatatcgaaaggcaagccgccgcctcgagcccagcgtctttcggagaccacccgtttccaccgtagcggctttttgccctgttcgccttgtccgaggagaaggcctcctctgcctcggcgggccgccgtcccagccgcagcggcgcgctctccatggcgtcctaatcagcgacaacgccgcaacgagcctgcgaagcagagcctaaggtttcgtgtatgatgccaagcatggatgaagcccttcttggcaatggtgttcagaagaccggaggggtgggagagaacctggttctgcctgaggtcagaaagcagctgcaccttgctgggccactcattgccgcatggatcctgcagaacatcgtccagatgatatctgtcatgtttgttggtcacctcggtgagcttgcactctcctgtgcctccatcgccacctcttttgcaggtgttactggcttcagcttattgtctggcatggcaagcagcttggacacactgtgtgggcaagcctttggggcaaagcagtactatcttctcggtatctacaagcagagggccatccttgttctcactctggtgagccttgtggttgctgttatctggtcgtacactggccagatccttctagtctttggtcaggacccagagattgcagctggcgcaggnagctacatccgatggatgattccagcgctgttcgtgtacgggccactgcagtggcatgtccgattcctacagacgcagaacatagtccttccagtg

SEQ ID NO: 36485 - protein, 176 aa, Panicum virgatum
  misc_feature: Ceres CLONE 1985707
  misc_feature (34)..(175): Pfam Name: MatE Pfam Description: MatE
MDEALLGNGVQKTGGVGENLVLPEVRKQLHLAGPLIAAWILQNIVQMISVMFVGHLGELALSCASIATSFAGVTGFSLLSGMASSLDTLCGQAFGAKQYYLLGIYKQRAILVLTLVSLVVAVIWSYTGQILLVFGQDPEIAAGAGSYIRWMIPALFVYGPLQWHVRFLQTQNIVLP

SEQ ID NO: 36486 - DNA, 602 bp, Panicum virgatum
  misc_feature: Ceres CLONE 1985710
  misc_feature: Encodes the peptide sequence at SEQ ID NO. 36487
aaggccagaggagaggagacacccaccactccgatggatcactccacctccctgctccgtctcatcttcctcgccctcggcgccgccctcgtcctcctcgtggtccgctccgcactccaccttccgcgcggcatcaacacgccaacaacctcgctcttggacgccgccgccgccgcgggcagcagcaactgcacccggttcgcgccgtgggggtgccgacagggcggccggacgaagcccaagcccaagcccaagccgccgtcgcacaagaccgacgtgcctcggcacccgctggacccgctgacggtcggcgagatcaaccgcgcgcgcgagctcctccgcgcgcacccaccgttcgcatcgtcgccgtcgtccctgttcgtgcactcgctcgcgctggacgagccggagaaggccgccgtcctggcctggcggaagggcgccgacccgctgcccccgcgccgcgccgtggcggtcgtccggttccgcggcgaggcctccgtcctcgccgtcgacctcgccggcggcgccgtggatcctctgcccgtccccgcctccgggtacccaaccatgaccatggacgagcaggtgtccctctgctc

SEQ ID NO: 36487 - protein, 189 aa, Panicum virgatum
  misc_feature: Ceres CLONE 1985710
  misc_feature (85)..(173): Pfam Name: Cu_amine_oxidN2 Pfam Description: Copper amine oxidase, N2 domain
MDHSTSLLRLIFLALGAALVLLVVRSALHLPRGINTPTTSLLDAAAAAGSSNCTRFAPWGCRQGGRTKPKPKPKPPSHKTDVPRHPLDPLTVGEINRARELLRAHPPFASSPSSLFVHSLALDEPEKAAVLAWRKGADPLPPRRAVAVVRFRGEASVLAVDLAGGAVDPLPVPASGYPTMTMDEQVSLC

SEQ ID NO: 36488 - DNA, 2004 bp, Panicum virgatum
  misc_feature: Ceres CLONE 1985727
  misc_feature: Encodes the peptide sequence at SEQ ID NO. 36489
gcaataccaaatccagacccaatcccacccgccgccagagcgtgcgtccggcctcctgcgacgccgagtcgccgacgcccccgagcccgacgtcgcccgcgtggcccccgcctgggagcgcctgcgcgcctgcgccgctgcgcggccgcgcggccgccgctgggagctcctgccgcctgccgcctgggagtgcccgcgcgcctgccgcctaggtgcgcctgcgcgctcgcgagggcgaggccgcgacctcaacaggtcgccgcgccgccgccctgaggcccgcggggttctgccgctgccgccgccgccgcctatcccctgagccccgatctcccacggtttcttctatcgcccgacgggtacccggcgggtacgggtacgagttttcgcctgaaacgttttgcgggtacgggtacggctgcaatgttcgggtatgctgtcgggcgggtaaatgtcttacccgcaccatacccgacccgttgccatccctaccgccgcacaacctcagcggcatcttcctccactcttaagccaccctcacacccgccgccgtctcctggcatccgcgtccggcaggccaccaccgtgctcccgcgttcctgccccgccgctgcaatggctgcggcagcctcgctggcagcgtgcgctcaggcatccggcccccgcgcgggggcccgcctcgccgtccgcaccgcagccctcccggcggacggacgcggcgacggcgccgcctccaaggagctcggtctgtactccttgaaaaagaggattgaagatgcagttatccgggttgaaaccaccgcatccagtgctctggagttggaggaagcacggagaattaagcaggaagaagtactgcggaagtgtaacttgtgggataatctaactaagtcacatgagacgctctctgctctggcagatgccatcagggtggtcgaccatctaaaagatcttcgcttcaaggctgaagaggcaaaattgataagtcaactatcagagatggatgccataaatggtgagctatttaagcaagcatacaaatcttcagtagatgctagcgagtatctagatcgctaccagatgtacaagcttcttaagggtccatacgacaaggaaggagcttgtattattgttactgcagtatcagatggtgttgcttctgagctatgggcagcgaaggtctttggcatgtatacaagttgggcacggaagcaaggttgcaaggttggattgattgagaagatttcttcaatgagtggccatgtccggactttagcgatggagattgaatcagagtacatttttggcatcctttctggagaaaaaggaatgcatcgaatgatatactcttcccttgaaaattctgataaatttcaggccttatcagctagagtagacgtaattcccctcttcttggataggccaattaatcttcacttggatgacaatgatatagagatcgctccctcaccttcttctgaatgtaagaagcgagatagcagaaactgtgctgctgtcagtgttcaacacaaaccaagtggagtcactgcggaaagttcaggtgagagaaactattttggaaacaggctaaaagctacaagtaggttgaaagcaaagctccttttatttgcaagagaattgggagtatcaaacatgaagacgataaacaaacaagctataaaggatatatgcagccgtgaaacgcgaaggtacacatttgggcctcagaaattggtccatgatctcaacacaggcaaccagttatcagatttgaacttggttctggaaggtgaaatagaaccattcattagaggtcgtattatcgccagacaatgatgatacaactcaccaattgattgattgtcccccctcattgcgatcttgtacatttatttgtctttatacaaaccacaccacatcaaaggatgacctctgtaaaatatcacatttcaagccaaaaggcatgacacctggtatacaaaacattacgttgtttgcaccatc

SEQ ID NO: 36489 - protein, 406 aa, Panicum virgatum
  misc_feature: Ceres CLONE 1985727
  misc_feature (125)..(236): Pfam Name: PCRF Pfam Description: PCRF domain
MAAAASLAACAQASGPRAGARLAVRTAALPADGRGDGAASKELGLYSLKKRIEDAVIRVETTASSALELEEARRIKQEEVLRKCNLWDNLTKSHETLSALADAIRVVDHLKDLRFKAEEAKLISQLSEMDAINGELFKQAYKSSVDASEYLDRYQMYKLLKGPYDKEGACIIVTAVSDGVASELWAAKVFGMYTSWARKQGCKVGLIEKISSMSGHVRTLAMEIESEYIFGILSGEKGMHRMIYSSLENSDKFQALSARVDVIPLFLDRPINLHLDDNDIEIAPSPSSECKKRDSRNCAAVSVQHKPSGVTAESSGERNYFGNRLKATSRLKAKLLLFARELGVSNMKTINKQAIKDICSRETRRYTFGPQKLVHDLNTGNQLSDLNLVLEGEIEPFIRGRIIARQ

SEQ ID NO: 36490 - DNA, 743 bp, Panicum virgatum
  misc_feature: Ceres CLONE 1985754
  misc_feature: Encodes the peptide sequence at SEQ ID NO. 36491
ggggataattcttgtgtagccaaagaatccgaatcaggaactagtgtatcagccatcccaaaggagagctcacaggactatagaaaaaagtttaggaaagtgtttcttaaaaaagacaaaagaacaaaaagaagagatgagagcttcgagcgagctctactcatagcaaatacatataccaaagttgatgtaatctggcaggatgggacaaaggaatgtggagtaacctcaacatcactgattcctatccacagtccaaatgaccatgagttcttcccagagcagtatgttgtcgacaaggtcactcatgatgtcgatgattcggccgaaccaaagcgtgtgggtcttgttagaagtgttaatgccaaggatcgaactgcatccgtatcatggtttaagccctcgctacacccagaggagccgaaggagattcagtctcatgaaattgtgagtgcatatgaactggatatccatccagattatgattattgctatggagatgttgttgtccgcttgccatctgtttcaccactgattgaatcaaccaatagtgaggacaaaatggaactggataagaagttagattcatcagaaggattggctgcttcaaatgtggcaccccctgatgctagtgctgatgatcaagtttcacagaaggaatcctgttcgcagtttacaagcctttcatgggctggaaatatagttagctttcaagatggtgaaattggaagtcatttgggggt

SEQ ID NO: 36491 - protein, 247 aa, Panicum virgatum
  misc_feature: Ceres CLONE 1985754
  misc_feature: SWISSPROT Homolog: EC 6.3.2.19 Ubiquitin--protein ligase
GDNSCVAKESESGTSVSAIPKESSQDYRKKFRKVFLKKDKRTKRRDESFERALLIANTYTKVDVIWQDGTKECGVTSTSLIPIHSPNDHEFFPEQYVVDKVTHDVDDSAEPKRVGLVRSVNAKDRTASVSWFKPSLHPEEPKEIQSHEIVSAYELDIHPDYDYCYGDVVVRLPSVSPLIESTNSEDKMELDKKLDSSEGLAASNVAPPDASADDQVSQKESCSQFTSLSWAGNIVSFQDGEIGSHLG

SEQ ID NO: 36492 - DNA, 724 bp, Panicum virgatum
  misc_feature: Ceres CLONE 1985759
  misc_feature: Encodes the peptide sequence at SEQ ID NO. 36493
agtggcgccgtgcctgctgcctgctgcctgctgcctgctgcctgctgccatcgccccccataactctcacccgccccgcacgcctgcctggctgtctgtccctcccgctctgctccgcacactcggtgcaggtgaagcgtcgtcccctgctctgctccccaccccacccagcgcccgcattgccgccggtgagcggaggcggaccggccgcggcggcgcgggggaggaaccaggaggaggggcgggaagagaggcggcaggatgttcgggcgggacccgtggggcgggccgctggagatctccaacgccgactcggcgacggacgacgaccggagccgggacctggaccgggcggcgctgatgcggcagctcgacgagacgcagcagagctggctcctcgccggcccgggcgaccaggcgggcaagaagaagaagaagtacgtcgacctcggctgcgtcgtcctcgaccgcaagatcttcatgtggaccgtcggcaccatcctcggcctcggcgtcttcatcggcttcgtcatgatgatcgtcaaactcgtaccgcacaagcgcccgccgccgccgccgcccgaccagtacacgcaggcgctgcacaaggcgctcatgttcttcaacgcccagcgatctggtccgctgcccaagcacaacggcgtcagctggaagggcaattcctgcatgaaggatggtctctcggacagcaccgtccgggcga

SEQ ID NO: 36493 - protein, 154 aa, Panicum virgatum
  misc_feature: Ceres CLONE 1985759
  misc_feature: SWISSPROT Homolog: EC 3.2.1.4 Cellulase
  misc_feature: Functional homolog of the protein sequence given in SEQ ID NO 50500
  misc_feature: Useful for making plants with altered cell wall content and/or composition
  misc_feature: Functional homolog of the protein sequence given in SEQ ID NO 50501
  misc_feature: Useful for making plants with altered carbohydrate content
MFGRDPWGGPLEISNADSATDDDRSRDLDRAALMRQLDETQQSWLLAGPGDQAGKKKKKYVDLGCVVLDRKIFMWTVGTILGLGVFIGFVMMIVKLVPHKRPPPPPPDQYTQALHKALMFFNAQRSGPLPKHNGVSWKGNSCMKDGLSDSTVRA

SEQ ID NO: 36494 - DNA, 725 bp, Panicum virgatum
  misc_feature: Ceres CLONE 1985778
  misc_feature: Encodes the peptide sequence at SEQ ID NO. 36495
atgcatacatccccaccgcgccatggccatggccacctcgcagctcttcatcttcctccacatttccacctgctttctcctaccctcatccctgcatgctaataacgatcctgcagtagacgcgtcgagattctccttcagcttcaacttctccgacgagtccagctaccgagcagggagcgacgacctgctgttcgagggctcggcgtcgccgccgcagggcaacctggtcgacctcacctgcaacaagctcgggaaggagatcaacagctgcgcggggcggatgtcgtacggccacccggtggcactccacgacagcgcgaccacggcgagcttcagcacgcgcttcaccttcgcgatcgtggcagccggcgacggcgcaccgggggacggcatcgccttcttcctctccggctacccgtcagccatgccgccgtactccttcggggggcacctcggcctcgtcaaccccaacgcgaccacggcctacggcgtcggccagttcctcgccgtcgagttcgacacctacaagaaccgttgggatcccaaccccagccacatcggcgtcgacgtcaactccgtcctgtcctggaacacgacggtcctgccgattctgacgaacaatggcaccataacggcgacgattcagttcaacggcacgaccggaatgctggtcacctccctccggtttcatgaccgtccctcttttgcccccgttgtgtttg

SEQ ID NO: 36495 - protein, 234 aa, Panicum virgatum
  misc_feature: Ceres CLONE 1985778
  misc_feature (33)..(230): Pfam Name: Lectin_legB Pfam Description: Legume lectin domain
MAMATSQLFIFLHISTCFLLPSSLHANNDPAVDASRFSFSFNFSDESSYRAGSDDLLFEGSASPPQGNLVDLTCNKLGKEINSCAGRMSYGHPVALHDSATTASFSTRFTFAIVAAGDGAPGDGIAFFLSGYPSAMPPYSFGGHLGLVNPNATTAYGVGQFLAVEFDTYKNRWDPNPSHIGVDVNSVLSWNTTVLPILTNNGTITATIQFNGTTGMLVTSLRFHDRPSFAPVVF

SEQ ID NO: 36496 - DNA, 1431 bp, Panicum virgatum
  misc_feature: Ceres CLONE 1985786
  misc_feature: Encodes the peptide sequence at SEQ ID NO. 36497
aacggctcatcactccagtctctcactcgtcactccctcgcttcctcgtttcggcatggagcccaaaccctcgccgccgccgaccgccacgccgcgccgccgcggggtggcgaccaagcgcaaggagagggtcgcatccgcggcactccccgcgtccccaccgccgaagcgccaggcctgggagcgcgcccgcgtcgacccgccgcccctcccgcctcctccgccgccgccgccttcaccgcgcagccgccctgccgccagcaagtcgcggcgcaagcccgctcggaagaaagcgccgcgccgctccgtgaatccgccgcgcgagcagcaggaggaggaggaggaggaggcgccgtcgccgtcgccgtcgccgtcgccgtcgccgcccagggcgtcgcttgagcaggagatcgaggccgtcctgtcccgcggcgccggcgtccacgtcgtccccaccttcgccggatggttttcatggaaggaaattcacccaattgagaagcaaatgttggctacattttttgatgggaaatcagagagaaggacacccgagatatacttgggaattaggaattcaatcatgagaaaatttcactttaatcctgaagtgcatctggagaaaacagatttgtctgagttgtcaattggggagatggatgctcgtctggaaatcttggagttcctggctcactggggcttggttaattttcatccttgtccaccagttgcacaggactgcaagctaattgagagcaaaagtagtgctgatacagcggaggaaatttctctgattgagaagctatttcagtttgaaacagttcattcatatctggtacctgtttcaaagaaagctgaaatcatagccccagttcagtttactagcttcctttctcagcctaaactagctgaagatgcgataactgcagctgagtcttctgttgagtatcattgcaactcctgctcagttgattgttccagaaagcgctatcattgtaggactcaggtagactttgatttgtgttctgattgctacaatgaaggaaagtttgatgaaggcatgtcaaaagctgatttcatccttatggaatatgcagaggttcctggctccggtggttctaactggactgaccaggagacattgcttcttttggaagctttggaaatttttaaaggaaaagaatgggatgagattgctgagcatgttgctacaaaaacaaaagaacagtgcatgctgtacttcctccagatgccaattttcgattcctttctagatggtgaagatatcaatgaaacacctcagaagatcacagaacaggattcagcagaaactggcactttgggtgtacctgaggatatggatgtaggtgacaatgcagaaggaaaagagagcgctgatgaaaacacttgcaagaaagcaaatgctaattcttc

SEQ ID NO: 36497 - protein, 458 aa, Panicum virgatum
  misc_feature: Ceres CLONE 1985786
  misc_feature (130)..(218): Pfam Name: SWIRM Pfam Description: SWIRM domain
  misc_feature (353)..(399): Pfam Name: Myb_DNA-binding Pfam Description: Myb-like DNA-binding domain
  misc_feature (293)..(337): Pfam Name: ZZ Pfam Description: Zinc finger, ZZ type
MEPKPSPPPTATPRRRGVATKRKERVASAALPASPPPKRQAWERARVDPPPLPPPPPPPPSPRSRPAASKSRRKPARKKAPRRSVNPPREQQEEEEEEAPSPSPSPSPSPPRASLEQEIEAVLSRGAGVHVVPTFAGWFSWKEIHPIEKQMLATFFDGKSERRTPEIYLGIRNSIMRKFHFNPEVHLEKTDLSELSIGEMDARLEILEFLAHWGLVNFHPCPPVAQDCKLIESKSSADTAEEISLIEKLFQFETVHSYLVPVSKKAEIIAPVQFTSFLSQPKLAEDAITAAESSVEYHCNSCSVDCSRKRYHCRTQVDFDLCSDCYNEGKFDEGMSKADFILMEYAEVPGSGGSNWTDQETLLLLEALEIFKGKEWDEIAEHVATKTKEQCMLYFLQMPIFDSFLDGEDINETPQKITEQDSAETGTLGVPEDMDVGDNAEGKESADENTCKKANANS

SEQ ID NO: 36498 - DNA, 706 bp, Panicum virgatum
  misc_feature: Ceres CLONE 1985792
  misc_feature: Encodes the peptide sequence at SEQ ID NO. 36499
tctccagccctaatccccttcgtccccgttccccttccgcggcggcgtctgcggcggcggcgaggggaggcgagccaccaaccaagcagcccctccgtgattcaggaatagaacctcaaccagtaaaatgaggccagttttttgtgggaaccttgactatgatgtccgcatttccgagattgagcgactttttggcaagtatggaagagtggaacgagtggatctaaagacaggttagtctgttccttgccatgttattctcgaatttatgatgatatttagcaagataatatttttctgctttagctatctgtaatttttggtcaagggacaagagttttatttcattaagtgaattacttctagagtcagctaacattactgatattgaggctctgatttgtcccaccccccaattgtttctttgttttatatgctgaagtattaccgaatatatttataagacaatgctgcttgacttgcattgttttaaattttcaataaattttagctgtccaaaaaaggggcagtgccttcttggttttgcaatttgatttactattcggttcaaatcatgtatggctgtgaacagatacatgatcttcacatatgacctcttaagagtgtgttcatttgactaatatgatccggtgagttcaagtggaaattgctgtaaccatgatgtggcagatattattgatcttcc

SEQ ID NO: 36499 - protein, 36 aa, Panicum virgatum
  misc_feature: Ceres CLONE 1985792
  misc_feature: Functional homolog of the protein sequence given in SEQ ID NO 50813
  misc_feature: Useful for making plants with modulated biomass
MRPVFCGNLDYDVRISEIERLFGKYGRVERVDLKTG

SEQ ID NO: 36500 - DNA, 1458 bp, Panicum virgatum
  misc_feature: Ceres CLONE 1985808
  misc_feature: Encodes the peptide sequence at SEQ ID NO. 36501
ggtttcctcttccgcatccggtctttgcccgctttatattccttcacatgcactgctctccccacaacgaccaaaacccccaaacccaaccatcaccaagattccagcacgcgctcgccgccaccgcaaaatcttctcccgtccaccgcaatggcgagaaccgttcggcccctaaccccccgcttctgatcccgaaaccaaatcctccgccgagcagcgccagcatttcgggcgctcgaaaggagccgccttactctgaggatcggaaggggacggagcaatggcggcggcgtggggccgcgccaagcgcgcgctcgccacaagcctctgcatcagcgtgcccgcgcgccagattgccatcgaggactcgccgccggaggcgggggtggctgaggcgtcgtcttctttggtccaggagaaggcggagtccgcctccgtgtctctgcggcggctgaaaagctttggaagccggagctcgcagaagatatgttcaatttgccttggaggcatgagatcagggattggacaggccttgttcacggctgaatgctcccacaaattccattttcattgcatatcttcaaatgtcaagcatggcaaccttatctgcccgatatgccgtgctgagtggaaagaactcccaggcgctcaacctgcagatgccaattatggaagagctagagtaagcccactaaactggccccaggatgaagggcacatggctgttgtccgcaggctttccaatgcatacagtggaagcctgcaggagcaccttcctttcttccgtacaccagaggcaggcatcttcaatgatgatgagctcatagatcttcagtcttatacaacaaatgaacatgatgcagtcactggttcagttgaaatcaagacatattcagaatttcctgctatacaacagtcagtggcccaggaggtctttgctgtattgatccatctcaaggctccaaaatcctctcactcagcatgctcccgtgcacctcttgaccttgtcgctgttcttgatgtcagcggtagcatggcagggaccaagcttgcacttctgaagcgtgccatgagctttgtcatacaaacccttggacccaacgaccgcctgtctgtcattgccttctcatccacagcacggagactcttccctcttcgccgaatgacgttaactggtaagcagcgagccttgcaagatgtcagttcacttgttgcaagcggtggcacaaacattgctgacgggctaaagagaggtgctaaagtgatcgaggaccgtcagtcgaagaacccagtctgtagcatcattcttctctctgatggtcaagacacgcataccctcctttctgacaggggtttgctaaattacagcgcccttgtccctccttcaattcttcctggaacaggtcaccatgtccagatccacacctttggttttggctcagatcatgattctgctgc

SEQ ID NO: 36501 - protein, 392 aa, Panicum virgatum
  misc_feature: Ceres CLONE 1985808
  misc_feature (241)..(392): Pfam Name: VWA Pfam Description: von Willebrand factor type A domain
  misc_feature (70)..(113): Pfam Name: zf-C3HC4 Pfam Description: Zinc finger, C3HC4 type (RING finger)
  misc_feature: SWISSPROT Homolog: EC 6.6.1.1 Magnesium chelatase
MAAAWGRAKRALATSLCISVPARQIAIEDSPPEAGVAEASSSLVQEKAESASVSLRRLKSFGSRSSQKICSICLGGMRSGIGQALFTAECSHKFHFHCISSNVKHGNLICPICRAEWKELPGAQPADANYGRARVSPLNWPQDEGHMAVVRRLSNAYSGSLQEHLPFFRTPEAGIFNDDELIDLQSYTTNEHDAVTGSVEIKTYSEFPAIQQSVAQEVFAVLIHLKAPKSSHSACSRAPLDLVAVLDVSGSMAGTKLALLKRAMSFVIQTLGPNDRLSVIAFSSTARRLFPLRRMTLTGKQRALQDVSSLVASGGTNIADGLKRGAKVIEDRQSKNPVCSIILLSDGQDTHTLLSDRGLLNYSALVPPSILPGTGHHVQIHTFGFGSDHDSA

SEQ ID NO: 36502 - DNA, 677 bp, Panicum virgatum
  misc_feature: Ceres CLONE 1985808-R
gaatcacaagctgcacaatcttcagacaaccaatgcttgtcattgataacagagctgagggagatgcaggatagggtggagagccggcaaaggtatgaggaatcaggcagggcgttcatgctatctggcctgagctcacacacatggcagagagcaaccgcacgtggtgactcgactgatctcagtaccactattcacacctatcagacgccatccatggttgacatgcttcagcgctctcagactcttgctactcctggtgttgacacgctgaatcgctccccaactatggttccttcacacaggtctcctcataggttcagacggccaaccaggtcaacgaaatccttctccggtcggcccctgtgatgctgcctgatcatgattcagttctagcattgactattgaagtattacgacaaagtaaattattcattctttagtctgtcatactgcagttcttacttccattttcaatattctatagaaggcatgggactagaagtcttgagatttataaatggcataactgatagaggtgaaaaggatttaggtatatatatttttacagttgtctgtttgttctgtacataaacatctcccttgaatgatttccgtgagtaatatctttgggattgataaatggcatatcaatggaatgaaaggattgaggtgtg

SEQ ID NO: 36503 - DNA, 655 bp, Panicum virgatum
  misc_feature: Ceres CLONE 1985811
  misc_feature: Encodes the peptide sequence at SEQ ID NO. 36504
gcgaggtcgaaccccaaggcgaggcagcgaaaccctgagtcggccggccagtgcgaggggagagagtgcgcgaggcggcggagggcgagatgaagctcaacgtcaagaccctgaagggcaccagcttcgagatcgaggcgagccccgaggagacggttgctggggtgaagcggatcatcgagacgactcagggacagagcgtctaccccgccgacaaccagttgctcatataccaagggaaaattctcaaggatgacaccactttggaaagcaacaaagttgctgagaacagcttccttgttataatgctgtccaaggctaaggcatcgtcaagtggaccttctaccgctactcctgcaaaagctcctgcaactccggcccaacttgctacgcctgcagcccctgctgcttcagttgcaagatcaacacctcctcaagcgcctgttgccgcggcagtaacgtgagctctctctccttaaccttgtgtggaaaccctatcaggcttctcttatattaccgttacctttgacagggcgcctccaactgcacagccttcacctgctcctgctgctactgctccagctgctacagttgctgcatctgatgctgatgtgtacggtcaggcagcatcaaaccttgtctctggtagcaatct

SEQ ID NO: 36504 - protein, 124 aa, Panicum virgatum
  misc_feature: Ceres CLONE 1985811
  misc_feature (6)..(78): Pfam Name: ubiquitin Pfam Description: Ubiquitin family
MKLNVKTLKGTSFEIEASPEETVAGVKRIIETTQGQSVYPADNQLLIYQGKILKDDTTLESNKVAENSFLVIMLSKAKASSSGPSTATPAKAPATPAQLATPAAPAASVARSTPPQAPVAAAVT

SEQ ID NO: 36505 - DNA, 629 bp, Panicum virgatum
  misc_feature: Ceres CLONE 1985812-R
  misc_feature: Encodes the peptide sequence at SEQ ID NO. 36506
cgttgaacccgcccacatccaacagttcgcgtttgatacgtgcaaagggatggtttatcttcatgctcacaatattattcatagagatttaaagtgtcataatttattagttgacaaagattggaatgttaaagttggtgactttggactttctagagcaatcgaagatttagttgaaaagaataaaatgacggtgtgtggcacaccctcatgggctgcccctgaagtcatgagacaccaacaatatacgctaaaagcagacgtcttctcatttggtatttgcttgtgggagatgtgtgcacgtaaacttccatatgctggggttgcaccatatcaagtcgtaattgaagtagcaacaaagggaacgagaccagagatcgatgaaactatacctgaaatttttgttgatctaatgagagtatgttgggctgaaaatccaacagaacgtcctccgttctctgcaatacaaacaatgattcaaaaacttgaaccaccagttgcctcaaagaaaagaccctatcaaaaatcaaagaaattttctcttgattatatcgaagaaccaccacccgctcaacctcaaccggaagctgcccttcctaattttgaaatccaataaatatttttcctcc

SEQ ID NO: 36506 - protein, 204 aa, Panicum virgatum
  misc_feature: Ceres CLONE 1985812-R
  misc_feature (1)..(159): Pfam Name: Pkinase_Tyr Pfam Description: Protein tyrosine kinase
  misc_feature: SWISSPROT Homolog: EC 2.7.11.1 Non-specific serine/threonine protein kinase
VEPAHIQQFAFDTCKGMVYLHAHNIIHRDLKCHNLLVDKDWNVKVGDFGLSRAIEDLVEKNKMTVCGTPSWAAPEVMRHQQYTLKADVFSFGICLWEMCARKLPYAGVAPYQVVIEVATKGTRPEIDETIPEIFVDLMRVCWAENPTERPPFSAIQTMIQKLEPPVASKKRPYQKSKKFSLDYIEEPPPAQPQPEAALPNFEIQ

SEQ ID NO: 36507 - DNA, 1380 bp, Panicum virgatum
  misc_feature: Ceres CLONE 1985812
aaaaaagcaaacaggggcatgcaatcagatgctgcttattgttaatttcattctagctttgttcatcgtttattcctctgcacaaggagacgacctgacagattctccatgtagaaaatgtttattgtcaggagaacaaaatgtaggatggtgtgggaacacttcaaaagtcggttcctgcattttaggttggtccattgctcctccaacctgtcgggatcaattatggaatttcaacttttgcccagaaggtgttgaaattgctgttccaattgaatctgcgccttataaatccaataattctggatttattcctccagaattatgtcgtgataccctctgctatacagatagaaacaaaaggccaactctcttacctggtaactctcaatacagtggcaacaaattcaatattacacttccaaatacccatcttatatcaggtggatatatttcactaaacgcatcatcctgttgtcgcaatgaaacgcctgtttttcttctagaattcattttaatgtcccacaaagaagaagtccgagttttccatgactcatgtcaaagacaagaatgggtggatcctcaactacacatttcaaaaatattcaattttttgggattttattcaagttaatactgcaatgaaattaactatttcaatgagaagggatgattgtattttatggataaatgatcaatctcttcatgtaaatgctgtaaatattaatccaaaattaccagataatcctaattttcttgcatataatgattctcaacctttaccttctgtctatcttaaaggatcaaatttctggaaatttaaatattattgctcatggagaacggaagataatgagcaggtgtttgcttctgatccagtgttttttgcggagagtagacaatatgcatgtcaagtacctgagattgaaattccaacagcaaatgctccagcattttatctcctttcgcttcttccatatgaagcagactccctccttgcactagacttagataaagtgcacgtctctttttatgtatcgccaattcttcatagtgtttatccaagacgaggatatccagggatgaatttgacattaataggagaccaattcccaacaacgttcgaagatgccagaatagatctagactatgactccataaaagtcccaatttggataatcaactccacacacctaaacttcatcctccctgaagtagctccgcacaccgaagaactctgcctagaaatgtatttggttttgtgggatgattcttttattaggattcagattccttgttttgattttatatttgattctcctcctgttcctgtacccgcaccagttattccaactccaataccaccgactcctccaactc

SEQ ID NO: 36508 - DNA, 752 bp, Panicum virgatum
  misc_feature: Ceres CLONE 1985823
  misc_feature: Encodes the peptide sequence at SEQ ID NO. 36509
aaacaatccccaaggatctcatttttcagaagaaccaatccatcttgactctctcccctctctctccaccgaaacgtccgcagccatggcgacgaggacgctggagctgacgctgatctcggccaaggatctcaaggaggtgaacctgctctccaagatggaggtctacgccgtcgtctccctctccggtgacccccgctcgcggcagcggatccaggccgaccgcaccggcggccgcaaccccacctggaacgccacgctccgattcaacgtcccggccagcggcgccggatccctccacgtcctcctccgcgccgagcgcgccctcggcgaccgcgacgtcggcgaggtccacatcccgctctccgagctcctctccggcgcccccgatggccccgtccccgccaagttcgtcgcctaccaggtccgcaagatctcctccggcaagccacagggagtcctcaacttctcctacaagctcggcgaggtcacccaatcggccgccggctacgcccccgcccccgcccagtccgcctacacccagcctccctccgcatgcccgccggcaggcaaggccgacgcgtacccgcctccctccgcctacccgcctgcagccaaggccgacgcgtacccgcctcccaccgcctacccggcggcggccaaggccgacgcgtaccctcctcccaccgcctatccacccgcccggcagaccgacgcgccagcgaccgcttacccgcccccatccggctacc

SEQ ID NO: 36509 - protein, 222 aa, Panicum virgatum
  misc_feature: Ceres CLONE 1985823
  misc_feature (6)..(90): Pfam Name: C2 Pfam Description: C2 domain
MATRTLELTLISAKDLKEVNLLSKMEVYAVVSLSGDPRSRQRIQADRTGGRNPTWNATLRFNVPASGAGSLHVLLRAERALGDRDVGEVHIPLSELLSGAPDGPVPAKFVAYQVRKISSGKPQGVLNFSYKLGEVTQSAAGYAPAPAQSAYTQPPSACPPAGKADAYPPPSAYPPAAKADAYPPPTAYPAAAKADAYPPPTAYPPARQTDAPATAYPPPSGY

SEQ ID NO: 36510 - DNA, 707 bp, Panicum virgatum
  misc_feature: Ceres CLONE 1985824
  misc_feature: Encodes the peptide sequence at SEQ ID NO. 36511
gcttcggttgctccgtcgaaagcgacggagcctcgggagactcacaaattgcttcaggtgctaggtggaaaagtccgtagaagaaaattactttcacccaaagataggaatgttcgtccaatgatggaagtagtccgaggagcagcctttgacattttgcagtcagctggtggttctcctgcttcactcagaccaggtcggtggttagacttgtatagtggtactggatctgttggaatcgaagctatgagccgaggatgttcagaggttgtcgaacaactcatgctgaaacatgagtcatgatagtccagaaattaatgcaaataatccctgaaaaaaactattcatcaaattacctcttccgattctatcacaattctaaataagctcatggaatatgtatattgacatttcattaaaaggaagtctctgtaaataatagcctgtgtgcaaagtaatacctggtctgtgtgcggtacagaagtgtaccttcattcgcttcatttttttacatctttgtgggcccttacactgtaggaatcatggatggtagcacacaaatttcagtttgttgtatgaagcaagcagcataggcacatcctggaaatactaaaatggttgttaagatgatcatttgtaaagctacatttgagtctccaaagtagagacttttctgctatttcagtcatggcaactgacatatttac

SEQ ID NO: 36511 - protein, 100 aa, Panicum virgatum
  misc_feature: Ceres CLONE 1985824
  misc_feature: SWISSPROT Homolog: EC 2.1.1.52 rRNA (guanine-N(2)-)-methyltransferase
ASVAPSKATEPRETHKLLQVLGGKVRRRKLLSPKDRNVRPMMEVVRGAAFDILQSAGGSPASLRPGRWLDLYSGTGSVGIEAMSRGCSEVVEQLMLKHES

SEQ ID NO: 36512 - DNA, 755 bp, Panicum virgatum
  misc_feature: Ceres CLONE 1985830
  misc_feature: Encodes the peptide sequence at SEQ ID NO. 36513
accgcaccgccaacaccaccgcagctcgcagctcgcagttgcatctgatcgatcacttatacataggccaatggcgtcgtcgctgccggcgttcacggtgcggcggggggagccggtgctggtggcgccggcggagcccacgccgcgggaggtcaagccgctgtcggacatcgacgacggggagggcatgcggttctacagctcggggatccacctgtaccgcagcaacccggccaaggcggggcaggacccggccagggtcatccgggaggcgctcgccagggcgctcgtcccctactacccgctcgcgggccgcctccgcgaggaggccgggaggaagctcgtcgtcgactgcgccggccagggcgtcatgttcgccgaggccgacgccgacctcaccgccgacgacttcggggacgtgcagagcccaccgttcccgtgcttcgagcgcttcatcctcgagagcaccaccatcgccggcgtcgagcccgtcgtcgaccgccctctgctctacatccaggtgacgcgcctcacgtgcgggggcttcatcttcggccagcgcttctgccactgcgtcgtggacgccccgggcggcatgcagttcgagaaggccatctgcgagctcgcgtgcggcgccgccgcgccgtcggtggcgccggcgtggggcacggagatgttcatggcgcggcggcccccgcggtcgtcgtatccgcacctcgagtaccgcgagccggcgggcgggcaagacaggatgc

SEQ ID NO: 36513 - protein, 228 aa, Panicum virgatum
  misc_feature: Ceres CLONE 1985830
  misc_feature (8)..(228): Pfam Name: Transferase Pfam Description: Transferase family
  misc_feature: SWISSPROT Homolog: EC 2.3.1.162 Taxadien-5-alpha-ol O-acetyltransferase
MASSLPAFTVRRGEPVLVAPAEPTPREVKPLSDIDDGEGMRFYSSGIHLYRSNPAKAGQDPARVIREALARALVPYYPLAGRLREEAGRKLVVDCAGQGVMFAEADADLTADDFGDVQSPPFPCFERFILESTTIAGVEPVVDRPLLYIQVTRLTCGGFIFGQRFCHCVVDAPGGMQFEKAICELACGAAAPSVAPAWGTEMFMARRPPRSSYPHLEYREPAGGQDRM

SEQ ID NO: 36514 - DNA, 636 bp, Panicum virgatum
  misc_feature: Ceres CLONE 1985835
  misc_feature: Encodes the peptide sequence at SEQ ID NO. 36515
ttactttactcgcccccaccaccacctcctccacctcgccttccgcttcccacccgtccccgcgccgccgcctccggaccgcggcctccctcctccggcgagacctcttgcgccaacaccgccccatgccccgccgccggtgacctcggccccccgccatgggctgcgtgcacggccgcccgtccaccaccagccccgcggcccccgtcacctcctcccgccgccgggaccaccccgtggtctcccagccgcagcaggagggagtcgactcctccgacgccgccgcggcgccagcggggcctggcgcggcgccggagcagcaggcgggcgagaagcctgagaagccggcgcaggtgaagagggagcgccggtcgcggtcgttgcgctccgccgccgccgcggcggccgccgcggcgcacgcggaggtgcgcctgggcgggagcttcgccaacaaggcgcgcggcgagcaggtcgccgccggctggcccgcctggctctccgccgtcgccggcgaggccatcaacggctggacccctcgccgcgccgactccttcgagaagatcgacaagatcggccagggcacgtacagcaatgtgtacaaggcgcgggactcgctgagtggcaagatcgtggcgc

SEQ ID NO: 36515 - protein, 159 aa, Panicum virgatum
  misc_feature: Ceres CLONE 1985835
  misc_feature: SWISSPROT Homolog: EC 2.7.11.22 Cyclin-dependent kinase
MGCVHGRPSTTSPAAPVTSSRRRDHPVVSQPQQEGVDSSDAAAAPAGPGAAPEQQAGEKPEKPAQVKRERRSRSLRSAAAAAAAAAHAEVRLGGSFANKARGEQVAAGWPAWLSAVAGEAINGWTPRRADSFEKIDKIGQGTYSNVYKARDSLSGKIVA

SEQ ID NO: 36516 - DNA, 1904 bp, Panicum virgatum
  misc_feature: Ceres CLONE 1985839
  misc_feature: Encodes the peptide sequence at SEQ ID NO. 36517
gtttgaatccgcgtggcttgacgtcaaatcacattcatggtgcaattaggacaagtgggaaactacattctcgttatggctattgcaattgcattagtagggagattcacatctatgaaacctttagaagaagatttagtcttgggacaaggtggttatgattatcgatctgtttcagctccaaaattaagtggccttcccctctatttattaggcagagttgctcaaaatccccaatttggaccaatcctattgagagctctattaaatggaaatggagtcaacagactcaggtcgttagcctctcaatcccgagaaccctccgttttctttcccttcaaagtagttgacccaacagaaagagaatatcactcaaaccaatctcaccacacaaaagaatccctccgactccttctgagtcctgattcccttccagatcaatgtaaaaaattcaaaccaccaacaggtcgttggaagattgaagacttcgccctggcatatcgttgcaaaattacaactccttcaaaagttgcaaatagaatcttagaagcaatcaatcttcaaacaggctaccttagacacctcaaattcttcacacaaatcgttgaatcagaagttctctccgctgcacaagagtctgataaacgttttgaatcagaaaaaccacttggtgttttcgatggagttcctgttgcaattaaagatgaaattgacgtcctcggttatatcagtggatctgggacagacttttcaaatttcccagttgcaacgaaagatgacttaataacttcaagactcaaagcagcaggaatggtaattgttggtaaaacaagcttgactgaatatggaacttcaccagttgggtataatgcaagacatgatggtacttttaatccatggaaccagtcctatttaacaggaggttcttcttctggatcagctggaagtgttgccgcaaatattgttcctttagcaattgggtttgatggaggaggatcaattagaattccaagttcaggatgtggaatctttggactcgcatcaactttcggaagagtcccattcgatgcaaaatccgtaccaagatcctcaacagtaagaacaggtccaatgacaggaacagcaagagatgctgcattatctcatatgctcctaagtgaacctctcaaagatcatttttattccacattgacaaatccacctcttcctcatcttgataaagttgagttgaaaggattaaaaattggaattttttgggatcattttaaggattctgcgactgttgttcatgagacttgttttaaagcagttaaattgcttcaagacaaaggtgctggtttagttaatattaccattcctcatatatctgttctgagtttagctcatggaatgacaattgcaactgaatttgctcttggacaagatgcaagatggtttacaaaacacgaatatgagcctcaaacattaataacaataggaataggaagatcaataacttcaacagaattctcagcagcagcagtacttaaaggatgggcaacaaaatacttcaacgacctattcaaccaagtagacataatcgtctccccaacaatcccttcaaccgaattattaaaattcgaagaatcaatgagaggttatggagaatctgatacggttaagaatatggaaattatgaagtttatttttttttcaaatttgttggggtttccagcgattacagttccagtggggaatgatttgaataatcagattccaattggtttgcagattataacaaagcattggtttgaacatagacttctcgatcttgcatctattcttgatgaatctatacccaagaatctaccaccaaatgcattttcaccattagggcattagatcaataaacaagtcgaccacgg

SEQ ID NO: 36517 - protein, 614 aa, Panicum virgatum
  misc_feature: Ceres CLONE 1985839
  misc_feature (168)..(590): Pfam Name: Amidase Pfam Description: Amidase
  misc_feature: SWISSPROT Homolog: EC 3.5.1.4 Amidase
MVQLGQVGNYILVMAIAIALVGRFTSMKPLEEDLVLGQGGYDYRSVSAPKLSGLPLYLLGRVAQNPQFGPILLRALLNGNGVNRLRSLASQSREPSVFFPFKVVDPTEREYHSNQSHHTKESLRLLLSPDSLPDQCKKFKPPTGRWKIEDFALAYRCKITTPSKVANRILEAINLQTGYLRHLKFFTQIVESEVLSAAQESDKRFESEKPLGVFDGVPVAIKDEIDVLGYISGSGTDFSNFPVATKDDLITSRLKAAGMVIVGKTSLTEYGTSPVGYNARHDGTFNPWNQSYLTGGSSSGSAGSVAANIVPLAIGFDGGGSIRIPSSGCGIFGLASTFGRVPFDAKSVPRSSTVRTGPMTGTARDAALSHMLLSEPLKDHFYSTLTNPPLPHLDKVELKGLKIGIFWDHFKDSATVVHETCFKAVKLLQDKGAGLVNITIPHISVLSLAHGMTIATEFALGQDARWFTKHEYEPQTLITIGIGRSITSTEFSAAAVLKGWATKYFNDLFNQVDIIVSPTIPSTELLKFEESMRGYGESDTVKNMEIMKFIFFSNLLGFPAITVPVGNDLNNQIPIGLQIITKHWFEHRLLDLASILDESIPKNLPPNAFSPLGH

SEQ ID NO: 36518 - DNA, 704 bp, Panicum virgatum
  misc_feature: Ceres CLONE 1985849
  misc_feature: Encodes the peptide sequence at SEQ ID NO. 36519
aggaagaaaaaggaacaacatccagaccatcacacacaatggcaatgagtttgaggacggggcggcgcgccctgagcggggccctacgtcccatgatcgcaacagcaccctcatgttttgcaccacgccggacatacgccaccgccgagcccgacctcaagacgaccctcaaggaggtgatccccgccaaacgcgagctgctcaagaaggtcaaggcccatggcgccaaggtcatcggcgaggtcaaggccgagaacaccatcggcggcatgcgcgggctcaaggccatggtctgggagggctccgtgctcgacgccaaccagggcatccgcttccacggccgcaccatcaaggactgccagaaggagctgcccaagggcaagaccggcaccgagatgctgcccgaggccatgttctggctgctgctgacgggcaaagtgccctcggtcaaccagacccgccagttctcgcgcgagctcgccgagcacgcccagctgccggccttcgtcaacaagatgctggacgacttcccgcgcgacctgcaccccatgacccagttcgccatggccgtgtccgccctcaactacacctcccagttcgccaaggcctacgagcagggcctcaacaaggccgactactgggagcccacctttgacaactgcatcttctctgctcgccaagctgcccaccatcgccgccaagat

SEQ ID NO: 36519 - protein, 221 aa, Panicum virgatum
  misc_feature: Ceres CLONE 1985849
  misc_feature (77)..(221): Pfam Name: Citrate_synt Pfam Description: Citrate synthase
  misc_feature: SWISSPROT Homolog: EC 2.3.3.5 2-methylcitrate synthase
MAMSLRTGRRALSGALRPMIATAPSCFAPRRTYATAEPDLKTTLKEVIPAKRELLKKVKAHGAKVIGEVKAENTIGGMRGLKAMVWEGSVLDANQGIRFHGRTIKDCQKELPKGKTGTEMLPEAMFWLLLTGKVPSVNQTRQFSRELAEHAQLPAFVNKMLDDFPRDLHPMTQFAMAVSALNYTSQFAKAYEQGLNKADYWEPTFDNCIFSARQAAHHRRQ

SEQ ID NO: 36520 - DNA, 1618 bp, Panicum virgatum
  misc_feature: Ceres CLONE 1985854
  misc_feature: Encodes the peptide sequence at SEQ ID NO. 36521
gcggctgattcgactgcgagcggcctcattccccgcgggccggcatggagggtcagagcgcggcgccgctgctcccgaggatcccgccgccggagaagaggggcggaggacggcgcctggcggaggaggtgtgggaggagtccaagaagctgggggaggtcgtcggcccggcggtgttcataaacctggtgttctcctccatgaacatcgtcagccagtccttcgccggccacctcggcgacctcgacctcgccgccttcgccatggccaacaccgtggtcgacggcttcaacttcgccatgctgctcggcatggcgagcgccctggagacgctctgcggccaggcctacggggcgaagcagcaccacatgctgggcatctacatgcagcgctcgtggctcatcctcctctccttcgccgtcctcctctccccgatgtacgtcttcagcgggcagctgctcgccgcgctgggccagtccgccgagctgtcgcgcgaggcgggctccgtcagcctgcgcttcctgccgtcgcacttcatgtacgccgtcctcctgccggtcgttacgttcctgcagtgccagcgcaagaactgggtcaccgcggccgcggcggcggcggtgttcgccgtgcacgtcgccaccacgtggctgctggtgagctgcctcgggctcgggatcttcggcgtggccatggcgttcaacctgtcctgggtggccttcgcggcgctgctgctcacctacgcgctcggcggcgggtgtccggagacgtggaccgggttctcgacgtcggcgttcgtgggcttgaaggagttcgtcgccttgtccgcgtcctcgggtgtcatggtgtgcttggagaattggtactaccggatattggttttcctcacgggtttcatgaagaacgccgagctatctgtggatgcattgtctatctgtatgagtttgactagctgggagatgatgatccatatgggatttttagcaggcactggggtgagggtagctaatgagcttggcgcggccaatggacaaggtgcaaagtttgccacgatcgtgtccacgactacgtcctttctgatcagcctcttcgttagtttgctcgccctgattttccacgacaaactcgcgataatcttctcgtcaagccaggccgtgatcgacgcggttgatcacatctccgttctgctcgcgctcaccattctcctcaacgggatccaacctgtgctctccggagtagctattggatcaggctggcaaggagtggttgcttatgttaacatcggaagttactacttgatcggtgttcctcttggtgttctgctaggatggggtttcaactacggggttcctggaatatgggctggaatgatcggcggcacaatgatgcagactctaatcctggcatttatcacccttcgatgtgattggaatgaagaggcgctgaaagctggtaacagagtgcggcaatggagtagcaccaagtgagctaggagcctatcggcagcaattagttgtagtttatatcttcgtctctcttatcacatgttttcggcagctttttttatattcgtagatatgtatctaaatatatttatacatctagttgatactaaaaatct

SEQ ID NO: 36521 - protein, 479 aa, Panicum virgatum
  misc_feature: Ceres CLONE 1985854
  misc_feature (262)..(425): Pfam Name: MatE Pfam Description: MatE
  misc_feature (42)..(202): Pfam Name: MatE Pfam Description: MatE
MEGQSAAPLLPRIPPPEKRGGGRRLAEEVWEESKKLGEVVGPAVFINLVFSSMNIVSQSFAGHLGDLDLAAFAMANTVVDGFNFAMLLGMASALETLCGQAYGAKQHHMLGIYMQRSWLILLSFAVLLSPMYVFSGQLLAALGQSAELSREAGSVSLRFLPSHFMYAVLLPVVTFLQCQRKNWVTAAAAAAVFAVHVATTWLLVSCLGLGIFGVAMAFNLSWVAFAALLLTYALGGGCPETWTGFSTSAFVGLKEFVALSASSGVMVCLENWYYRILVFLTGFMKNAELSVDALSICMSLTSWEMMIHMGFLAGTGVRVANELGAANGQGAKFATIVSTTTSFLISLFVSLLALIFHDKLAIIFSSSQAVIDAVDHISVLLALTILLNGIQPVLSGVAIGSGWQGVVAYVNIGSYYLIGVPLGVLLGWGFNYGVPGIWAGMIGGTMMQTLILAFITLRCDWNEEALKAGNRVRQWSSTK

SEQ ID NO: 36522 - DNA, 718 bp, Panicum virgatum
  misc_feature: Ceres CLONE 1985856
  misc_feature: Encodes the peptide sequence at SEQ ID NO. 36523
ggcgatagtaggatttggaggtttagggaagaccacactagccaatgaggtgtaccgcgaagttggagggaagtttgacagcaaggcatttgtgtccgtttctcaaaagccagagatgatagggctattcaacagcttgctatcgcaacttggcctagacccatatcctcatgcttgccagctgcaagatccaatcaacaaactcatagagcatctacagaataagaggtacttcattgttgtcgatgatttatgggatacaagagcgtggcataccattcaatgtgctttcccaccaaataatcagtgtagtagagtaataataactacacgaaatgagaatctagccggatcatgttgcggcaatgaccatggatgcattcataatatgaagcctctaagtgagcaagactcaaagaagctcttctttggtagaatatttggatctgaagatgcttgtccttctgagctcaggaatgcttcatctgaaattttgaagaagtgtaatggtctaccccttgcaattattacaatggctagtatgttatcttgccaaccaaaaatattggaaggacagtgggagtatatccataattcactagccactaagtttgcaacaaactccaactatgaagacatgatgtacatcttagacctcagctacaagaatctcccccgtcatctgaaggcttgctttttgtatctcggctcttacccc

SEQ ID NO: 36523 - protein, 238 aa, Panicum virgatum
  misc_feature: Ceres CLONE 1985856
  misc_feature (1)..(237): Pfam Name: NB-ARC Pfam Description: NB-ARC domain
AIVGFGGLGKTTLANEVYREVGGKFDSKAFVSVSQKPEMIGLFNSLLSQLGLDPYPHACQLQDPINKLIEHLQNKRYFIVVDDLWDTRAWHTIQCAFPPNNQCSRVIITTRNENLAGSCCGNDHGCIHNMKPLSEQDSKKLFFGRIFGSEDACPSELRNASSEILKKCNGLPLAIITMASMLSCQPKILEGQWEYIHNSLATKFATNSNYEDMMYILDLSYKNLPRHLKACFLYLGSY

SEQ ID NO: 36524 - DNA, 1464 bp, Panicum virgatum
  misc_feature: Ceres CLONE 1985861
  misc_feature: Encodes the peptide sequence at SEQ ID NO. 36525
atcctcccgtacaaatagcacacgaacacttcgacctccccaaccatctccgccgcgcccatcccccggcgccgcctcctcccctcgaagccgcactccctccaacccgccgccgtaccccactcccgcacccgccgcgggcggggggacactctgcgccgtccagcgggaatttgattcagtcggattccgctgtgaccgcgatggcggggaaggcgatggagcggcaccagtcgatcgacgcgcagctgcggctgctggcgccaggcaaggtgtccgaggacgacaagctcgtcgagtacgacgccctcctcgtcgaccgcttcctcgacatcctccaggacctgcacggcccgcacctccgcgaattcgtccaggagtgctacgagctctcggcggagtacgagaacgaccgcgacgaggcgcggctcggcgagctcgggagaaagctcaccagcctgcccccgggggactccatcgtcgtcgccagctccttctcgcacatgctcaacctcgccaacctcgccgaggaggtgcagatcgcgcaccgccgccggatcaagctcaagcgtggggacttcgccgacgaggcctcggcgcccaccgaatccgacatcgaggagacgctcaagcgccttgtctcgcagctcggcaagtcgcgcgaggaggtcttcgacgcgctcaagaaccagaccgtcgacctcgtcttcacggcgcaccccacgcagtccgtcaggaggtccctgctccagaagcacggcaggatccggaattgcctgagacagctgtatgccaaggacatcactgctgatgacaagcaggagcttgatgaggctcttcagagggagattcaagctgctttcagaactgatgaaatccgcaggacccctcccactcctcaagatgaaatgcgtgctggaatgagttacttccatgaaactatatggaagggcgtacccaaattcttgcgccgtattgacactgctttgaaaaatattgggatcaatgagcgtctcccttacaacgctcccctcattcagttctcatcctggatgggtggtgaccgtgatggaaatccaagagttacaccagaggttacacgggatgtatgcttgttggcgagaatgatggctgctaacttgtacttctctcagatagaagatctaatgtttgagctctctatgtggcgctgcagtgatgaacttcggatccgtgcagatgaattacatcgctcgtcaaaaagagctgcgaagcattatatagaattctggaagcaagttcctccaaacgaaccatatcgtgtcatacttggtgaggtcagggataaattgtactatacacgtgagcgttctcgtcatctattgacaacaggaatttctgagattccagaggacgcaacttttactaatgttgaacagtttctggaacctcttgagctctgttatagatcattatgtgcttgtg

SEQ ID NO: 36525 - protein, 420 aa, Panicum virgatum
  misc_feature: Ceres CLONE 1985861
  misc_feature (11)..(420): Pfam Name: PEPcase Pfam Description: Phosphoenolpyruvate carboxylase
  misc_feature: SWISSPROT Homolog: EC 4.1.1.31 Phosphoenolpyruvate carboxylase
MAGKAMERHQSIDAQLRLLAPGKVSEDDKLVEYDALLVDRFLDILQDLHGPHLREFVQECYELSAEYENDRDEARLGELGRKLTSLPPGDSIVVASSFSHMLNLANLAEEVQIAHRRRIKLKRGDFADEASAPTESDIEETLKRLVSQLGKSREEVFDALKNQTVDLVFTAHPTQSVRRSLLQKHGRIRNCLRQLYAKDITADDKQELDEALQREIQAAFRTDEIRRTPPTPQDEMRAGMSYFHETIWKGVPKFLRRIDTALKNIGINERLPYNAPLIQFSSWMGGDRDGNPRVTPEVTRDVCLLARMMAANLYFSQIEDLMFELSMWRCSDELRIRADELHRSSKRAAKHYIEFWKQVPPNEPYRVILGEVRDKLYYTRERSRHLLTTGISEIPEDATFTNVEQFLEPLELCYRSLCAC

SEQ ID NO: 36526 - DNA, 651 bp, Panicum virgatum
  misc_feature: Ceres CLONE 1985861-R
  misc_feature: Encodes the peptide sequence at SEQ ID NO. 36527
tgagatgttttcgccaagggagacccaggaatcgcagctgtttatgacaaactgctagtggctgaagatctgcaatcctttggagagcagctgaggaagaactatgaagagacaaaatggctactccttcaggttgccggtcacaaggatgtcctcgaaggcgatccttacctgaagcaacgtctgcggctgcgtgagtcgtacatcaccaccctgaacgtctgccaggcctacaccctgaagcggattcgtgacccggccttccaggtgagcccccagcctgccctgtccaaggagttcgtcgacgagagccagccggcgcagctggtgcagctgaaccccgagagcgagtacgcgccgggcctggaggacacgctgatcctgaccatgaagggcatcgccgctgggatgcagaacactggctaggccagatactcggtgtacaaataacccatctcatatgagatggtggacaatatgtgtaatgcctgcaggcaggtagtcaaccggcgctagtgcgttactcttctgaggaacttttatgtcagagcctttcggttttgcttgatgtaaatgtcaaggtgagcttattggctgttgaagcttgattgcgtaataaattatggaacaatgatttgcgttaatccgtcc

SEQ ID NO: 36527 - protein, 140 aa, Panicum virgatum
  misc_feature: Ceres CLONE 1985861-R
  misc_feature: SWISSPROT Homolog: EC 4.1.1.31 Phosphoenolpyruvate carboxylase
DVFAKGDPGIAAVYDKLLVAEDLQSFGEQLRKNYEETKWLLLQVAGHKDVLEGDPYLKQRLRLRESYITTLNVCQAYTLKRIRDPAFQVSPQPALSKEFVDESQPAQLVQLNPESEYAPGLEDTLILTMKGIAAGMQNTG

SEQ ID NO: 36528 - DNA, 1464 bp, Panicum virgatum
  misc_feature: Ceres CLONE 1985866
  misc_feature: Encodes the peptide sequence at SEQ ID NO. 36529
acaccgaaatttgaaatccccaccccgagccaggcacgccgcccgttgtcctcaccgccgccgcatccatggagaagatctccgtcgccgtccgcttccgcccccccaaccctgccgccgccgacccctccccgggtggcgccggcggaggcggcgaccgcgagtggcgcatcgacgacacccgcgtcaccctcgtccaccgcaccgccggcccccttcccggcgcacccttcgtcttcgaccacgtgttcgacaggaccgccaccaacgagcgggtctacggcacggtcgtccgggacctcatcggcgccgtcgtcgacggcttcaacgccaccgccttcgcttacgggcagaccagcagcggcaagacgttcaccatgaacggctccgacgccgaccccggcatcatcccgcgcggcgtccgcgacgtcttcgacaccgtgcgtcagacggacgaccgcgagttcctcgtcagggtgtcctacatggagatctacaacgaggagatcaacgacctcttgacgcttgagggccggcggctgccgattaaagagaacctcgagcgtggagtatatgtagctggtttgcgggaggagatcgtgaacagctcagaacaagtgttggagctcctccagctcggagaagtgaacaggcattttggggagacaaacatgaacgcccggagtagtcggtcacacactattttcagaatggtcattgaaagcagtgctaagaatcagatagactctgaagatcctatccgtgtctctgttttgaatttggtggacttagctgggtcagaaagaaacaacaagaccggaactgaaggggtgcgtttgaatgaggcagggcatataaacaagagcttgttgatgcttgggaatgtcatcaataagttaagtgagaatggaaagcaaagagggcacattccctatcgtgatagtaagttgactcgcattctccaacctgcacttggcggcaatgcaaaaacttctatcatctgcactgctgcaccagaagagatgcacattgaggaaactagaggaacccttaaatttgcaagcagagcaaaatgtgtcagcaattgtgcccaagtaaatgagattctaacagatgctgctctgctgaagaggcaaaaacgagaaatagaagaacttcgtaaaaagctgcagggttcccattctgaagggttggagcaggttgtactaaaactacgcaatgatatgcacaagtctgagcttgagcgtgatcgtttggcaatggaacttgaagaggaaaggaagttacggatgaccctagagcaccatttgactgagcaacagaagaagctagagggcctcgataacaccagcatatcagcggaccagtttactgattcggcccagctcgatgcactgaaaactccagatttcaagtatacacctgatggatttgttgcacatcgctcacgctattcaaatgatg

SEQ ID NO: 36529 - protein, 465 aa, Panicum virgatum
  misc_feature: Ceres CLONE 1985866
  misc_feature (9)..(338): Pfam Name: Kinesin Pfam Description: Kinesin motor domain
MEKISVAVRFRPPNPAAADPSPGGAGGGGDREWRIDDTRVTLVHRTAGPLPGAPFVFDHVFDRTATNERVYGTVVRDLIGAVVDGFNATAFAYGQTSSGKTFTMNGSDADPGIIPRGVRDVFDTVRQTDDREFLVRVSYMEIYNEEINDLLTLEGRRLPIKENLERGVYVAGLREEIVNSSEQVLELLQLGEVNRHFGETNMNARSSRSHTIFRMVIESSAKNQIDSEDPIRVSVLNLVDLAGSERNNKTGTEGVRLNEAGHINKSLLMLGNVINKLSENGKQRGHIPYRDSKLTRILQPALGGNAKTSIICTAAPEEMHIEETRGTLKFASRAKCVSNCAQVNEILTDAALLKRQKREIEELRKKLQGSHSEGLEQVVLKLRNDMHKSELERDRLAMELEEERKLRMTLEHHLTEQQKKLEGLDNTSISADQFTDSAQLDALKTPDFKYTPDGFVAHRSRYSND

SEQ ID NO: 36530 - DNA, 627 bp, Panicum virgatum
  misc_feature: Ceres CLONE 1985866-R
  misc_feature: Encodes the peptide sequence at SEQ ID NO. 36531
gtgccaaaggttagaaaaggactgtgtctctgaccgacaacagctggaggaatcaaatgcgagatgcgcagccctcgagaaggagtgcgacctgctgcgggacaagaactcgtccctgcagcaggagctctctgattccaagcgggaggccaaccttctcgtcgcagagaagcaggcgcagctagatgactcgatagccaggtgcgtggcgctcgagagggagctctccgtgtgtcggcaggacgccgagcgcctcgccaccgagaagcaggagttggccggggagctgggcgtggagaggcagaagatggaggagctgaagcaggacatccgggtgatcagccgggcattctcgcagcgggaagggcagctcacgtcgctgtacagcaagtccaaggccatcctggagagctgcaagacctcgcacgccgctaccccctgccttgatggctgagcgagacgcgtgcaagctgctgggtaaggaatgtctctgcacccgtgtgttggctataggtgtgttggatttgtgttgtgtgaaaagtttggtggaatactggtaacaagtgtgtgcaagcggggtatgtaagttgtgtgtcaacttgatgggaacatcacctgcgttttgcc

SEQ ID NO: 36531 - protein, 150 aa, Panicum virgatum
  misc_feature: Ceres CLONE 1985866-R
  misc_feature: SWISSPROT Homolog: EC 2.7.11.1 Non-specific serine/threonine protein kinase
CQRLEKDCVSDRQQLEESNARCAALEKECDLLRDKNSSLQQELSDSKREANLLVAEKQAQLDDSIARCVALERELSVCRQDAERLATEKQELAGELGVERQKMEELKQDIRVISRAFSQREGQLTSLYSKSKAILESCKTSHAATPCLDG

SEQ ID NO: 36532 - DNA, 791 bp, Panicum virgatum
  misc_feature: Ceres CLONE 1985867
  misc_feature: Encodes the peptide sequence at SEQ ID NO. 36533
acaggagaagaggaaagacaagaggagcttcctcccttccacccccctaccactcctcgtcgaaaccctagccccgcctcgccgccggcggtggtggccgcccttccaacgcccagccctggttgttcgctgcacatactctcccccccaccgcgcgctccctcccggagccgtcgcgaccgccgccggatccggatcggccggccgccatgtccaaggccagggtctacaccgacgtcaacgtgctgcgccccaaggagtactgggactacgaggcgctcaccgtccaatggggtgagcaggatgactatgaagttgtcaggaaagttggtagaggaaagtacagcgaagtctttgagggcatcaatgttaacaacaatgagaaatgcatcatcaagatcctgaagcctgtgaagaaaaagaagatcaaaagagaaattaaaatccttcagaatctttgtggaggccctaatattgtgaagctgcttgatattgttagggatcagcactcaaaaacacccagcctgatctttgaatatgtcaacaacacagatttcaaagtgctgtacccaacattgacagattatgacattcgctattacatctacgagttactcaaggcattagattactgccattcacaaggtattatgcaccgagatgtgaagcctcacaatgttatgatagatcatgagcttcgtaaactccggctgatagattggggccttgctgaattctatcatccctggcaggaatataatgtccgtgttgcctcaaggtactttcagggg

SEQ ID NO: 36533 - protein, 193 aa, Panicum virgatum
  misc_feature: Ceres CLONE 1985867
  misc_feature (34)..(192): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 1 in US patent 7038110
  misc_feature: Functional homolog of the protein sequence given in SEQ ID NO 50314
  misc_feature: Useful for making plants with modulated flowering time
MSKARVYTDVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPWQEYNVRVASRYFQ

SEQ ID NO: 36534 - DNA, 1821 bp, Panicum virgatum
  misc_feature: Ceres CLONE 1985868
  misc_feature: Encodes the peptide sequence at SEQ ID NO. 36535
accgtctcgtctcgctgctgcgtgcctgcggggacactccatctcctccgcgatccccacccctctctccggcggagaacgagccgcaggcagcagcagggcgcgggccacagctcgtccgttcgattcgttggagatcgctcaagcgggagcggcgtcctcagcgaggaggcaggcgccatgaagcccccggccgccgccagcggcggcaagggaggcgcggtcgacccgtcgctgccgcggttcaggtgccaggagtgccgccgcgccctcgtcgtcgtcggggtcgactcgtacgccgacaggctgccgccccacgccgcggccggtaaccatgcaccttctgttcagggcagtgtcatgggtgcaagcaggatggacaattcttatgtagtgctatccaggcagaacagatctcaaggtcctggaattcccccgcgcccatcaactgccgcagcaccacacactgaacctaaccaatcaacaagagtgatagaggggtcctatatagtgcttccacctcctgctgcttccatatacaagacacctgcctctgaaggaggcggtgcacagctgacaacaccgggtgtaaactccagtaaccattcaccaggaaacaactctggatttcactctagtgttactgtgctgaaaagagcttttgagattgctagctcacaaactcaggttgagcagccactttgtctggaatgtatgaggattctttctgataagatggataaggagattgaagatgttaatgcggatattaaagcttacgaggcttgtcttcaacgtttggagcaggaaccctacgacatactcagtgaaacagactttcagaaggagaaacaaaagatcgaggaagaagaaaagaaacttaaagctgctattgaagaagctgaaaagctatattcagaagttagttccgagatgaaagatcttgaaataaagtctaaacaatttgaggaattggaagaacggtattggcatgaattcaacagctttcagtttcagttgacatctcaccaggaagaaagagacgcagtttttgctaagatagaagtttctcaggttcatctggaactgttgaagcgtactaatgttctcaatgatgcatttcatatttcacatgatggtgtaattggaacaataaacaacttccgcctcggacgtctttcaaatggagaggttgagtgggatgagataaatgctgcttggggtcaagctgcactgttgctgcataccatggctcaatatttcactccgaaatttcaataccggatcaagattcaccctatgggaagctatccaagagtcaccgacatccacaacaatacatatgaactgtttggccctgtaaatttgttctggagcacccgatttgacaaagccatgacatggtttctcacttgcctgcaagagtttgctgagtttgccataaatttggataaagagaacaatgttccaccagagaagtcattgaagcttccctataagattgatggtgacaaagtagggagccatacaatcgtcctaagtttcaataaggacgagaactggaccaaggcgctgaagtacatgctgtgcaatctgaaatgggttctctactggttcattggcaacacaagttttgctccaccatcgggaccagtgcacacacaatctctgaggaacaagaactaatgctgtttttacttcaactgtgcatagtttaaatacaaaccgatttactgacactagtcattggactctagccgtagtgacaataacgacatatttgatgtacatacatgtatcaatattaccgtctattacttg

SEQ ID NO: 36535 - protein, 501 aa, Panicum virgatum
  misc_feature: Ceres CLONE 1985868
  misc_feature (153)..(482): Pfam Name: APG6 Pfam Description: Autophagy protein Apg6
MKPPAAASGGKGGAVDPSLPRFRCQECRRALVVVGVDSYADRLPPHAAAGNHAPSVQGSVMGASRMDNSYVVLSRQNRSQGPGIPPRPSTAAAPHTEPNQSTRVIEGSYIVLPPPAASIYKTPASEGGGAQLTTPGVNSSNHSPGNNSGFHSSVTVLKRAFEIASSQTQVEQPLCLECMRILSDKMDKEIEDVNADIKAYEACLQRLEQEPYDILSETDFQKEKQKIEEEEKKLKAAIEEAEKLYSEVSSEMKDLEIKSKQFEELEERYWHEFNSFQFQLTSHQEERDAVFAKIEVSQVHLELLKRTNVLNDAFHISHDGVIGTINNFRLGRLSNGEVEWDEINAAWGQAALLLHTMAQYFTPKFQYRIKIHPMGSYPRVTDIHNNTYELFGPVNLFWSTRFDKAMTWFLTCLQEFAEFAINLDKENNVPPEKSLKLPYKIDGDKVGSHTIVLSFNKDENWTKALKYMLCNLKWVLYWFIGNTSFAPPSGPVHTQSLRNKN

SEQ ID NO: 36536 - DNA, 748 bp, Panicum virgatum
  misc_feature: Ceres CLONE 1985882
  misc_feature: Encodes the peptide sequence at SEQ ID NO. 36537
atcttcatcttctagctagctgcagcctctgctcctcctgcagatgcggtgtcagtgaattagctaggcaagccagacagtgcctctgacatggcgcagcactagaagcagcagaggcccctgcagccagaataggtgctagaagcagctgactgatttcagctaccaaaagcgcttctaggaaagtactagaacattctttctaatggaagcaagagcgccagtgctggtcctagcactagcagtgacagtactgcccttgatcttggccaccggcgttggcgcggccggcggcgacgagcgggcggcgctgctcgcgctcaaggcgggcttcgttgactcgttgggcgcgctcgccgactggaaggatggcggcagggcctcgtcgtcgcattgcagctggaccggcgtcgggtgcaacgccgccggcctcgtcgaccgcctcgacctctcggggaagaacctgagcggcaaggtcaccgacgacgtgctccggctgccgtcgctcaccgtcctcaacctctcctccaacgcgttcgccgtcgcgctgcccaagtctctcgccgcgctgtccaacctccaggtgttggacgtgagccagaattccttcgagggcgcgttccccgccggcctcggctcctgcgccgacctcgtcaccgtcaacgcatccggcaacaacttcgtcggcgccctccccgccgacctcgccaatgccacctccctcgagaccatcgacctgaggggcagc

SEQ ID NO: 36537 - protein, 180 aa, Panicum virgatum
  misc_feature: Ceres CLONE 1985882
  misc_feature (29)..(72): Pfam Name: LRRNT_2 Pfam Description: Leucine rich repeat N-terminal domain
  misc_feature: SWISSPROT Homolog: EC 2.7.11.1 Non-specific serine/threonine protein kinase
MEARAPVLVLALAVTVLPLILATGVGAAGGDERAALLALKAGFVDSLGALADWKDGGRASSSHCSWTGVGCNAAGLVDRLDLSGKNLSGKVTDDVLRLPSLTVLNLSSNAFAVALPKSLAALSNLQVLDVSQNSFEGAFPAGLGSCADLVTVNASGNNFVGALPADLANATSLETIDLRG

SEQ ID NO: 36538 - DNA, 711 bp, Panicum virgatum
  misc_feature: Ceres CLONE 1985889
  misc_feature: Encodes the peptide sequence at SEQ ID NO. 36539
aacaggcactggccgagcatgtacaggtccagtctcgccttcaacttccagcagccgcagcctgacctgaacaacggcggcggcggcggcaagtcctccttgatgtcctctagatgcgaggagagtggaaggaacccggagccgaggccgcggtggaacccgcggccggagcagatcaggatcctggaggggatcttcaactccggcatggtgaacccgccgcgcgacgagatccgccgcatccgcctccagctgcaggagtacgggcccgtcggcgacgccaacgtcttctactggttccagaaccgcaagtcccgcaacaagcacaagctccgcgccgcggggcagctgctgccgtccggccgcgccaccctggcgcgcgcgtgcgcgccgccgcctgcgccacccgtgacgccgccgcggcacctgttcgcttcttccgtggcgcccacctcctcgtcgtcgtcgtcatccgaccggtcctccgggtcgagcaagtcggtgaggccgaccaccgtcgctcttccgtctcccgctgcgccggcggccgtccagcatggcgtgctgccggcgacggccatggacctgctttcgtcgacgccgacgctggagccggctctagcggcacgccaactctactatcacagccagctcatggctcctgccatgcccccgatgcccgagctgatcgcctcccccgagcctctcctc

SEQ ID NO: 36539 - protein, 236 aa, Panicum virgatum
  misc_feature: Ceres CLONE 1985889
  misc_feature (48)..(109): Pfam Name: Homeobox Pfam Description: Homeobox domain
  misc_feature: The sequence is a functional homolog of SEQ ID NO 2664 in the 10/374,780 US patent application
  misc_feature: The sequence is a functional homolog of SEQ ID NO 330 in the 10/225,066 US patent application
NRHWPSMYRSSLAFNFQQPQPDLNNGGGGGKSSLMSSRCEESGRNPEPRPRWNPRPEQIRILEGIFNSGMVNPPRDEIRRIRLQLQEYGPVGDANVFYWFQNRKSRNKHKLRAAGQLLPSGRATLARACAPPPAPPVTPPRHLFASSVAPTSSSSSSSDRSSGSSKSVRPTTVALPSPAAPAAVQHGVLPATAMDLLSSTPTLEPALAARQLYYHSQLMAPAMPPMPELIASPEPL

SEQ ID NO: 36540 - DNA, 759 bp, Panicum virgatum
  misc_feature: Ceres CLONE 1985893
  misc_feature: Encodes the peptide sequence at SEQ ID NO. 36541
aacttgaacccacaaaccgaaacaaaccctcgaaagctcggaagatcccgcggcgctgcaccctcctctcctctcctctcctctccactacccactcgtcgccgccgtcgcgagaccgccatggcgctgcacgcccccgtcctcgtgatgaaggactcgatgaagcgggagtcgggcgccaaggtgcaccgggccaatatccaggctgccaaggctgtggcagacatcatacgcactacactgggtcccagatccatgttgaagatgcttcttgtgaagagctccatcggtacaaaattcactggtcagtttggtgaccttattgctgaccttgctatcgatgctactacaacagcaggtgttgacctaggtcagggtatgcgggaagttgatatcaagaagtatattaaagtagaaaaggttcctggtggccagttagaggattctacggtcctcaaaggagttatgatcaataaggatgttgtggctcctggcaaaatgagaaggaagatagttaacccacgtataatcctgctggacagccctattgagtataagaagggagaaaatcagaccaatgctgagttgatgaaggaagaagattggcaggttctgctagagatggaggaagagtacataaagaacctatgtgcacaaattctaaaatttaagcctgatttggtcatcacagagaaaaggcttagtgatcttgctatccattatttgagcaaggctggtgttagtgcaattcgtagactt

SEQ ID NO: 36541 - protein, 212 aa, Panicum virgatum
  misc_feature: Ceres CLONE 1985893
  misc_feature: SWISSPROT Homolog: EC 2.7.1.68 1-phosphatidylinositol-4-phosphate 5-kinase
MALHAPVLVMKDSMKRESGAKVHRANIQAAKAVADIIRTTLGPRSMLKMLLVKSSIGTKFTGQFGDLIADLAIDATTTAGVDLGQGMREVDIKKYIKVEKVPGGQLEDSTVLKGVMINKDVVAPGKMRRKIVNPRIILLDSPIEYKKGENQTNAELMKEEDWQVLLEMEEEYIKNLCAQILKFKPDLVITEKRLSDLAIHYLSKAGVSAIRR

SEQ ID NO: 36542 - DNA, 759 bp, Panicum virgatum
  misc_feature: Ceres CLONE 1985902
  misc_feature: Encodes the peptide sequence at SEQ ID NO. 36543
gagagcgaaaatccccaatcccctccactccgatccactcgagccctagccccgaatcccccggagcgtcagactgaatccattcgattaccgcatggcaggctccgtctgcatctgctgattcccgggatcgtctccatcgacgcgcttgccgcagccatggagccgcgcatcggcaacaggttccgcgtcggccgcaagctggggagcggctctttcggggagatcttcctcggtaccaacgtgcagaccaacgaggaggtcgcaataaaactggaaaatgtcaagacaaaacatcctcaattgctttacgagtcaaaattatacagaatacttcaaggaggaattggaattccaaatgttaagtggtttggtgttgagggtgattacaatgttttggttatggatttactgggaccaagcctcgaagatcttttcagtttttgtaacaggaagctgtccctcaaaactgttttgatgcttgctgatcaaatgatcaaccgagttgagtttgtccattccaagtcattcttacatagagatatcaagccagacaattttctcatgggcctcggaaaaagggcaaaccaggtttacgttatagattttggacttgcaaagaagtacagagatacatcaacacaccagcacatcccatacagagagaaacagaactttactggaaacagcagatatgcaagtgtgaatacccaccttgggaattgaacaaagccggagagatgacatgggatctcttgg

SEQ ID NO: 36543 - protein, 188 aa, Panicum virgatum
  misc_feature: Ceres CLONE 1985902
  misc_feature (9)..(186): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 32 in US patent 7179962
MEPRIGNRFRVGRKLGSGSFGEIFLGTNVQTNEEVAIKLENVKTKHPQLLYESKLYRILQGGIGIPNVKWFGVEGDYNVLVMDLLGPSLEDLFSFCNRKLSLKTVLMLADQMINRVEFVHSKSFLHRDIKPDNFLMGLGKRANQVYVIDFGLAKKYRDTSTHQHIPYREKQNFTGNSRYASVNTHLGN

SEQ ID NO: 36544 - DNA, 1806 bp, Panicum virgatum
  misc_feature: Ceres CLONE 1985903
  misc_feature: Encodes the peptide sequence at SEQ ID NO. 36545
gttctcaattcctctcgaaggtctagtctcggtcagctcgcaggccaatggtgaaagacagggagcccacatcctgattacaagagcctactcaggaatcaggcaccatgaagttgccaaccatctacaatgtccagctcgtggccatcatcgcgaccctcggtggcgcgttgttcggcttcgacatttcttccatgtctgccatcgtcgtgacagatcaatatatcgagttcttcgacaacccatccggcgtcattcaaggcgccatcggctccgctctcgcggccggttctgttgtcggctctgccgttgccggtccgctgtctgacaagatcggccgtcgcgactctatcctgttcgcttgcctcttttggctcattggcactgcggttcaggtggcctgccagaactatggtcagctcattgccggccgtgtcctgaacggtttcaccgtcggcatcacctccgcccaggttcccgtctaccttgccgaaatcgccaaggccgaaaagcgtggttcgctcgtcatcatccagcaactggccgtcgagttcggcattttgatcatgtacttcatcggctacggctgcgcgtccatcgagggcacggcttcgttccgcaccgcctggggaactcagttcatcccgtgcttcttcctcatgatcggcctgcctttccttccccggtcccccagatggcttgccaaggtcgggcgcgacaaggaggcaatcgagacgctggccaacatccaggccaacggcaacatcgaggacccacttgtcattgccgaatgggaggaaatccagactgtcatgcttgccgagagggaggccggtaaaggctggaggaagttctttaagaacggcatgtggaagcgaaccctggccggcacctcggttcaggcgtggcagcaacttgccggcgccaacgtcatcgtctactacctaacctacattgcccagatggccggcctaaccggcgacgtcgccatggttacctcgggtattcaatacgccgtgttcatcatcttcaccggtatcatgtggatcttcatcgacaagacaggccgccgcaccctgctcgtctggggcgccatcggcatgggcttctgccacctggtggttggcggcaccatgggcgcgcacagcacctaccacccggagggcgtcggcaacccgcccaacgccaacatcgtcatcgccgtgacccccggcgcgcccgccaacaccgtcatcaccttctcctacctcctgatcgtggtctacgccctgaccctggcccccgtctgctggatctacgccgccgaggtgtggtcgctgggcacgcgcgccacgggcatgtccatggcggccctgagcaactgggtcttcaactttgccctcggcatgttcaccccgccggccttcatcaacatcacctggaaggtcttcatcatctttggcgtgctgtgcatcgtcgccgccatctggttctggctgctgtgccccgagacctgcggcaagaccctcgaggaggtcgagctcatgttctccaaggacgccccctacccctggaagaccaagaagggcgagtcgcgcctggctgccgagatcgaggccgtcgccgcccgccagcagaagggtgagggcgagggtgaggtggttagtaataagcccgtggttggcgaggaggagaaggtctgagacgtggggcgcttgtgtttcgggagtgaggggtttaggctggtgtggtatttggtctggggagtgtgaactgaagtacctttcagggtcgtcagatcaggctagttaaatttatagtcctctc

SEQ ID NO: 36545 - protein, 524 aa, Panicum virgatum
  misc_feature: Ceres CLONE 1985903
  misc_feature (12)..(474): Pfam Name: Sugar_tr Pfam Description: Sugar (and other) transporter
MKLPTIYNVQLVAIIATLGGALFGFDISSMSAIVVTDQYIEFFDNPSGVIQGAIGSALAAGSVVGSAVAGPLSDKIGRRDSILFACLFWLIGTAVQVACQNYGQLIAGRVLNGFTVGITSAQVPVYLAEIAKAEKRGSLVIIQQLAVEFGILIMYFIGYGCASIEGTASFRTAWGTQFIPCFFLMIGLPFLPRSPRWLAKVGRDKEAIETLANIQANGNIEDPLVIAEWEEIQTVMLAEREAGKGWRKFFKNGMWKRTLAGTSVQAWQQLAGANVIVYYLTYIAQMAGLTGDVAMVTSGIQYAVFIIFTGIMWIFIDKTGRRTLLVWGAIGMGFCHLVVGGTMGAHSTYHPEGVGNPPNANIVIAVTPGAPANTVITFSYLLIVVYALTLAPVCWIYAAEVWSLGTRATGMSMAALSNWVFNFALGMFTPPAFINITWKVFIIFGVLCIVAAIWFWLLCPETCGKTLEEVELMFSKDAPYPWKTKKGESRLAAEIEAVAARQQKGEGEGEVVSNKPVVGEEEKV

SEQ ID NO: 36546 - DNA, 417 bp, Panicum virgatum
  misc_feature: Ceres CLONE 1985906
  misc_feature: Encodes the peptide sequence at SEQ ID NO. 36547
atccatctctattattgaggatcttcacgtcatccgcgcaaaaacaaatggagctcatcgtggcttcagctcgctgctctcctccttcctctcaccttccttctgctgttctctcactccaagaacatgggcaaagccagacaccgcctgccgccggggccagccgtcatgccggtgctcagcaacctgcagtgtctgatgcaccatggggactacatcatgctcgccctgaaccgcctccacgctcgccacgacccgctgctcactctccgcatgggctcccgcctcgaggtcaccctctctaaccgctgcctcacgcacgcattgctcgtaaagagcggccccgcgctgactgaccaccccgggttcgcgtctagggacctcctggggctcaacgccgccaccatctccacctcc

SEQ ID NO: 36547 - protein, 96 aa, Panicum virgatum
  misc_feature: Ceres CLONE 1985906
  misc_feature: SWISSPROT Homolog: EC 1.14.14.1 Unspecific monooxygenase
MGKARHRLPPGPAVMPVLSNLQCLMHHGDYIMLALNRLHARHDPLLTLRMGSRLEVTLSNRCLTHALLVKSGPALTDHPGFASRDLLGLNAATIST

SEQ ID NO: 36548 - DNA, 1618 bp, Panicum virgatum
  misc_feature: Ceres CLONE 1985937
  misc_feature: Encodes the peptide sequence at SEQ ID NO. 36549
tcgccgattttcaccaacaagcaaccacacttctcaaaatgactgacggaaaacaacacgtatcaattgtaatttgcggtcacgtcgacagtggaaaatcgactaccactggtcgtctcatcttcgaattaggaggaatcccagaaagagaaatgcaaaagcttaaagatgaagctgaaagactcggaaaaggatctttcgctttcgctttctatatggatcgtcaaaaggaagaacgtgaacgtggtgtcaccatctcttgtaccaccaaagagttcttcaccaccaccaaacactacactgtcattgatgctcctggacacagaaatttcatcaagaacatgattactggagcttcccaagctgatgttgctcttctcatgatcccagctgatggtaactttaccactgcaattgcaaagggaaaccacaaggctggagaagtccctggacaaaccagacaacatgctctcctcatcaatttactcggtgtcaaacaactcattgttggagttaacaagatggatgctgatatcgctctctacaaacaagaaagatacactgaaatcaaagatgaaatggatcgtatgttgatccgtgtcggatggccaaagaaatttattgaagaatctgttccaaaactcccaatctctggatggagaggagataacttgatcaccaaatcaaccaacatgacatggtggaatggagttgatattaaagttggaaaaaacaccgtccacatccacaccctccttgatgctcttgaatcaatggttaccatcccagaaagaccaaaggatgcagtcatgagaaccccaatctctggaatttacaaaatcaaaggtattggtgatgttttgactggacgtgtcgaacaaggaactgtcagaccaggagatgaatgtatctttttaccaacccacacctcatcaactccatgtattggaaaagtcttcactgttgaaatgcatcacaagactgttgaatctgcaacatgcggagacaactgtggattcaacgttaaaggtttggttaaagaaaacatgcctcgagttggagacgtcatgatcttgaagaaagatgaatccctcagaagatgtaaatcattcactgctcaaatccgtgttttggaacaccctggagaattgaaagttggatactgcccaatcgctttcgtcagaactggaagatctgctgtcaagatgaccaaaatcgcatggaaagtcggaaaagaaactggaaaccaaaaagttgaaaacccaatttccttgaaatcaaatgaaatggcagaatgtgtctttgaacctcaacaacctttcgtcgttgattcattcaaaaactgcgaaggtcttggacgtgttgctatcatggaaggagcttcagttattatgttaggaaaagtcgtttcccttgaattcttgactggagacgaaggaaagaaaggagctgctaccgctgctgctggaaaacctggagctaaacctgctgctggagcaaaacctgccgctggagctaaacctgctgctgctaaaccagctgctaagaaataagtgaacgaaaatttttttatttctcttttttgtccatatttagaaaataaaatacatttccttcc

SEQ ID NO: 36549 - protein, 504 aa, Panicum virgatum
  misc_feature: Ceres CLONE 1985937
  misc_feature (5)..(248): Pfam Name: GTP_EFTU Pfam Description: Elongation factor Tu GTP binding domain
  misc_feature (272)..(345): Pfam Name: GTP_EFTU_D2 Pfam Description: Elongation factor Tu domain 2
  misc_feature (352)..(460): Pfam Name: GTP_EFTU_D3 Pfam Description: Elongation factor Tu C-terminal domain
  misc_feature: SWISSPROT Homolog: EC 2.7.7.4 Sulfate adenylyltransferase
MTDGKQHVSIVICGHVDSGKSTTTGRLIFELGGIPEREMQKLKDEAERLGKGSFAFAFYMDRQKEERERGVTISCTTKEFFTTTKHYTVIDAPGHRNFIKNMITGASQADVALLMIPADGNFTTAIAKGNHKAGEVPGQTRQHALLINLLGVKQLIVGVNKMDADIALYKQERYTEIKDEMDRMLIRVGWPKKFIEESVPKLPISGWRGDNLITKSTNMTWWNGVDIKVGKNTVHIHTLLDALESMVTIPERPKDAVMRTPISGIYKIKGIGDVLTGRVEQGTVRPGDECIFLPTHTSSTPCIGKVFTVEMHHKTVESATCGDNCGFNVKGLVKENMPRVGDVMILKKDESLRRCKSFTAQIRVLEHPGELKVGYCPIAFVRTGRSAVKMTKIAWKVGKETGNQKVENPISLKSNEMAECVFEPQQPFVVDSFKNCEGLGRVAIMEGASVIMLGKVVSLEFLTGDEGKKGAATAAAGKPGAKPAAGAKPAAGAKPAAAKPAAKK

SEQ ID NO: 36550 - DNA, 680 bp, Panicum virgatum
  misc_feature: Ceres CLONE 1985942-R
  misc_feature: Encodes the peptide sequence at SEQ ID NO. 36551
agagcttgcaggcttagaggctatgtcccattttgaagcagaagataaccgactgtccggtcctattagtgattggcttcaaaaatggggaaatgttgtttctgtaaacctggcaaacaacaagttcagtggttctatacgtcccaccatatgtcaagccaagttactgcagacattcgacttgcattgtaacgatctcacggggagtatcgaggaggcattcgagggatgcaagaacctggttcatctggatttgcaaggtaacaatttcaatggtgggatacctgactacctggcagagctaccgctcaaaacattggagttgtcttacaacagatttacaggagtgttgcctggcaaattgtttgaatcatcaaccattttggaaatgaacctcagcaataatatgcttactggccatatccctgacagcattggtaaactccacagcttgcagatgttgaaaataggcagtaactgcttggaaggacctatcacaccggcagttggtgcactaaggaatttgacagaaatatctcttgatgggaatagactatctgggagcatcccgcaagagctcttcaactgcagaaacctagtcatgctaaacctgagctctaataatgtaacgtcctgaaaaattcaccaaataaatcacacgtgataaaatgtttattttc

SEQ ID NO: 36551 - protein, 211 aa, Panicum virgatum
  misc_feature: Ceres CLONE 1985942-R
  misc_feature: SWISSPROT Homolog: EC 2.7.11.1 Non-specific serine/threonine protein kinase
ELAGLEAMSHFEAEDNRLSGPISDWLQKWGNVVSVNLANNKFSGSIRPTICQAKLLQTFDLHCNDLTGSIEEAFEGCKNLVHLDLQGNNFNGGIPDYLAELPLKTLELSYNRFTGVLPGKLFESSTILEMNLSNNMLTGHIPDSIGKLHSLQMLKIGSNCLEGPITPAVGALRNLTEISLDGNRLSGSIPQELFNCRNLVMLNLSSNNVTS

SEQ ID NO: 36552 - DNA, 1444 bp, Panicum virgatum
  misc_feature: Ceres CLONE 1985942
gcccatgtgtaacgccattgccgccgtggaaccctagtcgccgccggtcgatggccgccgccgcggcgctcgcgcatctccgccctccggcggacaccgcagaagcttccttgcgacgcgccaccctctacgttatccttcttccgcccagcgaccgcctcgtctcgctgcgccgctgcctccccgccttcatgggtccttctggcggtgtcgaggtgacgttgggggtggaggtggcgcggaagcgcgggcttcggcctgctccgtcggtgcggcgccgcgggcgggccggtgctggtgctggggcgccgggtgagtcgatcgcgtcgcaaatttggcgggttataaaagatcgaatttacagttgactggtcatcggtcaagcagacttttctttttcctgaatagtgtcagcttgttcatcctattcgtcagcttcattgctacctctgctttcgctgaatctgatataaacaatctatatgctctgaggcacgcagtctctgaatcaaaaggcttccttcgggactggtttaattcagaaactcatccatgcaactggacgggtataacttgtgaaggacagcgcactgttgtggccatagaactgtcatctgtgccactccgtgtcccttttccattatgcatcataacattccagtcacttggttgcctcgacctaagcaggtgtgatttatttggtatgattccagaagctctgggagatttgcagaatctccagtacctggacttgagcaataacgagcttactgggcccatgcctttctcgttatatggtttgaagatgctgaaggaaatagtgatagacagaaacagattgtctggacaattgagccctgccattgctcatcttcagaacctcactaagttattgatatccaataacaacatctctggagaacttcctccggagctgggcagtctgaagaacctagaggtcctgggctttcaccagaacagattcaatggatcgataccagaatcttttggcaacctgactcggctcttccaccttgatgcaagcaagaataacctcactggatcaatatttcctggaataagtgcattgcagaacatgcagacacttgatttctcttcaaatagtttggtggggccaatacctaatgagattactcgtctgaaaatgcttgagcatttatctttggggttcaacaatttcactggagggattccaaaagagattggtaacatgaagcacctaaaggaactctctctgtgtcaatgcaacttatcaggcaccatcccttggtcaattggtagccttagaagcttaatggaacttgatatttcaggcaattacttcgactcggaactcccagcgtctgttggtgatctggggaatctgaccaccctgattgcaaggaaatcaaagctcatagggagcatacccaaagaacttggt

SEQ ID NO: 36553 - DNA, 730 bp, Panicum virgatum
  misc_feature: Ceres CLONE 1985945
  misc_feature: Encodes the peptide sequence at SEQ ID NO. 36554
gtccaccggttcctctgttcccctcctctctctcatctcgggcttttcaggagcagagctctctgttttctccccatccccagagatactctcgacgagaaggtcgccatggccgggaagggagacgggccggcgatcgggatcgacctcggcaccacctactcgtgcgtcggggtctggcagcatgaccgcgtcgagataatcgccaacgaccagggcaaccgcaccacgccgtcgtacgtcgcgttcaccgactccgagaggctcgtcggcgacgccgccaagaaccaggtcgccatgaaccccatcaacaccgtcttcgatgccaagcggctcatcggccggcgcttctcggacgcatcggtgcagagcgacatcaagctgtggcctttcaaggtggtgccgggctccgccgacaagcccatgatcggggtcaagttcaggggcgaggagaagcagttctcggccgaggagatctcctccatgatcctcaacaagatgaaggagacggccgaggcctacctcggcagcaccgtcaagaatgccgtcgtcaccgtcccggcctacttcaacgactcgcagcgccaggccaccaaggacgccggcgtcatctccgggctcaacgtcatgcgcatcatcaacgagcccaccgccgcgggcatcgcctacggcctcgacaagaagtcgagcagcgacggcgagaagaacgtgctcatcttcgacctcggcg

SEQ ID NO: 36554 - protein, 207 aa, Panicum virgatum
  misc_feature: Ceres CLONE 1985945
  misc_feature (9)..(207): Pfam Name: HSP70 Pfam Description: Hsp70 protein
  misc_feature: Functional homolog of the protein sequence given in SEQ ID NO 50336
  misc_feature: Useful for making plants with modulated heat sensitivity
MAGKGDGPAIGIDLGTTYSCVGVWQHDRVEIIANDQGNRTTPSYVAFTDSERLVGDAAKNQVAMNPINTVFDAKRLIGRRFSDASVQSDIKLWPFKVVPGSADKPMIGVKFRGEEKQFSAEEISSMILNKMKETAEAYLGSTVKNAVVTVPAYFNDSQRQATKDAGVISGLNVMRIINEPTAAGIAYGLDKKSSSDGEKNVLIFDLG

SEQ ID NO: 36555 - DNA, 776 bp, Panicum virgatum
  misc_feature: Ceres CLONE 1985948
  misc_feature: Encodes the peptide sequence at SEQ ID NO. 36556
  misc_feature (660)..(660): n is a, c, t, g, unknown, or other
accacaccgccttcacccgtgccccccacccctgccctgcttcgacgggcggcggcgcagatcgaaggaaccaggagggaatgatggatctcggggacagccagcagcggctcatcgccggcgcggcgctgctgctggccaccgtcgccttcgtcaggctcctgctgggctcccgcgcccgcggcaagcaccatcaagttcatgcgcgggcccacccccatgatccgggaggagtacgcccgcctcggcagcgtcttcaccgtccccatcctcagccgccggatcaccttcctcatcgggcccgaggtctccgcgcacttcttcaagggcaacgaggccgagatgagccagcaggaggtgtacaggttcaacgtgcccacctttgggccgggggtcgtcttcgacgtcgactactccgtcaggcaggagcagttccggttcttcaccgaggccctgcgtgccagcaagctccgcagctatgtcgaccagatggttgctgaggctgaggagtacttctcaaagtggggagaaagtggtaccgtgaatttgaagtatgagttggagcaccttatcatactgacagctagtcgatgcttgctgggaagggaggtgcgagagaagctctttgatgatgtatctgctctcttccatgaccttgancatgggatgcagcccgttagtgtcatcttcccctacctcccaatccctgcacataagcggcgggacagggcacgggcacgtctggcagaaatcctttgccaccatcattaactctc

SEQ ID NO: 36556 - protein, 189 aa, Panicum virgatum
  misc_feature: Ceres CLONE 1985948
  misc_feature: SWISSPROT Homolog: EC 1.14.13.70 Sterol 14-demethylase
  misc_feature (153)..(153): Xaa is any aa, unknown, or other
MRGPTPMIREEYARLGSVFTVPILSRRITFLIGPEVSAHFFKGNEAEMSQQEVYRFNVPTFGPGVVFDVDYSVRQEQFRFFTEALRASKLRSYVDQMVAEAEEYFSKWGESGTVNLKYELEHLIILTASRCLLGREVREKLFDDVSALFHDLXHGMQPVSVIFPYLPIPAHKRRDRARARLAEILCHHH

SEQ ID NO: 36557 - DNA, 670 bp, Panicum virgatum
  misc_feature: Ceres CLONE 1985949
  misc_feature: Encodes the peptide sequence at SEQ ID NO. 36558
atttctcactttccccatttgttcgccggagcgcccgccgccgccgctgccggagcgccgccgatggccagcggggcggaccgcatcagcggcctcccggagggcgtcctccaccacatcctctccctccttccggcgcaggacgcggtgcgcacgtgcgtgctcgcgcagagctggcgccaccactggcggtccgcgcccgccctgcgcctcgccggctgcgccggctgggccggcggcgcctacaccttcggccccttcgtcgacgccctgctgcacgtccgccgcgggggcgcacccctggactccatcgacttcgacctcgacgtcgatctggatctgggctgctacgacgtccccaagatggagcgccacgtcaacggctggctccgccgcgcgctgcggcgccaggtccgggacctccggttccgggtctccgtcgcgccccggctcacctgtgcgctggaggaccggcccctcgcctccgagcacctcaccaggctggagctcgtcggcgtcaagggcaacgccggcgtcctcgatttctcctgctgccccgcgctggaggagctcaggatggaggactgcgatgtcggctcgacggagatgctctccccgtccttgaaacgcctgaggatcagatactgcatcttctactgcaacttccgct

SEQ ID NO: 36558 - protein, 202 aa, Panicum virgatum
  misc_feature: Ceres CLONE 1985949
  misc_feature (6)..(53): Pfam Name: F-box Pfam Description: F-box domain
MASGADRISGLPEGVLHHILSLLPAQDAVRTCVLAQSWRHHWRSAPALRLAGCAGWAGGAYTFGPFVDALLHVRRGGAPLDSIDFDLDVDLDLGCYDVPKMERHVNGWLRRALRRQVRDLRFRVSVAPRLTCALEDRPLASEHLTRLELVGVKGNAGVLDFSCCPALEELRMEDCDVGSTEMLSPSLKRLRIRYCIFYCNFR

SEQ ID NO: 36559 - DNA, 1835 bp, Panicum virgatum
  misc_feature: Ceres CLONE 1985954
  misc_feature: Encodes the peptide sequence at SEQ ID NO. 36560
actcttgccagctgaccgcccgtacgaccgagatccaaggttccaagcccccggccccgcgcctcgtcctcgatctctccccgcgcgaacggcgcgccacgcggccggcgagacggagacgatggccgcccccgccgactccgcctccccggagtgccccgccgccccctccatgcccacggacccggacttcctcagctgcgtcctccagcccccggccccttcctcctcccgccccgacgccgactacgccgccctccgccgtctgctcctccgccgcaagccgccctccgccctccagcaccgcatggactggcgctgcaacggcaagggctacgtcgcctaccgcaacttcctcctccggcgcatcgacggcggtagcgcccacagtacgcccagcaacagtggaaggtgggctgcctctcctggccctgcactttccgaggcagacagctggagttctctccgggacttgagaactaataacagtggtttaagccgcactctaagtatcagttcaaagcagagtgatactgagcgccatgtcagattcgctgagcctgcatactcgtttgttggaatgcattgcatttttgacagctgcaaaacctcagttacaatattgaaatttggccgcgcaagttctgatctgcttgcgtatggtgcggcagatggcaacctaactgtttgccaggtttctgagccaccatctgttcttcaaaaattgataggtcactctaaaaatatcacagattttgatttttcatctaataaccagtacattgcttcatgctccctggataaaactgtgcgagtatgggaaatctctaaaggcacttgcattagggttgtatatggagtttcttcccagctatgcatctgctttcatcctgtgaacaacaacttgcttttagtcggcaatgcaaacaaggaaatcaatgcaataaattttagcactgggagagtaatcagcaaacttaactttgatgatgcggttacagctttggatattgatcacactgggcagcttattttcgctggtgatgcacagggttacatatatactgttagtgtgaattcacatacagggtcactatctagaactcataagaacaagagcagtaagagcaaatctcctattacaacaatccagtatcgcaccttttctctggtagcacgttgtccagtacttctttcttgtgctcaagatggaaacctgtctttcttcagtatcacaacagatgctaaagggtacttgactctcatatcttctttaaaactggcctcacggttgcagactatccgtgcttccttctgtccacttctttcccttgagaaaggagagttcatagttactggcagcgaggatgcaaatgtttacttctatgatttggcacgcccaaagaactcgtgtgtgaataaactacagggacatggttctccagtaattggagttgcctggaaccatggggaaaatttgctggcctcatctgattcagatggtacagttattgtatggaagcgagcgaaaactaattagagcgattccacatcacggaggatgcttttatgctgcaaactgttgattctactgaatgattcaaacgaaggcattttttttgtacattgtacgtccatcccattgtttgtaacataaacacccaaggctagggcaaagaagatcaaccggccttggttgtatttacagaagtatatagatttcccggtagagtgtaaagctttttgtcatggtatatcctgtatcatttgttttaggactgtacctttgtatcattaatgatttgtcccataaatatattaaacttgctgttcac

SEQ ID NO: 36560 - protein, 472 aa, Panicum virgatum
  misc_feature: Ceres CLONE 1985954
  misc_feature (196)..(234): Pfam Name: WD40 Pfam Description: WD domain, G-beta repeat
  misc_feature (429)..(467): Pfam Name: WD40 Pfam Description: WD domain, G-beta repeat
MAAPADSASPECPAAPSMPTDPDFLSCVLQPPAPSSSRPDADYAALRRLLLRRKPPSALQHRMDWRCNGKGYVAYRNFLLRRIDGGSAHSTPSNSGRWAASPGPALSEADSWSSLRDLRTNNSGLSRTLSISSKQSDTERHVRFAEPAYSFVGMHCIFDSCKTSVTILKFGRASSDLLAYGAADGNLTVCQVSEPPSVLQKLIGHSKNITDFDFSSNNQYIASCSLDKTVRVWEISKGTCIRVVYGVSSQLCICFHPVNNNLLLVGNANKEINAINFSTGRVISKLNFDDAVTALDIDHTGQLIFAGDAQGYIYTVSVNSHTGSLSRTHKNKSSKSKSPITTIQYRTFSLVARCPVLLSCAQDGNLSFFSITTDAKGYLTLISSLKLASRLQTIRASFCPLLSLEKGEFIVTGSEDANVYFYDLARPKNSCVNKLQGHGSPVIGVAWNHGENLLASSDSDGTVIVWKRAKTN

SEQ ID NO: 36561 - DNA, 1551 bp, Panicum virgatum
  misc_feature: Ceres CLONE 1985960
  misc_feature: Encodes the peptide sequence at SEQ ID NO. 36562
acacaggcaagcacaagcctctcttggcagcacaccagcaaagcacgggagagcgagaggtcgaggtgcaggcgagcggatgacgaagcactcggctgctatgtgcagcctcctcgtgctcgtgttgctcggcttgggatcccagctggtccagtcccaggtcctcttccaggggttcaactgggagtcgtggaagaagcagggtgggtagtacaactacctccggggccaggtcgatgacatcgccgcgacgggggccacgctcgtctggctcccgccgccgtcgcactcggtggcgccgcaggggtacatgcccggccgcctctacgacctggacgcgtccaagtacggcacccacgccgacctcaagtcgctcatcgccgccttccacgccaagggcgtccagtgcgtcgccgacatcgtcatcaaccaccgctgcgccgactacaaggacagccgcgggatctactgcgtcttcgagggcggcacgccggacggccgcctcgactggggccccgacatgatctgcagcgacgacacccagtactccaacggccacggccaccgcgacaccggggcggacttcggcgccgcgcccgacatcgaccacctcaacccgcgcgtccagcaggagctctccgactggctcaactggctcaaatccgacctcggcttcgacggctggcgcctcgacttcgccaagggctactccgccgccgtcgccaaggtgtacgtcgacaacaccgcgcccaccttcgtcgtcgccgagatatggagctcgctgcagtacgacggcaatggagaaccgtccagcaaccaggacagagatcgtcaggagctggtgaattgggcgcaatctgtgggcggccctgccgcggcgtttgacttcaccaccaagggggtgctgcagtctgccgtccagggcgagctgtggcggctcaaggatggcaacggcaaggctcccggcatgatcggctggctgccggagaaggcggtcaccttcgtcgacaaccatgacaccggctccacccagaactcatggcctttcccctccgacaagttctacgaccacgttttcgattggaacctgaagcaggagatcagcgtcctgtcagcggtgaggtcaagaaacgggatccaccccgggagcaagctggacatccttgccgctgatggggatctctacgttgccaagatcgacgacaaggttatcgtgaagatcgggtcgcggtacgatgtcgggaacctgatcccctcagacttccatcctgttgcacatggcaacaattactgcgtttgggagaggtctggtctaagagttccagcaggacgacaccactagacctgaccgaacctctaaagatattctttctcaggtctatctgagcctgaagaaatttgaatcggattgagtaaaataacccgaattttattgtactaagcttctttcagcaaattattgaaagaagatcatggtgtttggatgtattatgttgatcagggaatttttgtaacttctcttgaaatgaggaaacaaagatggttcttgcg

SEQ ID NO: 36562 - protein, 343 aa, Panicum virgatum
  misc_feature: Ceres CLONE 1985960
  misc_feature (272)..(332): Pfam Name: Alpha-amyl_C2 Pfam Description: Alpha-amylase C-terminal beta-sheet domain
  misc_feature (1)..(271): Pfam Name: Alpha-amylase Pfam Description: Alpha amylase, catalytic domain
  misc_feature: SWISSPROT Homolog: EC 3.2.1.1 Alpha-amylase
MPGRLYDLDASKYGTHADLKSLIAAFHAKGVQCVADIVINHRCADYKDSRGIYCVFEGGTPDGRLDWGPDMICSDDTQYSNGHGHRDTGADFGAAPDIDHLNPRVQQELSDWLNWLKSDLGFDGWRLDFAKGYSAAVAKVYVDNTAPTFVVAEIWSSLQYDGNGEPSSNQDRDRQELVNWAQSVGGPAAAFDFTTKGVLQSAVQGELWRLKDGNGKAPGMIGWLPEKAVTFVDNHDTGSTQNSWPFPSDKFYDHVFDWNLKQEISVLSAVRSRNGIHPGSKLDILAADGDLYVAKIDDKVIVKIGSRYDVGNLIPSDFHPVAHGNNYCVWERSGLRVPAGRHH

SEQ ID NO: 36563 - DNA, 1449 bp, Panicum virgatum
  misc_feature: Ceres CLONE 1985966
  misc_feature: Encodes the peptide sequence at SEQ ID NO. 36564
gaatgtgtggagaagctgaagctgctaagtactccagaggagtgtgctcgtaggctaaatgaagaacctgagatacacgctgaccctgcgatggatccagattatgaatctccggaggaacaggagcaggagactgaaagaagtagctttaataagtcgagaggttctttcttgaggaaagatggtaatcttgtgtctccagttaaaggagacggtagaaatcctttacagcgagatccaaaaactaactgggaatctaatcgaaacacatgggctgaatcaagtcctcatgtggagtcacccctttcacggagatccacattctcttctccaggtgaaagtgctggttatacaagtaaatcggaaagtcctaacattggtgcgcaaacagtgaaattggaaggtaccacacgcagtgcttcacaagggccatctggtgtctcatctggaattttggctgctaacatagattcaggggcaaaaactgcaccgcaatcagccattaacgaatctgagaagatctggcagtacatggatccttctaataaaatccaaggccctttctcaatcatccagttgcggaaatggaacagcaatggttacttccctcccagtttgaaaatatggaaagctagtgagaagcaggatgattcaatactactgactgatgctttggcggggaagtttgagaaagaccttcctccatgggaaccaccacatgttagtgcatctcaaattggcaaaacccctcttcttgaggaaagcacaatacctggtgagcgaactccaaaatcagtagttccaatgtctttctcaagtagtgatcaaaggcaggactatagttcaacgaaccttggagcaaccatgatccattctggcacacaaggttattatggaatgcaaaattctcaagcagcgtacacaaaccaacagtctcttactggaagttggaatgccgcctctagccagtttggagttgcagtaaatccgatgacacctacccagcctgccatgggaaacttttcgggacaaaatattgtggctgcaggaaatatgggtcatttaactcctgggatgactcctgctactgcaactgcagaattaacctcagatttatcctcccagaaccaaatatcatctgctttaccacaaatgggtgacaggttacctgatggaagtgactctaagttaggagaaaatgcttcacatggaagagtgagatcttcggctgaagccgatggagcactgggtgctcagcgtggaccagcacaactgaacactcagcaacttgaagacacaaggaaccagatgtcaacaccatctgctgcatcagtacagccttcggtgacagtaattgctggcagtgatactcaaagcagtgggtgggctgtacctgcacaagcggtcaacacatctggccaacctcaggtagctggaaatatgacctgg

SEQ ID NO: 36564 - protein, 482 aa, Panicum virgatum
  misc_feature: Ceres CLONE 1985966
  misc_feature (173)..(228): Pfam Name: GYF Pfam Description: GYF domain
  misc_feature: SWISSPROT Homolog: EC 3.2.1.18 Exo-alpha-sialidase
ECVEKLKLLSTPEECARRLNEEPEIHADPAMDPDYESPEEQEQETERSSFNKSRGSFLRKDGNLVSPVKGDGRNPLQRDPKTNWESNRNTWAESSPHVESPLSRRSTFSSPGESAGYTSKSESPNIGAQTVKLEGTTRSASQGPSGVSSGILAANIDSGAKTAPQSAINESEKIWQYMDPSNKIQGPFSIIQLRKWNSNGYFPPSLKIWKASEKQDDSILLTDALAGKFEKDLPPWEPPHVSASQIGKTPLLEESTIPGERTPKSVVPMSFSSSDQRQDYSSTNLGATMIHSGTQGYYGMQNSQAAYTNQQSLTGSWNAASSQFGVAVNPMTPTQPAMGNFSGQNIVAAGNMGHLTPGMTPATATAELTSDLSSQNQISSALPQMGDRLPDGSDSKLGENASHGRVRSSAEADGALGAQRGPAQLNTQQLEDTRNQMSTPSAASVQPSVTVIAGSDTQSSGWAVPAQAVNTSGQPQVAGNMT

SEQ ID NO: 36565 - DNA, 633 bp, Panicum virgatum
  misc_feature: Ceres CLONE 1985966-R
cacgttctagtggcgatggagggtcaaggggaaatagaccgcagggactctgctggccctatcttgagcgcgggaactgctggaaagttgactgcaggttcatccatccaacaaacacagatggatattcgtccaggaatgataggcactttgataggcagcactcaagtaatgataggcgatatgacgatcacaatgaaagaaatgatcggcagtttgataggcagccttcagacaatgaaaggcaccatgataggtctgatgacaggcacagtggcagggatgacgataggcatgatgacaggtaggctgataggtctcagtcaagagagccgcactcgaaccgttgcaaatttcctccgttttgttgtatgtgcagtagcatactagcgtagtagcatccatgcatgttttgaactccaccctatagcgagctgcatacatgtgcaagaatcatcatgtacaacagttgtagtttgatgctgtgggtatcctagcttcgaatttaataatttactataataaatcgtggtgtatgaactctgtagctatggctccacataccggttgtctctatggtgccgactgttgcgtgtgcctttaaagagtttgaagatcggtagtgttacctgc

SEQ ID NO: 36566 - DNA, 1458 bp, Panicum virgatum
  misc_feature: Ceres CLONE 1985990
  misc_feature: Encodes the peptide sequence at SEQ ID NO. 36567
ctggcaaccttcgaaaccgggcgctcccggatccaccccgaagtccaaaagcgaagcccaccagcgccgcaacggcgaaaccatcggaaccctagatccctctcgcctgaggtccagaaccctagatccgccatgcaccagcccagagcccgctacccgcccggctacggcggaggcggcggcagacgtggcggcggaggcggaggcggaggcggaggaggaggcggcggcggcggaaatcacaactattacagccgaaacccacagccgcagccgcaccaccaccagcactaccagcaccagcagccgccaccgcagcaacaaccgcagcagcacgcgcataggaactcatcgcatcagcatcagcagtggctgcggcgagatcagggccccgcctccgccgcggggtctggagatgctgcggtgaggacggcggcgcagctcgacgctgtagactcgagttctcaagattggaaggcgcaattgaatataccagctccggatacacgctacaggacagaggatgtcactgcaacaaaaggcaatgagttcgaagattattttttgaaacgtgagctgcttatgggaatctatggaaagggctttgaaaggccatcccctattcaagaagaaagcattccgattgcactgactggaagtgatattcttgcaagagcgaaaaatgggactgggaagactgcggcattttgcattccagcacttgaaaaaattgatcccgagaaaaatgccattcaagttgttatactggtaccaacaagggaactggctctgcagacttcacaagtctgtaaggagctcgggaagtacctgaacattcaagttatggtcagcactggtggaaccagcttgagggatgacatcatgcgtttgtaccaacctgttcatttacttgttgggactcctggccgtatactggatcttaccaggaagggcatttgtgtgctgaaagattgttcaatgcttgtcatggatgaggctgacaagctattagctccagagttccagccttctgtagaggcacttattcatttccttccacctagtcggcaactgttgatgttttcggcaacctttcctgttactgtcaaggaattcaaagagaaatacctgcctaaaccttacgttattaatcttatggatgaactgaccctgaaaggaatcactcaatactatgcttttgtcgaagaaagacagaaagttcattgcctgaatacacttttctctaagcttcaaattaatcaatccattatattctgcaactccgttaatagagttgagctactagctaagaaaataactgaacttggttattcatgcttctacattcatgctaagatgttgcaagaccacagaaaccgagtgtttcatgattttcgcaatggtgcttgcagaaaccttgtgtgtacagatctgtttaccagaggaattgacatccag

SEQ ID NO: 36567 - protein, 441 aa, Panicum virgatum
  misc_feature: Ceres CLONE 1985990
  misc_feature (162)..(328): Pfam Name: DEAD Pfam Description: DEAD/DEAH box helicase
  misc_feature: Functional homolog of the protein sequence given in SEQ ID NO 50788
  misc_feature: Useful for making plants with altered lignin content
MHQPRARYPPGYGGGGGRRGGGGGGGGGGGGGGGGNHNYYSRNPQPQPHHHQHYQHQQPPPQQQPQQHAHRNSSHQHQQWLRRDQGPASAAGSGDAAVRTAAQLDAVDSSSQDWKAQLNIPAPDTRYRTEDVTATKGNEFEDYFLKRELLMGIYGKGFERPSPIQEESIPIALTGSDILARAKNGTGKTAAFCIPALEKIDPEKNAIQVVILVPTRELALQTSQVCKELGKYLNIQVMVSTGGTSLRDDIMRLYQPVHLLVGTPGRILDLTRKGICVLKDCSMLVMDEADKLLAPEFQPSVEALIHFLPPSRQLLMFSATFPVTVKEFKEKYLPKPYVINLMDELTLKGITQYYAFVEERQKVHCLNTLFSKLQINQSIIFCNSVNRVELLAKKITELGYSCFYIHAKMLQDHRNRVFHDFRNGACRNLVCTDLFTRGIDI

SEQ ID NO: 36568 - DNA, 535 bp, Panicum virgatum
  misc_feature: Ceres CLONE 1985990-R
  misc_feature: Encodes the peptide sequence at SEQ ID NO. 36569
tcacttatgaggatcgtttcaacttgtataggattgagcaagaactcggaacagaaattaagacaatacccccacaaattgacctggccgtgtattgccaatgatcagcgctgcagtttccaaaacatcaatgcatttattttcatgaaaaacttgtcaggaaaatacagatgtacatagcacccatcaaggttcgctttggtgcctttggtgatgtttctaagcttacttcaagtagtagaggaagggtttcctgtcggcactgataccattcagtttaactgagggcatgggcactgggcttgcttgagaggtccggaacatcgatcagagaaaacagttcttacttcatagatcctgttaacattttcattgtacttgtttgcctaagttcctcttgattcgtcagtttttttttccattttctttccttctgttatgacacatggatatttttttttcttagccagcttattttgtgtttgttttttttcttggtctatatgattgcctctaaattattttgcgttccttc

SEQ ID NO: 36569 - protein, 33 aa, Panicum virgatum
  misc_feature: Ceres CLONE 1985990-R
  misc_feature: Functional homolog of the protein sequence given in SEQ ID NO 50788
  misc_feature: Useful for making plants with altered lignin content
TYEDRFNLYRIEQELGTEIKTIPPQIDLAVYCQ

SEQ ID NO: 36570 - DNA, 768 bp, Panicum virgatum
  misc_feature: Ceres CLONE 1985993
  misc_feature: Encodes the peptide sequence at SEQ ID NO. 36571
atcccagcacaacacgagcagctcgctcatcaccgtctcgtctccctccaacgatccccagacgcgcgctctcttggttctccctctctccccctccccacagccactcgcgccccgtgccctttccgccatgtgtggcatcttcgccgtgctcgggtgcgccgactgctcccaggcccagagggctcgcgtcctcgcctgctcccgcaggctgaggcaccggggtcccgactggtcgggggtgtaccagcacgagggcaacttcctcgcccagcagcggctcgccgtcgtctccccgctgtccggagaccagccgctcttcaacgaggaccgcaccgtcgtcgtcgtggccaatggggagatctacaaccacaagaagatccggaagcagttcaccggcaagcacaccttcaccaccggcagtgactgcgaggtcatcatccctctgtacgaggagtacggcgagaacttcgtcgagatgctggacggcgtgttcgccttcgtgctctacgacacccgcaacaggacgtacatggccgcgcgcgacgccatcggcgtcaaccccctctacatcggctggggcggcgacggttccgtctggttcgcctccgagatgaaggcgctgaacgaggactgcgtccagttcgagctcttcccgccggggcacctctactccagcgcctccgggttccgccgctggtacaacccggcctggttcctcgagcaggtgccgtcgacgccgtacgacccgctcgtgctcagggcggc

SEQ ID NO: 36571 - protein, 212 aa, Panicum virgatum
  misc_feature: Ceres CLONE 1985993
  misc_feature (2)..(162): Pfam Name: GATase_2 Pfam Description: Glutamine amidotransferases class-II
  misc_feature: SWISSPROT Homolog: EC 6.3.5.4 Asparagine synthase (glutamine-hydrolyzing)
MCGIFAVLGCADCSQAQRARVLACSRRLRHRGPDWSGVYQHEGNFLAQQRLAVVSPLSGDQPLFNEDRTVVVVANGEIYNHKKIRKQFTGKHTFTTGSDCEVIIPLYEEYGENFVEMLDGVFAFVLYDTRNRTYMAARDAIGVNPLYIGWGGDGSVWFASEMKALNEDCVQFELFPPGHLYSSASGFRRWYNPAWFLEQVPSTPYDPLVLRA

SEQ ID NO: 36572 - DNA, 706 bp, Panicum virgatum
  misc_feature: Ceres CLONE 1985995
  misc_feature: Encodes the peptide sequence at SEQ ID NO. 36573
accggctcttcttcctcttgttcgtacgcccgcgcgccccctctgcagtgaccctctccgcatctccctccattgctcaaggctctgggccatccagcagccatggggacccaagcgcccgcgagctatcctcctcctgccaaggatgacagcaagacggcggaggagaagaagctcgaggagtggctccccatcaacggctccaggaacgccaagtggtggtactccgccttccacaatgtcaccgccatggtcggcgccggcgtcctcggcctcccctacgccatgtccgagctcggatggggccccggcatcgtggtgatgatcctgtcgtgggtcatcacgctgtacacgctatggcagatggtggagatgcacgagatggtgcccgggaagcgcttcgaccgctaccacgagctcggccagcacgtcttcggcgagaagctgggcctctggatcgtcgtgccgcagcagctcgtcgtcgaggtcagcctcaacatcaagctctcctacttcatcatgatcttcgcctccgtccacttcgtcctctcccagctccccaacttcaactccatctccgtcgtctcccttgccgccgccgtcatgtcaatcagttactcgacaatcgcgtggggagcatccttggacaaggggagggaggcgaacgtggactacgacctgcgcgcgaccacgacgccggggaaag

SEQ ID NO: 36573 - protein, 201 aa, Panicum virgatum
  misc_feature: Ceres CLONE 1985995
  misc_feature: Functional homolog of the protein sequence given in SEQ ID NO 50493
  misc_feature: Useful for making plants with altered oil content
MGTQAPASYPPPAKDDSKTAEEKKLEEWLPINGSRNAKWWYSAFHNVTAMVGAGVLGLPYAMSELGWGPGIVVMILSWVITLYTLWQMVEMHEMVPGKRFDRYHELGQHVFGEKLGLWIVVPQQLVVEVSLNIKLSYFIMIFASVHFVLSQLPNFNSISVVSLAAAVMSISYSTIAWGASLDKGREANVDYDLRATTTPGK

SEQ ID NO: 36574 - DNA, 749 bp, Panicum virgatum
  misc_feature: Ceres CLONE 1986001
  misc_feature: Encodes the peptide sequence at SEQ ID NO. 36575
aaaccaaagcaagtgctataaagctcccacctccctctctgctcgatctctctctcgcgcgcgcactcgcaccaacatggtcaaggaaggcaccaccgacggcggcgcggtgacgatcacggccgtgacgacggtggcgccggcgctgccggtgcaggagcaccgcctgccgctctcgaacctggacctcatcctgccacccatcgacgtcggcgtcttcttctgctacgcggccccaggcggcagcgccgccgcggtcctcaaggcggcgctggccaaggcgctggtggcgtactacccgctggccggggaggtggtggccaacgcggcgggcgagccggagctgctgtgcagcggccgcggggtggacgtcgcggaggccaccgccaccgccggcgccgtgatgcgggacctgcggctgggccgccccgacgagagcgtcgagcacctcgtgcccaagaagaaggccggcgtcatgtccgtgcaggttacaaagttcaggtgcggcggcgctgtcgtcggctgcaccttcgaccaccgcgtatgcgacgcctactccttcaacatgttcctcgtcgcgtgggccgcagccgcccggggcgacagccccgcgccgccggccccttccttccgccgctcgttcctcgcgcctcgtaatccagcgccaccgtgcaccggcaccctcgcggaccgcctcttcgtccccgtccgccgcgcgcaggccccgccggacaccgccgctgccaacc

SEQ ID NO: 36575 - protein, 224 aa, Panicum virgatum
  misc_feature: Ceres CLONE 1986001
  misc_feature (10)..(223): Pfam Name: Transferase Pfam Description: Transferase family
  misc_feature: SWISSPROT Homolog: EC 2.3.1.162 Taxadien-5-alpha-ol O-acetyltransferase
MVKEGTTDGGAVTITAVTTVAPALPVQEHRLPLSNLDLILPPIDVGVFFCYAAPGGSAAAVLKAALAKALVAYYPLAGEVVANAAGEPELLCSGRGVDVAEATATAGAVMRDLRLGRPDESVEHLVPKKKAGVMSVQVTKFRCGGAVVGCTFDHRVCDAYSFNMFLVAWAAAARGDSPAPPAPSFRRSFLAPRNPAPPCTGTLADRLFVPVRRAQAPPDTAAAN

SEQ ID NO: 36576 - DNA, 1361 bp, Panicum virgatum
  misc_feature: Ceres CLONE 1986006
  misc_feature: Encodes the peptide sequence at SEQ ID NO. 36577
aacaaacgctaaaaaagtaacagtttctgtactttattgctgtagaggtactgtcgattcgaggcccgtgtgtgaagaggcgctcgaccttcaacccccaactttacccctccggcgcatacaaccgccgagctctttttatccccaggaactctcaccctccacccggctatgtcgacggctgccgatgccgcgtcgtggaagctgtccgacttcgagctgaagcagacgctcgggacggggtcgttcgggcgcgtgcggctgtgcaagcacaagggcacgaacgagtacttcgcgatgaagtgcctgaagaagcgcgagatcatcaagatgaagcaggtgcagcacatcatcgcagagaagaacttgctgtcggaactgtcgcacccgttcatcgtgaacatgctgtgctcgttccaggacgaccgcaagctgtacctcgtgctggagttcgtgatcggcggcgagatgttcacgcacctgcgcacggcggggcggttcccgaacgacgtggcgaagttctaccacgcggagctcgtgcttgccttcgagtacatgcacacgaaggatatcatctaccgcgacctgaagccggagaacctgctgctggacaacaaggggcacatcaaaatcacggacttcgggttcgcgaagaaggtgccggagcgcacgttcacgctgtgcgggacgccggagtacctggcgcctgaggtgatccagagcaaggggcacggcaaggctgtagactggtggacgatggggatcctgctgtatgaattcatcgcgggctacccgccgttcttcgacgactcgccgtaccggatctacgagaagatcatcgagggcaaggtgaagttcccgaactggttcgactcgcgcgcgcgcgacctcgtgaaggggctgcttgtgatcgaccacacgaagcggctggggacgctgaagaacggcgtggcggacatcaaggggcacccgtacttccacggggcgaactgggacaagctcttcgcgcggcactacccggcgccgatccctgtgaaggtgaagagcgcgggcgacacgagcaacttcgagtcgtacccggagagcaacgacgaccgaggcgcgccgctgacgccggcgcagcaggcggagttcaaggacttctagtgccagtgacacgccgacaggccttccaacccaaccgcactccagcacaaacgtgggacatgtgatttttttgaaccggttgacacaagccgtcgtgcggggccggcgtccctcgttccacccgccggatggccatgcaccaccgatcccccgaactctctccaccgccggatccgctccatgtacgtacactcctccagagcgtatcatcctcg

SEQ ID NO: 36577 - protein, 324 aa, Panicum virgatum
  misc_feature: Ceres CLONE 1986006
  misc_feature (15)..(269): Pfam Name: Pkinase Pfam Description: Protein kinase domain
  misc_feature: SWISSPROT Homolog: EC 2.7.11.11 cAMP-dependent protein kinase
MSTAADAASWKLSDFELKQTLGTGSFGRVRLCKHKGTNEYFAMKCLKKREIIKMKQVQHIIAEKNLLSELSHPFIVNMLCSFQDDRKLYLVLEFVIGGEMFTHLRTAGRFPNDVAKFYHAELVLAFEYMHTKDIIYRDLKPENLLLDNKGHIKITDFGFAKKVPERTFTLCGTPEYLAPEVIQSKGHGKAVDWWTMGILLYEFIAGYPPFFDDSPYRIYEKIIEGKVKFPNWFDSRARDLVKGLLVIDHTKRLGTLKNGVADIKGHPYFHGANWDKLFARHYPAPIPVKVKSAGDTSNFESYPESNDDRGAPLTPAQQAEFKDF

SEQ ID NO: 36578 - DNA, 1976 bp, Panicum virgatum
  misc_feature: Ceres CLONE 1986007
  misc_feature: Encodes the peptide sequence at SEQ ID NO. 36579
ttcatttataaataaattaaaaacagttcatatctcacctcacaaatggagccatccaaaagagccatgaagtcaatccttaaacaggtcattgacgtcgccaccaaaaccatcagcgccagcttcagtgtccctgatgaggcagtcgtcactcccgtcactaacgtccctggcagagactaccaaatcccaactggtatcaagatcttcaatagatacaagaaatcccacaactcctttggctgcaccagtactaaggaacttgcccaaaaattccaagagaatctcgtccccaacgactttatcgactctgtcgatatcaccgatgacggcttcatcttccctcatatcaaggacagttatattgaagaagaaatcaacagcatcctcagaaacggagtcagcttgcaccaagagaacccacaaactattgttgttgacttctcaggccctaacatcgccaaggaaatgcacgttggtcacttgagatccaccattatcggagaaagtgtctgcagaatccttgaggcacaaggacagaaggtccacagagtaaaccatctcggtgattggggaactcaattcggtatgttgattaaccacttgaaggtcacttaccctgactacctcgagaaccttccaccactctctgatctcaccactttctacaaggaagccaagaagagattcgatgaagaccccgaattcaaaaagaaggcacaattgaccgtcgttgacctccaatctggtgaccctgactgcagaaaggcctgggccactctctgtgaaatttcaagacaagagttcaacaagatctacaagagactcgatatcaagatcaacgatttcggagagagtttctataacccaatgttgccaggcattgttaaggaacttgaagaaaaaggacacatcgaactcagtgacggagctaaatgcatgttcattaaaggtaagcaagtcccattgatgttgcaaaagagtgatggtggatataactacgatactaccgatatggctgctgctaagtacagattgactgaactcaaggctgatagaattattattatcactgatatcggacagaagccacacttcgacctcatctttgaaggtgctaagattttgggctggcatcaacctcccaagaccagaatggaccatatcggtttcggtctggttactgatgaaaacggccaaaagttcaagactagatctggagataccgtcaagctcattgacttgttggatgaagccaaaaagagagccgctgaccaacttaaactcagattaaaggagtccaaggaaggcaaagaaggagctcagacctacgttgatgaagataaggttgaagaatctgctgaaaagatcggtatggctgctgttaaatacttcgacttgaagcagaacaaggtttccaactacaagttcaactacgaccagatgttggaccctaagggaaataccgctgtgtacttattgtactcatatgccagaatctgctctattatcaacaaggctggtttcactcaggaagatgtgaataaggtcctcagccaaggaggattcaagatcactcacccccacgagagacaattggctatggctttgctcagattcccagaagtcattgacactgtcgttgatgagttgaacgtccacaagctctgcgacttcatctatgaaatttccgtgaaggttgctgaaggatacagcaagtacagaatcattgatgaccctaacagagacaccagattgcttctttgcgaggctgtcagaagaatcttggacactgctttctatatggttggtatcacccccttacagaagatctaaaaaggatttaaagagtatataatgcattcatataaggagtagaactgcaccgaagaactgtttttatatatctattttttaacaattaagaacacttagcttaacaaacagaaaattaatagactgcctatataggggat

SEQ ID NO: 36579 - protein, 589 aa, Panicum virgatum
  misc_feature: Ceres CLONE 1986007
  misc_feature (103)..(457): Pfam Name: tRNA-synt_1d Pfam Description: tRNA synthetases class I (R)
  misc_feature (471)..(589): Pfam Name: DALR_1 Pfam Description: DALR anticodon binding domain
  misc_feature: SWISSPROT Homolog: EC 6.1.1.19 Arginine--tRNA ligase
MKSILKQVIDVATKTISASFSVPDEAVVTPVTNVPGRDYQIPTGIKIFNRYKKSHNSFGCTSTKELAQKFQENLVPNDFIDSVDITDDGFIFPHIKDSYIEEEINSILRNGVSLHQENPQTIVVDFSGPNIAKEMHVGHLRSTIIGESVCRILEAQGQKVHRVNHLGDWGTQFGMLINHLKVTYPDYLENLPPLSDLTTFYKEAKKRFDEDPEFKKKAQLTVVDLQSGDPDCRKAWATLCEISRQEFNKIYKRLDIKINDFGESFYNPMLPGIVKELEEKGHIELSDGAKCMFIKGKQVPLMLQKSDGGYNYDTTDMAAAKYRLTELKADRIIIITDIGQKPHFDLIFEGAKILGWHQPPKTRMDHIGFGLVTDENGQKFKTRSGDTVKLIDLLDEAKKRAADQLKLRLKESKEGKEGAQTYVDEDKVEESAEKIGMAAVKYFDLKQNKVSNYKFNYDQMLDPKGNTAVYLLYSYARICSIINKAGFTQEDVNKVLSQGGFKITHPHERQLAMALLRFPEVIDTVVDELNVHKLCDFIYEISVKVAEGYSKYRIIDDPNRDTRLLLCEAVRRILDTAFYMVGITPLQKI

SEQ ID NO: 36580 - DNA, 1436 bp, Panicum virgatum
  misc_feature: Ceres CLONE 1986011
  misc_feature: Encodes the peptide sequence at SEQ ID NO. 36581
gttcactccccatcactctcgccccacctcctcgtcctccgacgccgccgccgtcgccgccgctgacgatgccgcggaaggtctcgtcgacatcagattcgcgccgcaagcggaagcgcaaccccaacgcgtccccgtccaggccctccacctccgccgcggcggccgaccactccgacgagtccgactccgccgccgcgaacggcgacgacgatgccgccgcccacgccgccgcggggggcggggccgacgacgacgagggccccgcggcgtccgaggaccccgtgctcgacctccgcgaggcggaggtgctgccctcggctgaggccatctccgccttccccgccgccaagcgccgcgtggtcaaccggccgcacccgtccgtcctcgccctgatcgcggccgagcgatctgcttattccggcgacacctctgctgcagcaccggcgccggcgctagagaacatctcgcacgggcagctgcaggtgctctctggggtgctgccggaccatccctcccttgccacagaccccgacaaaccgtccctgtatgtgtgcaccccgccgcccctaatggaggggcggggcgtgcccaaacagttccatggtcgcctccatgtcgtgccaaagcactcagattggttctcccccggggcagtgcataggcttgaaagacaggtggttccgcacttctttacagggaagtctccagggcacaccccggagaagtatgtcatgctaaggaataaagttattgccaaatacttggagaacccaggcaagaggcttgcttttgctgagtgccaggggcttgttgggagcacaggcgaactgtatgatttgagtaggattgttaggttcttggacacttgggggatcattaattaccttgcggctggatcagtgcaccgcggcctgaggatggcagcgtctcttctaagggaggaaccatcaggggaattgcaattggttacagcaccattgaaatcaatcgatggtctggttttgtttgatcggccaaaatgtagcatccaagcggaggacatttcttcgatggcatcatcttcttcgaattcggaggtggtggattttgatgctgcatttgcagaactggatgggaagattagggagcgtttgtctgaaagctcttgcagttactgcttacagcctttgccaagtttgcattaccgatcgcagaatgaggcagatattgctctgtgctctgattgcttccatgatgcgagatatattactgggcattctagcatagatttccagaaagtggatggggataatgatggattggaaaatgatagtgataaatggactgatgaagaaacattgttgctgttggagggcattgaaaagtacaatgacaactgggatgacattgcagggcatgttggaacaaaatcaaaggcgcaatgtatttaccat

SEQ ID NO: 36581 - protein, 455 aa, Panicum virgatum
  misc_feature: Ceres CLONE 1986011
  misc_feature (183)..(273): Pfam Name: SWIRM Pfam Description: SWIRM domain
  misc_feature (416)..(455): Pfam Name: Myb_DNA-binding Pfam Description: Myb-like DNA-binding domain
MPRKVSSTSDSRRKRKRNPNASPSRPSTSAAAADHSDESDSAAANGDDDAAAHAAAGGGADDDEGPAASEDPVLDLREAEVLPSAEAISAFPAAKRRVVNRPHPSVLALIAAERSAYSGDTSAAAPAPALENISHGQLQVLSGVLPDHPSLATDPDKPSLYVCTPPPLMEGRGVPKQFHGRLHVVPKHSDWFSPGAVHRLERQVVPHFFTGKSPGHTPEKYVMLRNKVIAKYLENPGKRLAFAECQGLVGSTGELYDLSRIVRFLDTWGIINYLAAGSVHRGLRMAASLLREEPSGELQLVTAPLKSIDGLVLFDRPKCSIQAEDISSMASSSSNSEVVDFDAAFAELDGKIRERLSESSCSYCLQPLPSLHYRSQNEADIALCSDCFHDARYITGHSSIDFQKVDGDNDGLENDSDKWTDEETLLLLEGIEKYNDNWDDIAGHVGTKSKAQCIY

SEQ ID NO: 36582 - DNA, 634 bp, Panicum virgatum
  misc_feature: Ceres CLONE 1986011-R
cagagggaacgtgaagtccaaagactagctgctaccgtaataaatcatcagttaaagaggttggagttgaaattgaagcagtttgcagaagttgagactttgctcttgaaggaatgtgagcaagtggagagggtgagacagcggatttcagctgactgtacccggatgaggtcagccctgttaggttccactggaatgcctggaagcagtagtaccatgccatccaatccagcaagcatgagccccagaccagtgggtgtgccgggctccatgcctcagaccagcatgccagctgcagctgcatatgccaataacatgcagggtcatggtcaagcccagatgcctcagatgccgttcatgcatcagcggccgcagatgctttcgttcggtcctcgccttccactctcggcaatccagactcaaccatcaccacaggcatcaaacatcatgttcaactctgggatgcccagttcggttgcatctaaccaccatcagttgctgagatcgtcttctggaaacaattttagtgcaggataggggtcttcataagaatcttacttagttttgtcagatgtagcattatatgatttataaacaccattgtaatccattcagacggtgtcctgtgttggtc

SEQ ID NO: 36583 - DNA, 700 bp, Panicum virgatum
  misc_feature: Ceres CLONE 1986020
  misc_feature: Encodes the peptide sequence at SEQ ID NO. 36584
tttctgaagaaacatgatggtgttaggtatccatcaatacttggtgttcgagaacatatcttcaccggcagtgtttcctctcttgcatggttcatgtcaaaccaagaaacgagttttgtgactattggacagcttgtactcgctaatcctttgagggttcgatttcattacgggcattctgatatctttgatcggcttttccacctcacaaggggaggtgtaagcaaagcttctaagattatcaatcttagtgaggacatatttgctggatttaattcaacattgcgtgaaggaaatgttacacatcatgaatacatgcaagttggcaagggaagagatgttggtctcaatcagatttcactgtttgaagcaaaaatagcaaatggtaatggtgaacagacactgagtcgcgacgtctaccgacttggacatcgttttgacttcttcagaatgttgtcatgctactatactactattggcttttacttcagtacaatgataacagtttggacagtgtatgtattcctctatgggcgcctttatcttgttctcagtggcctggacgaagcactagccactggaaagcggtttatacacaatgaacctctccaggttgctctagcttcacagtcttttgtgcagcttgggttcttgatggcgctgcctatgatgatggaaattggtctagagagaggattca

SEQ ID NO: 36584 - protein, 233 aa, Panicum virgatum
  misc_feature: Ceres CLONE 1986020
  misc_feature: SWISSPROT Homolog: EC 2.4.1.34 1,3-beta-glucan synthase
  misc_feature: Functional homolog of the protein sequence given in SEQ ID NO 51526
  misc_feature: Useful for making plants with altered cell wall content and/or composition
FLKKHDGVRYPSILGVREHIFTGSVSSLAWFMSNQETSFVTIGQLVLANPLRVRFHYGHSDIFDRLFHLTRGGVSKASKIINLSEDIFAGFNSTLREGNVTHHEYMQVGKGRDVGLNQISLFEAKIANGNGEQTLSRDVYRLGHRFDFFRMLSCYYTTIGFYFSTMITVWTVYVFLYGRLYLVLSGLDEALATGKRFIHNEPLQVALASQSFVQLGFLMALPMMMEIGLERGF

SEQ ID NO: 36585 - DNA, 701 bp, Panicum virgatum
  misc_feature: Ceres CLONE 1986025
  misc_feature: Encodes the peptide sequence at SEQ ID NO. 36586
gagtttggctggggcggcacatctgttaaaagataacgcaggtgtcctaagatgagctcaacaagatcgagctcacccacgccgacctcgacgcgctcgtcgacgccgcggccgcgcgcctcgccgccgacgccggggtccgcccgggacacgtcgtcgcgctctccttccccaacaccatcgagctggtgatcatgttcctggcggtgatccgcgcccgcgccgtggcggcgccgctcaacccggcctacacccaggacgagttcgagttctacctctccgactccgagtcccgcctcctcatcaccaacgccgagggcaaccccgccgcgcaggccgccgccgccaagctcggcctgccccacgccgcagccaccctcaaggacgccgccggccccgtccacctcgccggcctgggctgcgcggccgccaacgggaacgggaacgcgaacggctcccactccaacaaacaagacgacaacaacgagccgtccgacgtggcccttttcctgcacacctccggcacgacgagccggcccaagggggtgccgctgacgcagggcaacctggcggcgtccgtgggcaacatccggtccgtgtaccggctgacggaggaggacgccaccgtggtggtgctgccgctgttccacgtgcacggcctcctgtgcgggctcctgagctcgctggccttcgggcgcgtc

SEQ ID NO: 36586 - protein, 168 aa, Panicum virgatum
  misc_feature: Ceres CLONE 1986025
  misc_feature: SWISSPROT Homolog: EC 6.2.1.26 o-succinylbenzoate--CoA ligase
MFLAVIRARAVAAPLNPAYTQDEFEFYLSDSESRLLITNAEGNPAAQAAAAKLGLPHAAATLKDAAGPVHLAGLGCAAANGNGNANGSHSNKQDDNNEPSDVALFLHTSGTTSRPKGVPLTQGNLAASVGNIRSVYRLTEEDATVVVLPLFHVHGLLCGLLSSLAFGR

SEQ ID NO: 36587 - DNA, 1408 bp, Panicum virgatum
  misc_feature: Ceres CLONE 1986031
  misc_feature: Encodes the peptide sequence at SEQ ID NO. 36588
ctctccattcttcctctgttccccccaaaacacatttctttccttccttgctttcctaccttctcgctcgcttgcgtgtccccgtccattcctcagcactaaccctctctttccccccaacaatgccgccgtggaggcagcgtgcgcgcggcctccggcggtgctagatccgcagctaagcagagcgacgcgcgccgagccaaggcacctcgagcagcggcggcgaagaagaagaagaagaagaaggcgcaggaggaggcgtggccgccgcgacaggcgggggcgtccaatgcacgagcacacccgcgtcagggcctgggaggcgacggtgcgcaaggtgcagcttccccagcccgtgggccggcgccgggtgtccccgatgtcggccgcggaggactccgagacggcgtcctcctcggcgtcgtcctcgtcgggcggcggcgacgacggcgagcacgtgcacgggtacgtggagcgcggcctccccaacggcgacttctacacgggccagtggcgcggcggcgctcctcatggggcggggaagtacctgtggacggacgggtgcatgtacgagggggagtggcggcacggcaaggccactggccggggcaagttctcctggccgtcgggcgccacctacgagggcgagttcaaggacggcttcatggacggctccggcacctacaccggcgccgccggggacacctacagggggtcctggtccatgaacctcaagcacggcaacggcaccaagagctacgccaacggcgaccagtacgacggcgagtggcgcgcggggctgcaggacggcgccggccgctacacctggcggaacggcaccgagtacacggggcagtggcgcgcggggctcatccacggccgcggcgcgctcgtctggtccaacagcaaccgctacgacggcgggtgggaggacggctgcccccgcggtcagggaaccttccgctgggccgacggcagcgtctacgtcggctactggacgcgggacagccccaccgacattgtccagcagaagggagtctactacccatccccggcggcgtcctccccaacggcgcgcgatccccgcgacgtgttcgcgagagacctgccgacctttatgggcaccagctccaactcagcgtcgccgcgcaaggcacggacgtcgtcggtgaacaggacgaccaacgggcgagcgagctcggtgtccgggctgagcaacagctccggcggcgaccggaagtacgacaagatttgcatttgggagtccgacggcgacatcacgtgcgacattgtggacgggcctgccttgggggacgaggcggtgtccgtgcggaggagcgtgaggacggacgacggtggtgacaaccggggactgctgccgtcctcgccggcgccgcacatcacccag

SEQ ID NO: 36588 - protein, 372 aa, Panicum virgatum
  misc_feature: Ceres CLONE 1986031
  misc_feature (117)..(139): Pfam Name: MORN Pfam Description: MORN repeat
  misc_feature (94)..(116): Pfam Name: MORN Pfam Description: MORN repeat
  misc_feature (71)..(93): Pfam Name: MORN Pfam Description: MORN repeat
  misc_feature (140)..(162): Pfam Name: MORN Pfam Description: MORN repeat
  misc_feature (163)..(185): Pfam Name: MORN Pfam Description: MORN repeat
  misc_feature (186)..(208): Pfam Name: MORN Pfam Description: MORN repeat
  misc_feature (209)..(231): Pfam Name: MORN Pfam Description: MORN repeat
  misc_feature: SWISSPROT Homolog: EC 2.7.1.68 1-phosphatidylinositol-4-phosphate 5-kinase
MHEHTRVRAWEATVRKVQLPQPVGRRRVSPMSAAEDSETASSSASSSSGGGDDGEHVHGYVERGLPNGDFYTGQWRGGAPHGAGKYLWTDGCMYEGEWRHGKATGRGKFSWPSGATYEGEFKDGFMDGSGTYTGAAGDTYRGSWSMNLKHGNGTKSYANGDQYDGEWRAGLQDGAGRYTWRNGTEYTGQWRAGLIHGRGALVWSNSNRYDGGWEDGCPRGQGTFRWADGSVYVGYWTRDSPTDIVQQKGVYYPSPAASSPTARDPRDVFARDLPTFMGTSSNSASPRKARTSSVNRTTNGRASSVSGLSNSSGGDRKYDKICIWESDGDITCDIVDGPALGDEAVSVRRSVRTDDGGDNRGLLPSSPAPHIT

SEQ ID NO: 36589 - DNA, 326 bp, Panicum virgatum
  misc_feature: Ceres CLONE 1986031-R
acacacacacacccccccccacacacacacacacacccccccccccccgcgcgcgcgcgcgcgccccctctcctctctcccctcccccacacaaaaaacacccccccccccccccccatatatatatatatatacatatatatatatatatatatatacatatacatatatatatatatatatatagctcacaatatttttgtagggtaggagatgttaacttactgattcagcttacagatagaaaaattgtaacacaagcgcgcaagccagtccggagatgtaaatgtttttttaccgaggttagcatgcatcaggtcaggtac

SEQ ID NO: 36590 - DNA, 1469 bp, Panicum virgatum
  misc_feature: Ceres CLONE 1986032
  misc_feature: Encodes the peptide sequence at SEQ ID NO. 36591
acgcacgccaccgcgcctgccttgcctgcctgcctgcctgtcgtctgcggcggccgcccaccggcctgcctccgccttctcctccgtcgcctcgggatccccagagcagcgactcggcataggggaatgtcccgggcgctgctgcgactccccgcgcgcagccagccaccgcgcctccccgcgccgcgagagccgccgcatttattcgccagctagacgggggcacgcctcgcgagagtccccagcccggcccagacgctatatagcgaggtcgccggagctggtagccctcgatccggagccgaccggggactgcctccttgccgttgagctcttgctcgcccggcgtcgcgatgggggctgcccgcggccgccgggtgctggccctcggcctcgcgctgctcgtggtgctccgtggctgcgcggcccaagggggggacggcggctccgacgccccggccgcggcggcggcgccggccacggcgccgatggaggagaagcagcgggcggcgctgtacgcggctatcgagggcttcgtcggcaagggatggaacggctccgggctctaccccgacccctgcggctggtcgcccatccagggggtgtcatgtgatctgttcaacggcttgtggtacacaacgtcgatcagcattggcccagttcttgacaactcgctgcagtgcgcccctgacgccaggttcagcccccagctgttcgacctgaggcgcctccggacgctctccttctacagctgcttcccggcgagcaaccccacggccatccccgccgccagctgggagaggctgtcggggagcctcgagacgctcgagttccgcaccaacccgggcctcaccggcgccatcccggcctccctcggccgcctggccagccttcagtcgctggtgctcgtcgagaacaacctgaccggacccgtgcccgccgagctcggcgcgctgctgaagctgaggcggctggtgctctccgggaacgggctgtcggggccgatcccggcggcgctcggtaactcccgccacgacgagctgctgatcgtggacctgagcaagaaccatctaacggggtctctgcctgcatcgctaggtggcctgagggagctcctcaagatggacctgagcaacaaccagctggacggcagcatcccgccggagctcggcgggctccggaatctcacgctgctcgacctcaggaacaacagcctaaccggcgggctgccccagttcgtgcaaggcatggagtcgctgcaggacctgctgctctcgaacaacccgctgggctgcagcctgccgccgtccgggtgggagaagctgggcgacctcgccatgctggacctgtccaacgtcggcctgaccggcgccataccggagtccatggcggcgctggccgggctgcggttcctggcgctggaccacaaccggctgacgggccccgtgccggcgaggctcgcgcagctg

SEQ ID NO: 36591 - protein, 371 aa, Panicum virgatum
  misc_feature: Ceres CLONE 1986032
  misc_feature: SWISSPROT Homolog: EC 2.7.11.1 Non-specific serine/threonine protein kinase
MGAARGRRVLALGLALLVVLRGCAAQGGDGGSDAPAAAAAPATAPMEEKQRAALYAAIEGFVGKGWNGSGLYPDPCGWSPIQGVSCDLFNGLWYTTSISIGPVLDNSLQCAPDARFSPQLFDLRRLRTLSFYSCFPASNPTAIPAASWERLSGSLETLEFRTNPGLTGAIPASLGRLASLQSLVLVENNLTGPVPAELGALLKLRRLVLSGNGLSGPIPAALGNSRHDELLIVDLSKNHLTGSLPASLGGLRELLKMDLSNNQLDGSIPPELGGLRNLTLLDLRNNSLTGGLPQFVQGMESLQDLLLSNNPLGCSLPPSGWEKLGDLAMLDLSNVGLTGAIPESMAALAGLRFLALDHNRLTGPVPARLAQ

SEQ ID NO: 36592 - DNA, 697 bp, Panicum virgatum
  misc_feature: Ceres CLONE 1986032-R
cccaacatcggggccctgtacctgacggcaacaaacctgacgggcgcgctggagttcgcgccggggttctaccagcggatggggcggcgcttcgcgtcgtgggacaacccggggctgtgctacgacgtcgcggccgtggacgcggcgcacgcgccggcgggggtggtggtgtgcaaggacctgcaggagcccagcgtcccgcgggacggggaggacggcgggggcaggaagcccgaggcgagctcgagcctcgtggcgtcgtcgtcggccgggttctcggctgccagggccggcgggttctggtccgtggtttccgttcagggcaccgtggcagcgtttcttgggttggtgctcctatagcagcggcaggttcagacagttcagacttcagacagatggaacgggagaagaacatggagaaacttgtagagtagttgagcgcagaccagtttctgtgtgttctctgatcttttgccctttttggttggtgcttttgctcgtcaagggatacggggaaggagggagcatggatggctggacatgtctggtggctcagccagattacagtagagggtgagttctgaaagtgtgtagtgatgacagggttggttgttctgtgtaattagcctgtgttctcatctgacgttttccaacgtgaagtggataattagccaccatccttgggtttggatgatag

SEQ ID NO: 36593 - DNA, 658 bp, Panicum virgatum
  misc_feature: Ceres CLONE 1986039-R
  misc_feature: Encodes the peptide sequence at SEQ ID NO. 36594
atgatggccaagtgtgaccctcgccatggcaagtacatggcctgctgcctcatgtaccgtggagatgttgtgcccaaggatgtgaatgctgctgtggccaccatcaagaccaagcgcaccatccagtttgtggactggtgcccgactgggttcaagtgcggcatcaactaccagcctcccagtgtggtgcctggtggtgatctggccaaggtgcagcgtgccgtgtgcatgatctccaactccaccagtgtggttgaggtgttctcccgcatcgaccacaagtttgacctcatgtatgccaagcgcgccttcgtgcactggtacgtgggtgagggcatggaggagggtgagttctccgaggcccgtgaggaccttgccgcgctggagaaggactatgaggaggtcggtgctgagtttgacgatggtgaggagggtgacgagggtgatgagtactagacccttcctggtgcatctgtgtcaggcctgcgtgctgctattatccagtgatctgccttagtggctcgtgctatcgtgttatgtgttgtctgtcggtttgaactatcagttgtgttaacgtgtggtttacaacacctgatgttgtaagaactctatgttgaatttcctgctctgctactgggtaatgaatgtcgttatgatc

SEQ ID NO: 36594 - protein, 150 aa, Panicum virgatum
  misc_feature: Ceres CLONE 1986039-R
  misc_feature (1)..(92): Pfam Name: Tubulin_C Pfam Description: Tubulin/FtsZ family, C-terminal domain
  misc_feature: Functional homolog of the protein sequence given in SEQ ID NO 50141
  misc_feature: Useful for making plants with altered cell wall content and/or composition
MAKCDPRHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDDGEEGDEGDEY

SEQ ID NO: 36595 - DNA, 322 bp, Panicum virgatum
  misc_feature: Ceres CLONE 1986039
atatccaccccgctaataacaaagtggcgctcgtggcttggaggaggcaaaaggaaggaagcgcagcggggagcgccagacggacgagccgagcgccaccgcctaggaaaaagccagcgcccaaaaccctagctcccgcgcgccaccgcgcagatccgggtctcccgcgcgatggctgagacggaggccgcggggtcgtcgtcgaggcggcggatggaggacgaggagggtgcggcgagtgcggcggcgatggcggcggatgcgggggcggggggcaggggtaggggggaggaggaggatggcgaggacgaggagggggaga

SEQ ID NO: 36596 - DNA, 1405 bp, Panicum virgatum
  misc_feature: Ceres CLONE 1986044
  misc_feature: Encodes the peptide sequence at SEQ ID NO. 36597
atatagaggcggcggcggagcaagtgcggcggagcaagtgcagaggcggcggcgaccatggcgggcaagcagctcaacgttctgacgacgctggaccaggcgaagacgcagtggtaccacttcatggccatcgtgatcgccggcatgggctttttcacggacgcctacgacctcttctgcatctccctcgtctccaagctgctggggcgcctctactacaccgagcccaacagccccaaccccggcagcctgccgcccaacgtgtcggcggccgtgaacggcgtcgccctgtgcggcacgctggccggccagctcttcttcggctggctcggcgacaagctcgggcgcaagagcgtctacggcttcacgctcatcctcatggtgctctgctccatcgcctcgggcctctccttcggccacacggccaagggcgtcatcgccacgctctgcttcttccgcttctggctgggcttcggcatcggcggcgactacccgctctccgccaccatcatgtccgagtacgccaacaagcgcacccgcggcgccttcatcgccgccgtcttcgccatgcagggcttcggcatcctcttcggcgccatcgtggcgctcgtggtgtccgccggcttccggaactcgtacccggcgccgccgtaccaggacgacgccgcagcttcgctcgtcccggaggccgactacgtgtggcgcatcatcctcatgttcggcaccatcccggcggcgctcacctactactggcgcatgaagatgccggagacggcgcgctacacagccctgatcgcgcgcaacgccaagcaggccgccgccgacatgtccaaggtgctcaacgaagagatcgtcgaggacgcggaccgcgccgccgagctcgacgccggcgccggcgccggcaacgagtgggggctcttctcgaagcagttcagttgccggcacgggctccacctggtggccaccaccagcacgtggttcctgctggacatcgccttctacagccagaacctgttccagaaggacatcttctccaaggtcgggtggatcccgccggccaagaccatgaacgccgtcgaggaggtgttccgcatcgcgcgcgcgcaggcgctcatcgcgctctgcggcaccatcccgggatactggttcaccgtcgccttcatcgacgtcgccggccgcttcgccatccagctcatgggcttcttcatgatgaccgtcttcatgctcggcctcgccgtgccgtaccaccactggacgacggccggccaccacacggggttcgtcgtcatgtacggcttcaccttcttcttcgccaacttcgggcccaacagcaccaccttcatcgtccccgccgagatcttcccagcgcggctgcggtcgacgtgccacggcatctccgccgccg

SEQ ID NO: 36597 - protein, 449 aa, Panicum virgatum
  misc_feature: Ceres CLONE 1986044
  misc_feature (28)..(448): Pfam Name: MFS_1 Pfam Description: Major Facilitator Superfamily
  misc_feature: Functional homolog of the protein sequence given in SEQ ID NO 50798
  misc_feature: Useful for making plants with modulated phosphate use efficiency
  misc_feature: Functional homolog of the protein sequence given in SEQ ID NO 51527
  misc_feature: Useful for making plants with modulated carbohydrate content
MAGKQLNVLTTLDQAKTQWYHFMAIVIAGMGFFTDAYDLFCISLVSKLLGRLYYTEPNSPNPGSLPPNVSAAVNGVALCGTLAGQLFFGWLGDKLGRKSVYGFTLILMVLCSIASGLSFGHTAKGVIATLCFFRFWLGFGIGGDYPLSATIMSEYANKRTRGAFIAAVFAMQGFGILFGAIVALVVSAGFRNSYPAPPYQDDAAASLVPEADYVWRIILMFGTIPAALTYYWRMKMPETARYTALIARNAKQAAADMSKVLNEEIVEDADRAAELDAGAGAGNEWGLFSKQFSCRHGLHLVATTSTWFLLDIAFYSQNLFQKDIFSKVGWIPPAKTMNAVEEVFRIARAQALIALCGTIPGYWFTVAFIDVAGRFAIQLMGFFMMTVFMLGLAVPYHHWTTAGHHTGFVVMYGFTFFFANFGPNSTTFIVPAEIFPARLRSTCHGISAA

SEQ ID NO: 36598 - DNA, 598 bp, Panicum virgatum
  misc_feature: Ceres CLONE 1986053-R
  misc_feature: Encodes the peptide sequence at SEQ ID NO. 36599
tgccggaactgacgcagcagatgtgggacgccaagaacatgatgtgcgcggcggaccctcgtcacgggcgctacctgacggcgtcggccatgttccggggcaagatgagcaccaaggaggtggacgagcagatgatcaacgtgcagaacaagaactcgtcctacttcgtcgagtggatccccaacaacgtcaagtcgagcgtctgtgacatcccgcccgtcggcctgtccatggcctccaccttcgtcggcaactccacctccatccaggagatgttccggcgcgtcagcgagcagttcacggccatgttccgccgcaaggccttcctgcactggtacaccagcgagggcatggacgagatggagttcaccgaggccgagagcaacatgaacgacctcgtcgccgagtaccagcagtaccaggacgccaccgccgaggagtacgacgacgaggaggtcgacggcgaagaggaccacgcctgatgcttgaccggacgtccaaggtcttgatcgagcttctctccttcgctatgccgatcgagaggcgttctctctatatatatacatacatcccaacaaccacctaaagtattgtacgt

SEQ ID NO: 36599 - protein, 159 aa, Panicum virgatum
  misc_feature: Ceres CLONE 1986053-R
  misc_feature (1)..(97): Pfam Name: Tubulin_C Pfam Description: Tubulin/FtsZ family, C-terminal domain
  misc_feature: Functional homolog of the protein sequence given in SEQ ID NO 50258
  misc_feature: Useful for making plants with modulated flowering time
PELTQQMWDAKNMMCAADPRHGRYLTASAMFRGKMSTKEVDEQMINVQNKNSSYFVEWIPNNVKSSVCDIPPVGLSMASTFVGNSTSIQEMFRRVSEQFTAMFRRKAFLHWYTSEGMDEMEFTEAESNMNDLVAEYQQYQDATAEEYDDEEVDGEEDHA

SEQ ID NO: 36600 - DNA, 1445 bp, Panicum virgatum
  misc_feature: Ceres CLONE 1986053
ttttgtgttcggtttcgattccctcgccgatcccgtgttccgtttccatacatggatccggccgctctcgtgccctgtttcgtgcgcggatcggatcaggcattatatatttatattggggcgtggtgctaatgcagggaacaccaccaattcggtccaaatttgtcactgaagtttcaaaattagtcacgttattaattgcaaaatctgccgcaactgccctgcgtttctgtatccagtatagaaagagggacgcacgcatttttcggaccatggtttgatttttatgtttttgtgcgaggacaggaataccaaaacattaacaccctacaggggaattcggttgcattaaacacacctacgccaacttggcagcgttggcaggcagacctccataggtaacagatcgccgagtatcaatgctgtcgatttagcgagttaaagtctggacgaatatagagtttaattcgctgccaaagcagggaattgatattttcccttgaaatctaaacacatcacctcatttactggcaggatagattgcaaggccaagaacattttcacaactagttttaaatatcacctccatttgtgtaattgtgtttcacaagtcgccgcattgtctaatgtccgttcagatgattggaatcagcatgggtcggtacttatctgaattcagcttggatgcttgttttcagttcagttacgtgactgagactatgctacacagagtcacagagtagtacttgctgattgattaatattaacataacagatatgagaaatttggtgctacacaatacattcctctgtgtgtgtgtgtgtgtgtgtgtagctaattcctaaccaaaataaatcatgaggttatgacttgagacatgcattgcagttctgaaaataagctagattaggccatgtctcatctgttccccagtttttctcatcaatatgtcctgcaactttgctattggaggtggggccaactgctttcagattaattatctttcagtgggtacaaacgaacatgatcacagccaagcagaacttattgtcatgcatttgttgtcctaccagggcaccaggctatgactaatgcaagatttaattgaccgaacacctcatttgagaaagctatttttactgaaaaaaatcatttctacttgcaaaattgtatttttgttgttcagagaagaccatcggccctttgaggtgccgaacacacatggttttgtcggtcagataccagttttcagtattgaagaaacgttacatcacctgtcaacatcttcctgggacggtgaatgcatttgagattatcacaataatgcactacttatgatattatcatgctctgattaatgacaatgtggtacaacctaccaaaataaaaaaagaaagtatctagatctgctgctactgtaatagtgtcggtggtggttgtgacg

SEQ ID NO: 36601 - DNA, 745 bp, Panicum virgatum
  misc_feature: Ceres CLONE 1986112
  misc_feature: Encodes the peptide sequence at SEQ ID NO. 36602
acccaccaccgctgccgccattagcctcctgattcccgcgccacctagtcccgaacccccgtcccatgcccgcggcagccactgaggcgcgagtgagcagagcgaggcctgatgcggcagcggcagcagggggaggagcaccaggagctgttcgtgcagtggaggccctgcgacaagaagaggtcttaggcctcgagccgagtccgtccgcggatccactcatccactcggggcgcacgtggcggcggcggcgcgcggcgaccggccgggggaagatcggaagatgagcgtgtccgtggggaagacccgggtggggaggtacgagctgggccggaccctcggggagggcaccttcgccaaggtcaagttcgccaggaacgtcgagaccagcgagaatgtcgccatcaagatcctcgacaaggagaaggtgctcaagcacaagatggtcggccagataaagcgtgagatctcgaccatgaagctcatcaggcatcccaacgtcatccggatgtatgaggtgatggctagcaagacaaagatttacatagtgatggagcttgtcaccggtggtgaacttttcgacaagattgcttcccgtggaaggctgaaagaggatgatgcgaggaagtatttccagcaggtgatcaatgctgtcgattactggcacagcagaggcgtctaccaccgtgatctcaagcctgaaaccttctgcttgatgctagtggcacactccaggtgtctgaat

SEQ ID NO: 36602 - protein, 153 aa, Panicum virgatum
  misc_feature: Ceres CLONE 1986112
  misc_feature (13)..(153): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
  misc_feature: Functional homolog of the protein sequence given in SEQ ID NO 50317
  misc_feature: Useful for making plants with modulated biomass
MSVSVGKTRVGRYELGRTLGEGTFAKVKFARNVETSENVAIKILDKEKVLKHKMVGQIKREISTMKLIRHPNVIRMYEVMASKTKIYIVMELVTGGELFDKIASRGRLKEDDARKYFQQVINAVDYWHSRGVYHRDLKPETFCLMLVAHSRCL

SEQ ID NO: 36603 - DNA, 1455 bp, Panicum virgatum
  misc_feature: Ceres CLONE 1986113
  misc_feature: Encodes the peptide sequence at SEQ ID NO. 36604
agttccagccacgcccccccgtctcccgcctgcccgtcagctacccgccggcgcgcgcagaggaagaagctcgggctaccgatcggttcccttgctggggattcggccgagggcaagggctagtccgaaaacgtaagaaacatggtagagaatggtccggatgagcaaccaaaaggggtgtctcgcaatagtccacctgctcatatgaatggtgatgaggaaaaggtttatcctggacagcttccagtgttgacctggaaacacaagctaactcatgttagacatattttgccatcattcagacttacatggagagagatgaggcagctggctggtattggtcttcgtcttggtcgacatattgttgaagaaacttcaaaaggacgaactgctgtcattgatcctatgaaaaagcgaattgcaaactccggtcaaggtgttccacttggtggcattggtgcaggaagtattggaagaagttacacaggtaacttccaacgttggcaattgtttcctggaacttgtgaggataaacctgtactggcaaatcaattttctgccttcatttcccgccaagatggtagaaaatattccacagtgttgcatcctggggaaccagatttaccaaaaggaagtgacatttcaggaattggatcctgggactggaatatgagtggacaacattctacttatcatgctctttaccctagggcctggacagtatatgatggagaacctgatcctgagctcaacatagtatgccgtcagatatctcctgtcattccacacaattatcaacagagcagctatccagctgcagtattcactttcacagtaaccaattcaggacatacagctgctgatgtgactttgctttttacatgggctaactctgttggtggaaaatctgatatcacgggatatcattccaactccagtatgatagaaaaagatggcgttcatggcatactgttacatcacagaacagcagatggtcaaccacctataacttttgcgatagctgcacaggagaaagaggatattcatatctctgaatgtccttactttgtaatatctgggagctcagatggattcacagcaaaagatatgtggaattctgtgaaagagcatggatcttttgatcatcttgatcctataaaaacttcaatatgctccaagccaggatcgtcaattggggcagctattgccgcttctcttaagattgctcccaaggcaacccgggatgtttcattttcacttgcatgggcttgtcctgaagtgaagttctccagtgggaaaacatatcacaggcgttacaccaagttttatggaacagatgttgatgcagcagcaagccttgctcgtgatgccattcttgaacatacttcctgggagaggctgattgaggagtggcaggatcctattttgcaagacaagaggttccctgcatggtat

SEQ ID NO: 36604 - protein, 437 aa, Panicum virgatum
  misc_feature: Ceres CLONE 1986113
  misc_feature: SWISSPROT Homolog: EC 3.2.1.45 Glucosylceramidase
MVENGPDEQPKGVSRNSPPAHMNGDEEKVYPGQLPVLTWKHKLTHVRHILPSFRLTWREMRQLAGIGLRLGRHIVEETSKGRTAVIDPMKKRIANSGQGVPLGGIGAGSIGRSYTGNFQRWQLFPGTCEDKPVLANQFSAFISRQDGRKYSTVLHPGEPDLPKGSDISGIGSWDWNMSGQHSTYHALYPRAWTVYDGEPDPELNIVCRQISPVIPHNYQQSSYPAAVFTFTVTNSGHTAADVTLLFTWANSVGGKSDITGYHSNSSMIEKDGVHGILLHHRTADGQPPITFAIAAQEKEDIHISECPYFVISGSSDGFTAKDMWNSVKEHGSFDHLDPIKTSICSKPGSSIGAAIAASLKIAPKATRDVSFSLAWACPEVKFSSGKTYHRRYTKFYGTDVDAAASLARDAILEHTSWERLIEEWQDPILQDKRFPAW

SEQ ID NO: 36605 - DNA, 718 bp, Panicum virgatum
  misc_feature: Ceres CLONE 1986116
  misc_feature: Encodes the peptide sequence at SEQ ID NO. 36606
ttccccaccgccggcgccgtcaacgctaaggttgagatcgaatgccgccgcccatggcgacctgaaattcctgccgctcttccgctgccccgggccctatctcctcatctccacgccccgggctctccgagctctgctcctgctcctgcggtcggcgcccccgtcttcggtgccgttgctgcggccgccggtgaagccgccgccggtcagccaagcatcaacgcccgccatctgttccacggaatgcctccgaggaggaagggagggaagggcaggagggcggcgcgtccgggggccggccgcatcagcatcgacgagctcccagacgaagtccttcaccacgtgctgtcgttcctgccggcgcaggaggccgtgcggacgtgcgtgttggcccggcgctggcgccacctctggaggtccgccacgggccttcgtatctcgtgcggccctgagaatgaggcggcagtgaatgtgaagaagctccgggattttgtggaccatctgttcctcctccgtggaggctcgcctctcgacacgtgccagttcaacttgcttgatattaacgaggatgatgatgacacgcgcagaatacacctctggatctggcatgttctgatgtgtagagttcgggtgctcagcctcaatatgacttggtatagcgagtgttggaccaatgtttttctctggatggtctacctctcatctcccaacacctgaa

SEQ ID NO: 36606 - protein, 157 aa, Panicum virgatum
  misc_feature: Ceres CLONE 1986116
  misc_feature (21)..(68): Pfam Name: F-box Pfam Description: F-box domain
MPPRRKGGKGRRAARPGAGRISIDELPDEVLHHVLSFLPAQEAVRTCVLARRWRHLWRSATGLRISCGPENEAAVNVKKLRDFVDHLFLLRGGSPLDTCQFNLLDINEDDDDTRRIHLWIWHVLMCRVRVLSLNMTWYSECWTNVFLWMVYLSSPNT

SEQ ID NO: 36607 - DNA, 1502 bp, Panicum virgatum
  misc_feature: Ceres CLONE 1986118
  misc_feature: Encodes the peptide sequence at SEQ ID NO. 36608
gtgactgactcgagaaaccctcgcaatctcgccccgtctcctccagtcctcctcccttaccttctccggcggcggcggcggcggcggctcacgcgcggcgaaggaacaacaagatggcgacgatcgtgaacacgacggaggaggagcccatgctggccgtggtgcgcttcaccgcggagctcgcctgggccgacgcgggcccggaggtcgccgaccccgaggtcacgcgcctctgcctcgaggcgcaggagcacatcctcgcggggcgatggctcgacatggcctctctcatgctcgcctccgccgacctgctcctcacccccccgtcgcgcgtcccggacaaagatctcgagtgcgtcctctccgtcatctgcagcctcgtcaccaaggccgggtcggaggaccaggcgctgcagatcaccgacctcatctgcgacaagctcacccagcagcccgacgacaagccggcgctgcgcctcaaggttctgttcagcttgtacaatctgcttccaagcccctacttcaaggcacttgtttacaagaaggctcttgagctcgccacggccggaaaggctgccgagtacatcatcccgtcattcaagaacatcgacagcttcgtcaacgagtggggaattggaaatttagagcagagggagctgtaccttgccatcactaggatcctcaaagatcacaagggcatgacaaaggactacttcaaatttctcaacaagtacctcgccactttcaaggggtcagatgatgactctgctacaattggtgatgcaaaggaagaggctgttgctgcaattattgagtttgttaaatcgtctaacctctttcagtgtgatctgctcaatatgccagctgttgcacagcttgagaaggatgaaaagtatcagttggtttatgaacttctaaagatattccttactaaaaggcttgattcctatttagagtttcagactgcaaactctgccttgctgaaagattacggactggttcatgaggagtgcataaccaaaatgcgcctcatatctttgctcgatctgagcagctgttgctctattgaaatcccttattcagcaatcactgaatcacttcagattaatgatgatgaggtggaacaatggattgtgaaagcaatagcattcaagatattagattgcaaggttgaccagcttaaccagactgtcatcgtcagtcggcagacggagaggatatttgggatgccacagtggcagggtctgcacacaaaacttggagtttggaagggaaacattgcgagcgctataaacacaatccaagctaacaaagtcactgaagaggacacacaagcaatgcatggcttgacgatccactgacttaggcgagtttgggagtttatagctcgagggattagataagaaattttgtatgacaacttgtaatctgagttaggcactgatggtactggatagatttcagttacaatgcatgctccggaacaccacggcggcaggaaa

SEQ ID NO: 36608 - protein, 415 aa, Panicum virgatum
  misc_feature: Ceres CLONE 1986118
  misc_feature (262)..(364): Pfam Name: PCI Pfam Description: PCI domain
MATIVNTTEEEPMLAVVRFTAELAWADAGPEVADPEVTRLCLEAQEHILAGRWLDMASLMLASADLLLTPPSRVPDKDLECVLSVICSLVTKAGSEDQALQITDLICDKLTQQPDDKPALRLKVLFSLYNLLPSPYFKALVYKKALELATAGKAAEYIIPSFKNIDSFVNEWGIGNLEQRELYLAITRILKDHKGMTKDYFKFLNKYLATFKGSDDDSATIGDAKEEAVAAIIEFVKSSNLFQCDLLNMPAVAQLEKDEKYQLVYELLKIFLTKRLDSYLEFQTANSALLKDYGLVHEECITKMRLISLLDLSSCCSIEIPYSAITESLQINDDEVEQWIVKAIAFKILDCKVDQLNQTVIVSRQTERIFGMPQWQGLHTKLGVWKGNIASAINTIQANKVTEEDTQAMHGLTIH

SEQ ID NO: 36609 - DNA, 713 bp, Panicum virgatum
  misc_feature: Ceres CLONE 1986120
  misc_feature: Encodes the peptide sequence at SEQ ID NO. 36610
atgctgtgtcgtcgtttaccacgccacactgcctccacataacatcccatgccgtcgtctcgccgtggcctcctcctcctccaccttgccatggtggcgagcctctccaccgtcgtaataagatccagggacagcccgttcacgaccatggaggcatacccgccgccgattgtagcgctagctgctctcgtcggagaacggctgacggctccacgagcatggttgctgctcctcctccctgtccccatcttggtcgcacgctactcgttcggtgccaagagggccaggaagatgaggccgcagcaagcagacgaccgcctaccgccatcgcctccggcgctgcccgtcctcgggcacctccacctcgtgggctcactcccgcacgtctccctccgtaacctcgcaaggaagcacggccacgacctcatgctgctccgcctcggcgccatgccggtcgtcatcgtgtcgtcgccggccgccgcgcaggcggtgctgcgcacgcacgaccacgtgttcgcgtcccggccgcactccctggtcgccgagatcgtcctctacggcccgtccgacgtcggcttcgcgccacacggcgagtactggcgccaggcgaggaagctcgtcaccacgcacctgctcaccgtcaagaaggtgcaatcgctacgccacgctcgcgagggagaagtgagcacggtgatgggccagatcggcgaggc

SEQ ID NO: 36610 - protein, 207 aa, Panicum virgatum
  misc_feature: Ceres CLONE 1986120
  misc_feature: SWISSPROT Homolog: EC 1.14.13.68 4-hydroxyphenylacetaldehyde oxime monooxygenase
MVASLSTVVIRSRDSPFTTMEAYPPPIVALAALVGERLTAPRAWLLLLLPVPILVARYSFGAKRARKMRPQQADDRLPPSPPALPVLGHLHLVGSLPHVSLRNLARKHGHDLMLLRLGAMPVVIVSSPAAAQAVLRTHDHVFASRPHSLVAEIVLYGPSDVGFAPHGEYWRQARKLVTTHLLTVKKVQSLRHAREGEVSTVMGQIGE

SEQ ID NO: 36611 - DNA, 717 bp, Panicum virgatum
  misc_feature: Ceres CLONE 1986124
  misc_feature: Encodes the peptide sequence at SEQ ID NO. 36612
ataacttgctcctccaccaaagcctaaatggcttcctcctcgtctcatgccgccgcgctgccctagaaccctcggccccccgccgctcctcctcgaattcccctctcgctccgatcggccccgctgacacgcccgcgccggatccctagccccggaattccgggccggatcgaaatcgaactgcctgcctgcctcctctctcgatcaaataacgagcgcctgaggcggttggatccccgggcggggggcgtctcctgatttcggtctcttctccccccgtgccgcgatgggggcgccgaagcagcgctggacgccggaggaggaggccgcgctcaaggccggcgtcgccaagcacgggcccggcaagtggcgcaccatcctcagggacccggacttcagcacgctcctgcgcctccgctccaatgttgacctcaaggacaagtggcgcaacttgagtgtcaccgcgggaggttatgggtctagggagaaggcgagaatggcgttgaagaaaggcaggcgtgtggtgcctaagcttactgctgagccaatggatgtggacgcgaatggtttggacaatgttcatgatgcggtcatcgatgctgagccattggcaatgtctgtggagcccttggcactcgagggaagtccggaaaaatcagttgctaggcttgatgacctcatattagaagccataaggaagcttaaggagcccttcgg

SEQ ID NO: 36612 - protein, 143 aa, Panicum virgatum
  misc_feature: Ceres CLONE 1986124
  misc_feature (5)..(57): Pfam Name: Myb_DNA-binding Pfam Description: Myb-like DNA-binding domain
  misc_feature: The sequence is a functional homolog of SEQ ID NO 1221 in the 10/666,642 US patent application
  misc_feature: The sequence is a functional homolog of SEQ ID NO 1220 in the 10/666,642 US patent application
  misc_feature: Functional homolog of the protein sequence given in SEQ ID NO 51343
  misc_feature: Useful for making plants with altered alkaloid content
  misc_feature: The sequence is a functional homolog of SEQ ID NO 1526 in the 10/666,642 US patent application
  misc_feature: The sequence is a functional homolog of SEQ ID NO 1374 in the 10/666,642 US patent application
MGAPKQRWTPEEEAALKAGVAKHGPGKWRTILRDPDFSTLLRLRSNVDLKDKWRNLSVTAGGYGSREKARMALKKGRRVVPKLTAEPMDVDANGLDNVHDAVIDAEPLAMSVEPLALEGSPEKSVARLDDLILEAIRKLKEPF

SEQ ID NO: 36613 - DNA, 1358 bp, Panicum virgatum
  misc_feature: Ceres CLONE 1986127
  misc_feature: Encodes the peptide sequence at SEQ ID NO. 36614
gaattctcccgtcaacgtacgctcatgcgttcgcctctgcaatatatctcgcgtgcagcggagaacgctgcgctctgcgtaaaaattaggttgtttcgccttccagaaccccgtttggatcaagcaactgctctgctggtcttcaacgccgcgcctctccaagaaggagggcagttgctctctctctctctctctctctctctctctctctctctctctctctctctgaaaaaactcaacttgccgcaccacgtgagggcaacgtcgacgaccacggcgcgggcggcaccggcgccacgacgctgctcgctcgatcactcctcgctcacggccttgttggtgggtgagggcgtgaggaggtgaggtggccatgggcaccgcggcggcggcggcggcggcggacgtggtcatcccggcgtgcgcggcggttggcatcgccttcgcgctgtggcagtggttcctcgtctccaaggtgaaggtgtcggcctacgcggcggcgcccggcaacggccaccacgggggccccgtcttccggatggaagacgaggacgaggacatcggcatgggcggcggccacgacgacgacgaggaggagggcgccggcgaccgcaccgtcgccgtggcgcggtgcgcggagatccagagcgccatttcggttggagccaactcgttccttttcacgcaatacaagtacctggccgccttcactgcgatcttcgcggtggtgatcttcctcttcctgggctccgtgcaccggttcagcaccgacagccggccatgccagtacaccagcggccggacctgcaagccggcgctcgccaacgcgacgttcagcgccatcgccttcctcctcggcgccgccacctccgccgtgtccggctacctgggcatgcggatcgccacgtacgcgaacgccaggaccaccctggaggcccggcgcggcatcggcgcggcgttcaccactgcgttccggtccggcgccgtcatgggcttcctcctagcctccctcggcctcctcgtgctctacggcaccatcaaggccttcggcctctactacggcgacgactgggagggcttgtacgagtcggtgacgggctacggcctcggcggctcgtcggtggcgctgttcggacgcgtcggcggcggcatctacaccaaggcagcggacgtcggcgcggacctcgtcgggaaggtggagcgcaacatccccgaggacgacccgaggaaccccgcggtgatcgcggacaacgtcggcgacaacgtcggcgacatcgccgggatggggtccgacctcttcggctcctacgccgagtccacctgcgcggcgctcttcgtggcgtccatctcctcgcccggcg

SEQ ID NO: 36614 - protein, 329 aa, Panicum virgatum
  misc_feature: Ceres CLONE 1986127
  misc_feature (7)..(329): Pfam Name: H_PPase Pfam Description: Inorganic H+ pyrophosphatase
  misc_feature: SWISSPROT Homolog: EC 3.6.1.1 Inorganic diphosphatase
  misc_feature: Functional homolog of the protein sequence given in SEQ ID NO 50264
  misc_feature: Useful for making plants with modulated water use efficiency
MGTAAAAAAADVVIPACAAVGIAFALWQWFLVSKVKVSAYAAAPGNGHHGGPVFRMEDEDEDIGMGGGHDDDEEEGAGDRTVAVARCAEIQSAISVGANSFLFTQYKYLAAFTAIFAVVIFLFLGSVHRFSTDSRPCQYTSGRTCKPALANATFSAIAFLLGAATSAVSGYLGMRIATYANARTTLEARRGIGAAFTTAFRSGAVMGFLLASLGLLVLYGTIKAFGLYYGDDWEGLYESVTGYGLGGSSVALFGRVGGGIYTKAADVGADLVGKVERNIPEDDPRNPAVIADNVGDNVGDIAGMGSDLFGSYAESTCAALFVASISSPG

SEQ ID NO: 36615 - DNA, 669 bp, Panicum virgatum
  misc_feature: Ceres CLONE 1986127-R
  misc_feature: Encodes the peptide sequence at SEQ ID NO. 36616
cgtgaacgtgcttgaccccaaggtgttcgtgggtctcctcgtcggcgccatgctcccctactggttctcggcgatgacgatgaggagcgtgggcagcgccgcgctcaggatggtggaggaggtgcgccgccagttcgccgccatcccgggcctcatggagggccgcgccgcgccggactacgcgcgctgcgtccggatctccacggacgcctcgctccgggagatgatgccgcccggcgcgctagtgctgctcgcgccgctgctcgccggcaccttcttcggcgtccgcacgctcgccgggctgctcgccggcgcgctggtctccggcgtccagatcgccatttctgcttccaacagtggcggagcatgggacaatgccaagaagtatatagaggcaggtgcgtccgaccacgccaagtcactgggtcccaaggggtcggacgctcacaaggccgccgtgatcggcgacaccatcggcgacccgctcaaggacacgtcggggccgtccctcaacatcctgatcaagctcatggccgtcgagtccctcgtgttcgcgccattcttcgccgcccatggcggcctgatattcaagtaggcaggggatatgagagccttctaacaatgtgcaccttgatgagcatgttggacaacacagttatctcaaccagc

SEQ ID NO: 36616 - protein, 197 aa, Panicum virgatum
  misc_feature: Ceres CLONE 1986127-R
  misc_feature (1)..(185): Pfam Name: H_PPase Pfam Description: Inorganic H+ pyrophosphatase
  misc_feature: SWISSPROT Homolog: EC 3.6.1.1 Inorganic diphosphatase
  misc_feature: Functional homolog of the protein sequence given in SEQ ID NO 50264
  misc_feature: Useful for making plants with modulated water use efficiency
VNVLDPKVFVGLLVGAMLPYWFSAMTMRSVGSAALRMVEEVRRQFAAIPGLMEGRAAPDYARCVRISTDASLREMMPPGALVLLAPLLAGTFFGVRTLAGLLAGALVSGVQIAISASNSGGAWDNAKKYIEAGASDHAKSLGPKGSDAHKAAVIGDTIGDPLKDTSGPSLNILIKLMAVESLVFAPFFAAHGGLIFK

SEQ ID NO: 36617 - DNA, 730 bp, Panicum virgatum
  misc_feature: Ceres CLONE 1986137
  misc_feature: Encodes the peptide sequence at SEQ ID NO. 36618
aaagagacagagagagcgagaggtctcgccgtgccgtgccgtgctcgcctgatcatcgtgtcgccgaggccgccattctaaatttggcagcgaattaatcagcagccagccattacttactgcctcgccgcagttattccttccgttgccgttgccgtttccgcttcgccagtggaggataagaagcagcctgctggtggatcttggagagagttcatcgtcggaggaggtcgatcatcatgagggattgattgattgatctatgtgctgcgtctgcgccgccgccgccggagtttgtggaggaggaggagaggaggggcggcgccggctgcaggtggttgatcgttgggctcggttcttgcaatgagcgacgtctcgggccgcttcgtggtggccgcggccgtggtcgccgtgtcgctggcggcggcggcggcgacggcggcgcacgactacggcgacgcgctgtccaagagcctgctctacttcgaggcgcagcggtcggggcggctgccgtacaaccagcgcgtgcggtggcgcggccactcggggctcaccgacggcctcgagcagggggtggacctcgtcggcgggtactacgacgccggcgaccacgtcaagttcggcctccccatggcgttcaccgtcacccttctctcctggggcgtcctcgagtacggcgctggcgtgtccgcccgcgccgagctcgcgcacgcgctgcaggccatcaagt

SEQ ID NO: 36618 - protein, 122 aa, Panicum virgatum
  misc_feature: Ceres CLONE 1986137
  misc_feature: SWISSPROT Homolog: EC 3.2.1.4 Cellulase
  misc_feature: Functional homolog of the protein sequence given in SEQ ID NO 51344
  misc_feature: Useful for making plants with altered carbohydrate content
  misc_feature: Functional homolog of the protein sequence given in SEQ ID NO 51345
  misc_feature: Useful for making plants with altered cell wall content and/or composition
  misc_feature: Useful for making plants with altered lignin content
  misc_feature: Functional homolog of the protein sequence given in SEQ ID NO 51323
  misc_feature: Useful for biocontainment applications
  misc_feature: Useful for making plants with modulated nitrogen use efficiency
MSDVSGRFVVAAAVVAVSLAAAAATAAHDYGDALSKSLLYFEAQRSGRLPYNQRVRWRGHSGLTDGLEQGVDLVGGYYDAGDHVKFGLPMAFTVTLLSWGVLEYGAGVSARAELAHALQAIK

SEQ ID NO: 36619 - DNA, 1955 bp, Panicum virgatum
  misc_feature: Ceres CLONE 1986139
  misc_feature: Encodes the peptide sequence at SEQ ID NO. 36620
gcatcggcccatgtctctctcctccgccggccacctccccctcccgacccgaccaaccccgaaccccacttccgattagatgcaacaccaccaccacctccccaccgccgccgcctccgcgccggagccggcggcggacaccccgcccccgccggtccccgatccctcctccctccgcatccacatcccgtcgagcccgcaccacgcgctgccctccaccccgcacaagcgccccgtcgtcatgacctcctcctcctcgtcgtccacccccactcgcccctcgccgtcgcccttcaccccgccgcggaggcgcaaggtccccgcgcccgcgccccccgcgggggaggccgcggccaggcacctcctccgctgcctgcacctccgcctgcgcatcctcctcctcatctcgctccccaccctctacttcctctccccgacccccgccatcctcccgcgctccctcctcgccgacttcctctccgccgcggccttctcctgcgcgctactcctcctcctctgcctctccctgccccgcctacccttcgcgctgccgctcccgctccgccgcgcgcgccgatccccgatcctctggtccatcggctcctcgccctccgcgtcggcgaccacccctaccaccggccatttcgtccaggtgtacagcaacggcgacgtctacgagggccagttccaccgcggccgctgcacgggcagcggcgtctactactactacatgagcgggaggtacgagggggactgggtcgacggcaagtacgacggctttggcgtcgagacctgggctagggggagccggtacaggggccagtaccgcaaggggctcaggcatggctacggagtctacaggttctacaccggggatgtgtatgcaggggagtggtccaacggccagagccatgggtatggcgtgcacacctgtgaggatggcagccggtacatgggagagttcaagaggggcgtcaagcatggcctcggccactaccatttcaggaatggtgacacctacgctggagagtactttgctgataggatgcatggctttggagtctacagttttgccaatggccatagatatgagggagcatggcatgagggcagaagacagggtttaggcatgtatagtttcaggaatggagagatgcaagctgggcactggcaaaatggagttctggatacgttaagcactcagaactttatccctggatcgcctattgctgtgaaccattccaaggtcctcaacgcagtgcaggaagcgagaagagctgcagagaaggcctatgacatcccaagagtagatgataaggtgaacagggctgttgcagcagctaataaagcagccaacgcagccagggtggcttctgtgaaggctgcacaaaagcgcatccccaataacggcgacgatctaccactgtcagtagtgtgacaatgatgccaacataaggttggcatgaagctgcttcgcgatgccatcgcatcaccaaatgcccgacaaaacctccggcttccaggtaggggatgccgctgctcaatcatcgggccatggcggcatttgagtgactgcccgctgatttcagctttgagagcagaccaagtttgctgccaccccttacatacatctttgtggtgacttttgcgacgtagcagaactcctgctcggagaactttccattgtcgaaggcaactggttgaggtcagtattaggtcccccctgctttttcttcagtgcaatactcaccctatgttagagatatgacgatgtacaccccaacatctggagacaaaacatgtttcttgtctctcttcaagcatgtacagaacctacatgtttcgtggttgccggccgtgctggttggagataccttcagcccttcacgttccgcccgccactggttgtactttgtaccagaacgcataaagatatgacgatcatgagtgcctcc

SEQ ID NO: 36620 - protein, 235 aa, Panicum virgatum
  misc_feature: Ceres CLONE 1986139
  misc_feature (5)..(27): Pfam Name: MORN Pfam Description: MORN repeat
  misc_feature (51)..(73): Pfam Name: MORN Pfam Description: MORN repeat
  misc_feature (97)..(119): Pfam Name: MORN Pfam Description: MORN repeat
  misc_feature (74)..(96): Pfam Name: MORN Pfam Description: MORN repeat
  misc_feature (28)..(50): Pfam Name: MORN Pfam Description: MORN repeat
  misc_feature (120)..(142): Pfam Name: MORN Pfam Description: MORN repeat
  misc_feature: SWISSPROT Homolog: EC 2.7.1.68 1-phosphatidylinositol-4-phosphate 5-kinase
MSGRYEGDWVDGKYDGFGVETWARGSRYRGQYRKGLRHGYGVYRFYTGDVYAGEWSNGQSHGYGVHTCEDGSRYMGEFKRGVKHGLGHYHFRNGDTYAGEYFADRMHGFGVYSFANGHRYEGAWHEGRRQGLGMYSFRNGEMQAGHWQNGVLDTLSTQNFIPGSPIAVNHSKVLNAVQEARRAAEKAYDIPRVDDKVNRAVAAANKAANAARVASVKAAQKRIPNNGDDLPLSVV

SEQ ID NO: 36621 - DNA, 1358 bp, Panicum virgatum
  misc_feature: Ceres CLONE 1986144
  misc_feature: Encodes the peptide sequence at SEQ ID NO. 36622
aggaccgatcggtaatgttaaccctgtgtctacctcgtctcgacctgcagctacagcctacagctacctttcttcgcccccctcaaaatcctccaaccaattccactggcttctcggctcaaatccgccccgaaacctcccagcgcccgcaccgtccgccagggtcgtgcgcgatcggcagctgccccggcgctccagatcgagggaaaggagaccgctttggcggttccggcgggcgaatctagcggcgattcgctcagatttggatttagggttttggaggtagtagtgggcttgtgccgcacgggagagatgtcggcggctgtggcgtgcgcggagagggcgaccaacgacatgctcatcggcccggactgggcggtcaacatcgagctctgcgacatcatcaacatggatcctggacaagcaaaagatacactcaagcttctaaagaaacgtcttggaagcaagaattcaaaagttcaaattctgacactttatgtgctggagacactaagcaaaaattgtggggatgttgttcaccaactgattgttgaacgcgacatattaagtgaaatggttaagatagtaaagaaaaagccagatttaaatgttcgggagaagatattgagtttgattgacacatggcaagtggcttttggaggtccttctggaagatatccccagtatcatgcagcttaccaagaactcagggctgctggtgttgattttccacctcgcgaagaaaattcggtcccactgtttacacctcctcaaactcagccattgagacatccacatttatatccacctccaggtcaaagctatgaagatgctgccatagaagcttctcttcaatctgccccttctgtacctgccctgagtctaagtgagattcaaagtgctcgtggaattgtggatgtgctggatgagatgttaaatgctctggaccacaggcatcctgagggtgtgagggaggaggtcattgttgaccttgttgggcagtgccgatcgtatcaatctcgtgtcatggatcttgttaacagtaccggtgatgagagccttttatttcaggctctaggactaaatgatgaattacagcgtgttgttcagcgccatgatgacatagcaaagggggttcctcctggtacaggagcaactgcccctgcttctgcaaatgtaaaccaagggactgctcctcctaggtccactggggtttcattttctccacttttaaatgtacatgaggatgatgagccggaagacgagttctctgtgctttcccgcaggtctgcaagggatggcacagcagcccagagcaatctgccttctgctccgagaagtgaaagggcatacacaag

SEQ ID NO: 36622 - protein, 348 aa, Panicum virgatum
  misc_feature: Ceres CLONE 1986144
  misc_feature (2)..(136): Pfam Name: VHS Pfam Description: VHS domain
  misc_feature (184)..(281): Pfam Name: GAT Pfam Description: GAT domain
MSAAVACAERATNDMLIGPDWAVNIELCDIINMDPGQAKDTLKLLKKRLGSKNSKVQILTLYVLETLSKNCGDVVHQLIVERDILSEMVKIVKKKPDLNVREKILSLIDTWQVAFGGPSGRYPQYHAAYQELRAAGVDFPPREENSVPLFTPPQTQPLRHPHLYPPPGQSYEDAAIEASLQSAPSVPALSLSEIQSARGIVDVLDEMLNALDHRHPEGVREEVIVDLVGQCRSYQSRVMDLVNSTGDESLLFQALGLNDELQRVVQRHDDIAKGVPPGTGATAPASANVNQGTAPPRSTGVSFSPLLNVHEDDEPEDEFSVLSRRSARDGTAAQSNLPSAPRSERAYT

SEQ ID NO: 36623 - DNA, 563 bp, Panicum virgatum
  misc_feature: Ceres CLONE 1986144-R
cggcaaagtatggccagaggcagcagtacttcgagcagagcgtgtattctggcgggagcaatgggggcggcagctacgatagactcgtgacacagacagagaatctctccctcaaccagaatgagaagagcagcacatcatcacggccggcggcatcccgccagaccaaacccgaggactccctcttcaaggaccttgtcgactttgcgaaggccaagccgtcagcgccgtcgaaaccagccaacagccgccggactcgctgagccagctcgtgcgacgcacgcgcaaagctcagcgggcctaggtgatgctgtcaaaataagagccatttgaagactggattccttctgcatcgcgaattgttccggttgcattttcgagaatttaagagccgcagatttcagatactatgatacttggccataatccagggtgcgtagttagctgctctcaaacttccattgctgttggcttcacctccatttttttctctcgcacttagctgtgtatatatatgctactcggattcgacagtgatattcatagtttgagtttgcaattcg

SEQ ID NO: 36624 - DNA, 299 bp, Panicum virgatum
  misc_feature: Ceres CLONE 1986150
  misc_feature: Encodes the peptide sequence at SEQ ID NO. 36625
ctacttcgcagaccggtccaaatccccaactgaaattttgcgcccaggcccttcgccggagatggcgtcggagctcacgtaccggggcggcgccgcggcgcacggctccgcctccaacggcggggagtactccccgaagccctccaagccgctctcctggctctcgcgcgccgcccgctacgccgccgccgagcaccgccccgtcttcgccctcgccggcatgctcttcgccgccgccctcttcaccttctcctcctcctcctccaccaccaccacctccagtacctaagcggtgtgat

SEQ ID NO: 36625 - protein, 75 aa, Panicum virgatum
  misc_feature: Ceres CLONE 1986150
  misc_feature: Functional homolog of the protein sequence given in SEQ ID NO 50981
  misc_feature: Useful for making plants with altered carbohydrate content
MASELTYRGGAAAHGSASNGGEYSPKPSKPLSWLSRAARYAAAEHRPVFALAGMLFAAALFTFSSSSSTTTTSST

SEQ ID NO: 36626 - DNA, 671 bp, Panicum virgatum
  misc_feature: Ceres CLONE 1986151
  misc_feature: Encodes the peptide sequence at SEQ ID NO. 36627
aaaaaaaaaaaattccgcccccctctcttcttcaatcctccccgcgccggagttggagggagaggggagacgctttccgccgccaacccagcggcccgtgtcgccgatccgcgcgccgagccgatccggttgatcgaacacatcactgtctttactctttagggaagcccattgaacagtagtttgtaccacaaatcagataattctgtcacagcatggcctcggcaggggtgacacgctcttctgtgggatttcagaatgacacaagttctagcagtgatgcagatcgacttccgaacgagttgggcaatatgaacattagggatgataaggacattgaagatattgtggtcaatggcaatgggacagagcctggtcatatcatagtgactagcattgatgggagaaacgggcaggctaagcagaccattagctacatggcggagcgcgtggtaggtcatgggtccttcgggactgttttccaggcctactgtctggaaactggtgagactgtagctataaaaaaggttcttcaagacaagagatataagaaccgtgagctgcaaactatgcgagtgcttgaccacccaaatgtggttgctctgaagcactgtttcttttcaaagactgagaaggaggaactttacctcaatttggtgcttgagtatgtg

SEQ ID NO: 36627 - protein, 151 aa, Panicum virgatum
  misc_feature: Ceres CLONE 1986151
  misc_feature: SWISSPROT Homolog: EC 2.7.11.1 Non-specific serine/threonine protein kinase
  misc_feature: Functional homolog of the protein sequence given in SEQ ID NO 50366
  misc_feature: Useful for making plants with modulated water use efficiency
  misc_feature: Functional homolog of the protein sequence given in SEQ ID NO 50365
  misc_feature: Useful for making plants with modulated biomass
MASAGVTRSSVGFQNDTSSSSDADRLPNELGNMNIRDDKDIEDIVVNGNGTEPGHIIVTSIDGRNGQAKQTISYMAERVVGHGSFGTVFQAYCLETGETVAIKKVLQDKRYKNRELQTMRVLDHPNVVALKHCFFSKTEKEELYLNLVLEY

SEQ ID NO: 36628 - DNA, 732 bp, Panicum virgatum
  misc_feature: Ceres CLONE 1986158
  misc_feature: Encodes the peptide sequence at SEQ ID NO. 36629
gatagattaacagcaaatcccgaaatcgcagcgcgaaattaaacaaaaccggaacggcggatacaataagcagctgctgcggccggcagcagctccaccgcaagcagccgccaccgtcacgccaccgcgccgagagggaaaagccgagagcggtggcaggcgaggaggggacggacgaaagggggaaatcgcctgcctgcctgccgcggtgggttggtggctgccgcctccgcatcctctgctcagttccccagcccacccccattcacctcgcctgacctcgcatggattcccgctcgcttcccctccactccacgcgccgatccgccgccacctgccaggagagcgcgacgcgatccaattgaggtgcaggaggcgggggcgccctgcctgctgcctgcgtgcttcccctccagtatccgcccgggcctggccgcgctgccgctggacgccatcgcgcgcctgcacggcgtcttggggcggtcggagcagccgccgccacgcgggcgacccggcgcgaggaagcggtggccgagccgggggagcgcgatgctgtgggtgacgcgcctgtccggcttcttctccgccgccatggtgatggtggtgctgtcgccgtcgctccagtccttcccgcccgccgaggctatccggtcctcgcagttcgacggcagcgtccgcttcccgggccagatcgcgggcggcgcccgggggatcgcctcccgccgcgccccg

SEQ ID NO: 36629 - protein, 60 aa, Panicum virgatum
  misc_feature: Ceres CLONE 1986158
  misc_feature: Functional homolog of the protein sequence given in SEQ ID NO 50891
  misc_feature: Useful for making plants with altered carbohydrate content
  misc_feature: Functional homolog of the protein sequence given in SEQ ID NO 50892
  misc_feature: Useful for making plants with altered cell wall content and/or composition
MLWVTRLSGFFSAAMVMVVLSPSLQSFPPAEAIRSSQFDGSVRFPGQIAGGARGIASRRA

SEQ ID NO: 36630 - DNA, 1842 bp, Panicum virgatum
  misc_feature: Ceres CLONE 1986173
  misc_feature: Encodes the peptide sequence at SEQ ID NO. 36631
acgattgtgctttacttcatccccccgccgcgcgcggagcagcgctgccatcgtggagggagcaggcgggtcaagaatgagggggctgacgcgcgcggcgaagcgcgccggcgagatggccttcaacgccggcggaggcgccgtcaactggttcccgggccacatggccgccgcctcccgcgccatccgagaccgcctcaagcttgccgacctcgtcatcgaggtccgcgacgcacgcattccattatcctcagcaaatgaagaccttcaaccagtgcttgcagctaaaaggcgtattcttgctctaaataagaaggatcttgcaaaccccaatataatgaataggtggcttaatcattttgaatcatgcaagcaggattgtatttcaataaatgcacatagcagcagttctgttaatcagcttcttggacttgctgagctgaaactgaaggaagcaatctcgaaagagccaacacttcttattatggttgttggtgtccctaatgttggcaagtctgcactcataaattccattcacagaattgctacgtctcgatttccagtgcctgataagaacaagcgggctatggtggggccacttccaggtgtcactcaagatattgcagggtataagattgcaagtcagccaagtatttatgtgcttgatacacctggtgttcttgtgccaagcataccagatatggagacaggtctaaagcttgctttaacaggagcagttaaagactcggtagtcggagaagaacgtatagcaaaatatttattatctcttcttaatatcagaaaaacacccctgcactgggagcggttggtgcacagaagaggcgaggtgcatgaagaaacatgcagccataatgaaaatgactcaagggattcactacgaaggaggagatgtttgaataattctgatgccttatatgttcaggatttagtgacggaggtccagaggacactatgcaggacgtgcctggactacactggcaacaccgaggaagagagcgagctggaaagcctcatagacatgcagctcacggctcttcgcaaggtgttcagaatacctcacaagccctttgatgaaacccacggccctacctcgaagaagttgctgactctcttcaggtcagggaagcttggcccgttcatcctcgacgaccttccggatgagcagtaaattcaagattaacctgtgttgaaggaattagtacgagctgctgtgtgctatccttggtatccttgccaatcattcaaaagctcaaaagcaaaactcgaccacctttttgctctgcgctgctaatgttttgtgatgtaaggaattagtacgagctgcacggcacatagcatcttgcagggagcaacctctgaagaaaaattacaagtagccaacagatattttcaatgctgctgtgtgctatccttggtatgcaggatacccttttttttatgaagtccgtaggttttgttaatagcaggggtaatgcttctgtgtcgctctggctggctgttgacatggacagaacgtggcttgcgcctgattcagaattgaagtgccagcctaatgtcatgagtgaactggggcaagaaggcatgcataaaagagaacagtaaaatggaaaaccatctcttaccccggccggccaaggataaacctctggtttgatatcttgtggtcttactaatgcggtacatatttcagtggtaggcaatttttccgtgtgacatctctcgtaggtatttttatgtataggataattctgtagagtgcacgcgcatgtgtttcctggaatggacatgcacatttcttcttgaaaaaagacactttgatcc

SEQ ID NO: 36631 - protein, 370 aa, Panicum virgatum
  misc_feature: Ceres CLONE 1986173
  misc_feature (134)..(249): Pfam Name: MMR_HSR1 Pfam Description: GTPase of unknown function
MRGLTRAAKRAGEMAFNAGGGAVNWFPGHMAAASRAIRDRLKLADLVIEVRDARIPLSSANEDLQPVLAAKRRILALNKKDLANPNIMNRWLNHFESCKQDCISINAHSSSSVNQLLGLAELKLKEAISKEPTLLIMVVGVPNVGKSALINSIHRIATSRFPVPDKNKRAMVGPLPGVTQDIAGYKIASQPSIYVLDTPGVLVPSIPDMETGLKLALTGAVKDSVVGEERIAKYLLSLLNIRKTPLHWERLVHRRGEVHEETCSHNENDSRDSLRRRRCLNNSDALYVQDLVTEVQRTLCRTCLDYTGNTEEESELESLIDMQLTALRKVFRIPHKPFDETHGPTSKKLLTLFRSGKLGPFILDDLPDEQ

SEQ ID NO: 36632 - DNA, 936 bp, Panicum virgatum
  misc_feature: Ceres CLONE 1986174
  misc_feature: Encodes the peptide sequence at SEQ ID NO. 36633
gacacgcccgccggtgcccaccaatcacgcgcccgccacgactccgcctcctccgtctcaatcgacaccttccctcctcccttcttcctcgcccaagcgacgccgccgcagcccgcgaagccctcgccatcgccatcgccatcgcccagtgcgcgccgcgcaccccaataagcggcgtcttcacggaggaggccggcaccagcggcggccgcaacgcgcggtgcgggcacgagcgtgcaccccgagcgccgagcccggcatatcctgttcttgattgtcttgtttgggttggaatcggtggctggggagcagttctcgagtcgccggcgatggcgtcgaagtggatcctgaaggagcttctgcagcgcaggtgaggcgtttctcctacagcgattccaacccatcctgcagcgcaggtcccgtagcagaggatattttccattggcaggcaacaatcatgggcccttcagatagtccctatggaggtggcgtgtttcttgtttcgatccactttctccggattatccattcaaaccaccaaagatcacggagtgaccgaggaagaacctgtcaatgagtagtaccgcgagcaggagtccgaggacaagtactgcgaccccgaacccgaaggatagtacctcgatctggacttcccggaaggctttgtgaacgaggaagatctgaacttcattgttgaagacatcgagtagaggttgcgtccacacccaactttgcctgtggtgttggccctctgcaagatgcttctgctggcacgatactctgagcccgagctggatcccatgtgggtcgtgctttggtgtatcaccgtagcctttttacttcttattattgtttgtatcgagtgtccgcctcctcggaggtttgtacggtgatgtaccatctgatgtaataaatgtgtatcggcctcctgggatt

SEQ ID NO: 36633 - protein, 39 aa, Panicum virgatum
  misc_feature: Ceres CLONE 1986174
  misc_feature: SWISSPROT Homolog: EC 6.3.2.19 Ubiquitin--protein ligase
MGPSDSPYGGGVFLVSIHFLRIIHSNHQRSRSDRGRTCQ

SEQ ID NO: 36634 - DNA, 692 bp, Panicum virgatum
  misc_feature: Ceres CLONE 1986177
  misc_feature: Encodes the peptide sequence at SEQ ID NO. 36635
aacagaaaagctgcccagttaactgaacggcggaggcatctttcgtcggatccgccatggctgccgctgcccccctcctctccctcctcctcctcctccttctcccggcctcaaatgccatctactgcgacgaagacgactgctacgacctcctcgggcttaagcaggacgcgaacgcgtcggagatcaagaaagcctactacaagctctccctcaaacaccacccggacaagaaccccgatccggagtcgcggaaactctttgtcaagatcgccaatgcttacgagattctgaaagacgaatccactagggagaagtatgactatgccattgcacatccggaggagattttttacaacacagctcagtactatagggcgtactatggacataaaacggatcctcgtgctgtgttgattggtcttcttctaatcgtctcagcatttcagtacataaatcagctgacaaggtataaccaggccatagaaagtgtcaagcaaactcctgcttacagaaataggttaaaagcattggagtttgagcgaacaggaggaattgctagcaaaaagaagggtcacaagctgatggataagaaggtcgaagaagccgttagtaatgaagttgaattgcaaatccatggtgtcgagaaaccatctgtctggaagctctatggtgtccaatttatacttttg

SEQ ID NO: 36635 - protein, 211 aa, Panicum virgatum
  misc_feature: Ceres CLONE 1986177
  misc_feature (28)..(89): Pfam Name: DnaJ Pfam Description: DnaJ domain
MAAAAPLLSLLLLLLLPASNAIYCDEDDCYDLLGLKQDANASEIKKAYYKLSLKHHPDKNPDPESRKLFVKIANAYEILKDESTREKYDYAIAHPEEIFYNTAQYYRAYYGHKTDPRAVLIGLLLIVSAFQYINQLTRYNQAIESVKQTPAYRNRLKALEFERTGGIASKKKGHKLMDKKVEEAVSNEVELQIHGVEKPSVWKLYGVQFIL

SEQ ID NO: 36636 - DNA, 776 bp, Panicum virgatum
  misc_feature: Ceres CLONE 1986186
  misc_feature: Encodes the peptide sequence at SEQ ID NO. 36637
atcatcatgatcacattgagggcctttccgtcgttcagagatgcaatcctgatgctgttcttctgactcacgaaaacacaatgaaccgcattgggaaaggaaattggcagattcactacactgcagtaaccggtggtgaaaagatatgcataggtgaccaagaactacaagttatttatgctcctggtcatactgatggtcatgtggggcttctccatgttaataccaatacattaattgttggagatcattgcgtagggcatggaagtgcaacattggacagtagaagtggtggcaacatgaaggattactttgaaaccacgtacaaattcttagacctatcaccacatgtcataattccaatgcatggaaggatcaacctatggcccaagcatatgctctgtggatacctcaggtttggcaaactaataatatgtgcatactttttttaagaaaacggaactatgttacttcccacattctacagaagcctggatcgtgttattctgcaggctatatacagtcgttacaagttccatggttaaaattattattgttttttaattaattcaaatgcagcatgtttacttcttagttcttacccatgtaaagggtttttatattaataatgggaaattcaactgtgtaatttttttgcacttgtacatgtagagcacatatgggtatatacagctacatcatttctttttttttcattactgtagatggtttgtcactttttcagactctgcggacattctgattcaatctttgtt

SEQ ID NO: 36637 - protein, 149 aa, Panicum virgatum
  misc_feature: Ceres CLONE 1986186
  misc_feature: SWISSPROT Homolog: EC 3.1.2.6 Hydroxyacylglutathione hydrolase
HHDHIEGLSVVQRCNPDAVLLTHENTMNRIGKGNWQIHYTAVTGGEKICIGDQELQVIYAPGHTDGHVGLLHVNTNTLIVGDHCVGHGSATLDSRSGGNMKDYFETTYKFLDLSPHVIIPMHGRINLWPKHMLCGYLRFGKLIICAYFF

SEQ ID NO: 36638 - DNA, 559 bp, Panicum virgatum
  misc_feature: Ceres CLONE 1986188
  misc_feature: Encodes the peptide sequence at SEQ ID NO. 36639
actcctctccctgacttctattccgtcatggcgccccctcagatctcccgcaaaaccctcggcctcctgcttctcctcgccgccgctgccgtctcgccggccgccgccgacgatgtggtggccctgacggagggcgacttcgagaaggaggtcggccaggaccgcggcgccctcgtcgagttctacgcgccatggtgcggccactgcgagaagcttgccccagagtatgaaaaacttggtgcaagtttcaagaaggctaaatctgtattgatcgcaaaggttgactgtgatgagcacaagagtatatgtaccaagtatcgagtttctggatacccaacaattcaatggttccccaaaggtcctttggagccaaagaagtatgagggtgaacgttccgtggaagccctcgcagaatttgttaacagtgaagcaggtggacctcgcctgttgccaagaacagatttcaaccacgctgtctcgtattctaagtaccgaattactggaatatgaaacatatatttgcatttaccacactactggcttcccctactgatttggt

SEQ ID NO: 36639 - protein, 160 aa, Panicum virgatum
  misc_feature: Ceres CLONE 1986188
  misc_feature (29)..(134): Pfam Name: Thioredoxin Pfam Description: Thioredoxin
  misc_feature: SWISSPROT Homolog: EC 5.3.4.1 Protein disulfide-isomerase
MAPPQISRKTLGLLLLLAAAAVSPAAADDVVALTEGDFEKEVGQDRGALVEFYAPWCGHCEKLAPEYEKLGASFKKAKSVLIAKVDCDEHKSICTKYRVSGYPTIQWFPKGPLEPKKYEGERSVEALAEFVNSEAGGPRLLPRTDFNHAVSYSKYRITGI

SEQ ID NO: 36640 - DNA, 1487 bp, Panicum virgatum
  misc_feature: Ceres CLONE 1986192
  misc_feature: Encodes the peptide sequence at SEQ ID NO. 36641
aagcgagctcatcattgattcgttcgattcatcattggttagggtttcatcctccctccctacccccaccaaggcaccaacgccgccgcggccatggcgccgccgcacccgctcagctgggctgacgcgccgccctaccactaccacgggacgacccagcatccggcgcccacaaaggaggacgacgcaggagcagcagacgacgggccgcgctctctctggatcggcggcctgctgcactggatgaacgaggactacctctactgctgcttcaccctctcgcctgagcttctttctgttctcataatgcggagcaagcatactggccagtcagagggttatggctttctcaacttcaccagccatactgctgccactcacattctcaagagctacaatggtcagaagatgcctaatgctgatcaagatttcagcctcaactgggccacccagcaaactgctcccgtggaacttacccatcaagagtccaagctcgattgtgccacgcagcaggatggacacgccgatggcactgcaacttctgagcattccatatttgttggggacttggcctatgatgttactgaatacatgctacaccacctgttcaagagtcggtatccatcagtcaagagtgcaaaagttatctttgacaagcttactggccgctcaaaatgctatggctttgtttgctttggagatgtcaatgagcacgcacaagcaatgacagaaatgaatggagcatactgttctaccaggccaatgcgtattggacctgctctcaacaagaaagattttgtccacagcacacaaggaactgattcttatcacgatccaaacaattcaagactgtttgtcgggtgtcttgataaaagcatcacagatgacgatgtactgcaagcctttagtccatatggagagcttgttagtgtcaaagtactacaggggaagggctgcgcctttgtcacatactcaaaccgggcatcggcagaggaggccatgagaatgctaaatggaagtcagctgggaggtaacgccatgagactttcatggtttcgccgtgctgctaacaagcaggatggacaaaatggtggccggtatggacgccccaaatcctttgatccttctggttttggttggtttcctcaggttccgtacgcttatgctcagacaggccatccaggatatgaatattaccaacagcagctacccacagtacagtgaggtcaccatgtgaaggaacatcacaaggaacggcatgtagagagatttgaactcggaagaacttccacccctttttggaaataacctaaccctttagttgcgctccacgaggaatagttctgtatcccaccacggaagctccccgtgatgcctgggagtacagttttgttacggatgtcgagaatttagcccgtttaacctattgaagtttgggttacctgaattttgctatgccatgggcattcctcgcagaactctggttc

SEQ ID NO: 36641 - protein, 376 aa, Panicum virgatum
  misc_feature: Ceres CLONE 1986192
  misc_feature (253)..(318): Pfam Name: RRM_1 Pfam Description: RNA recognition motif. (a.k.a. RRM, RBD, or RNP domain)
  misc_feature (154)..(226): Pfam Name: RRM_1 Pfam Description: RNA recognition motif. (a.k.a. RRM, RBD, or RNP domain)
MAPPHPLSWADAPPYHYHGTTQHPAPTKEDDAGAADDGPRSLWIGGLLHWMNEDYLYCCFTLSPELLSVLIMRSKHTGQSEGYGFLNFTSHTAATHILKSYNGQKMPNADQDFSLNWATQQTAPVELTHQESKLDCATQQDGHADGTATSEHSIFVGDLAYDVTEYMLHHLFKSRYPSVKSAKVIFDKLTGRSKCYGFVCFGDVNEHAQAMTEMNGAYCSTRPMRIGPALNKKDFVHSTQGTDSYHDPNNSRLFVGCLDKSITDDDVLQAFSPYGELVSVKVLQGKGCAFVTYSNRASAEEAMRMLNGSQLGGNAMRLSWFRRAANKQDGQNGGRYGRPKSFDPSGFGWFPQVPYAYAQTGHPGYEYYQQQLPTVQ

SEQ ID NO: 36642 - DNA, 754 bp, Panicum virgatum
  misc_feature: Ceres CLONE 1986205
  misc_feature: Encodes the peptide sequence at SEQ ID NO. 36643
cttcctgttcctactagctaccttgcgagtgctctgtctatccgcagggccatcctgtactgctgtacagtggtggtggctgtgcagagtgcagagcagcagagatgggcgccgccactgctaccagagctctagtacggctgcagctcgccgcggcggccgtcgtcgtggcgtgggcgtgctgcggcttccgcccgtcggcggcgcagctgcaggtgggctactacaacgccacctgcccgggcgccgagaccatcgtccacgccgccgtccgcaaggacgccggcaacgggcccggcctcatccgcctcttcttccacgactgcttcgtcaggggctgcgacgcgtcggtgctgctggacgacccgacgggcaccccgggcaacgggacggtggagaagacctcgccgcccaacttccccagcctccggggcttcgccgtcatcgatcgcgccaagcgcgtggtggagcgccgctgcccagggaccgtctcctgcgccgacatcgtcgccttcgcggcgcgcgacgccgcgcgcatcatgggcgggatcaaattcgccatgccgtcgggccgcctcgacggccgcgtctccaacgcctccgaggccgtcgccaacctgcccccggcctccttcaacctcacccagctcgtcgcgcgcttcgcggccaagaacctcaccgcccgcgaaatggtcacgctctccggcgcgcactccatcgggcgctcccactgctcctccttctcgggccgcct

SEQ ID NO: 36643 - protein, 216 aa, Panicum virgatum
  misc_feature: Ceres CLONE 1986205
  misc_feature (48)..(216): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50376
  misc_feature: Useful for making plants with altered carbohydrate content
  misc_feature: Functional homolog of the protein sequence given in SEQ ID NO 51528
  misc_feature: Useful for making plants with altered cell wall content and/or composition
MGAATATRALVRLQLAAAAVVVAWACCGFRPSAAQLQVGYYNATCPGAETIVHAAVRKDAGNGPGLIRLFFHDCFVRGCDASVLLDDPTGTPGNGTVEKTSPPNFPSLRGFAVIDRAKRVVERRCPGTVSCADIVAFAARDAARIMGGIKFAMPSGRLDGRVSNASEAVANLPPASFNLTQLVARFAAKNLTAREMVTLSGAHSIGRSHCSSFSGR

SEQ ID NO: 36644 - DNA, 1180 bp, Panicum virgatum
  misc_feature: Ceres CLONE 1986206
  misc_feature: Encodes the peptide sequence at SEQ ID NO. 36645
agaggcgagggaaaacctagctccctttttctcacgcgcacgcgccgccccgccctcccctcccccagcgcgctctactcaccggccgccacgcacgccggcgccgttcgctccgtccccatcccatcgccggcagccgccgtccccctccccgtctcagtaaaaatggtgggacgttcaagtgaagaagcccaggctcatgatgaagtcatcatggatgatgttgattccgatgtggaagagtcagactcggaagatgattcaggggaagaagctcaggctaagccttcagacaaagctatatacaacaaggatgccattcttgaaaaacttgaagacatagcctggcccaagaatgtggactggatgcacaagctcaccattgagtatgaccagggggaaaaagttgatgtgaatgatgatcttgcccgtgaacttgcattttacacccaagctttggatggcacaaggcaggcctttgaaaagctgcagtcaatgaaggttcggttcctcaggccaacagattactatgctgagatggtcaagactgatgcacatatgcacaagatcaaggggagattgttgtcagagaagaggaggatcgaggaggctgaggagaggaagaaggctagagaggccaaaaagatagcaaaggaggtgcaggcagagaagaacaagcagcgggctaaggagaagaaggagcagattgagtcagtcaagaagtggaggaagcagaggcagcaggggggattcgccaagggaaatgatgatgtgccagacctgaactttgagggagaggaaggatttaaacaatcaaagaaaaagaggcctggggtttctcctagtgataggtctggtggtcttgctaagagaggtaaagaaggaaagaacaggaggtcaagagatgccaagtttgggcatggtgggcgtaaagggctgaagaagcaaaacactgctgagaccacgaatgatttcagaagctttaacaaggggggtgagtctcaaaacaagaagaggaagagggcttgatgcaatattgtaataattttgtgctcagtcccttttgccgttattgctattcttgttgcaactttgctatggtgcgttgttaccagaagcaaaaattagctgaaaagattattctagggaagcaatccaatcacaagacttatgttttact

SEQ ID NO: 36645 - protein, 287 aa, Panicum virgatum
  misc_feature: Ceres CLONE 1986206
  misc_feature (6)..(287): Pfam Name: Ebp2 Pfam Description: Eukaryotic rRNA processing protein EBP2
MVGRSSEEAQAHDEVIMDDVDSDVEESDSEDDSGEEAQAKPSDKAIYNKDAILEKLEDIAWPKNVDWMHKLTIEYDQGEKVDVNDDLARELAFYTQALDGTRQAFEKLQSMKVRFLRPTDYYAEMVKTDAHMHKIKGRLLSEKRRIEEAEERKKAREAKKIAKEVQAEKNKQRAKEKKEQIESVKKWRKQRQQGGFAKGNDDVPDLNFEGEEGFKQSKKKRPGVSPSDRSGGLAKRGKEGKNRRSRDAKFGHGGRKGLKKQNTAETTNDFRSFNKGGESQNKKRKRA

SEQ ID NO: 36646 - DNA, 768 bp, Panicum virgatum
  misc_feature: Ceres CLONE 1986224
  misc_feature: Encodes the peptide sequence at SEQ ID NO. 36647
aacgccgccaaagccacaaacccgagttcctctgctccccgagcagccgaacagagtggtctccagagcactccccatgccgacgggagctgcgacggcccccgttcagactgtggtgctgagggtgtccatccactgccatggctgcaagaagaaggtccggaaggtgctcaagagcgtcgaaggtgtgcagagcgtgacggtggacgccgcgcagcacaaggtgacggtgacgggcaccgtggacgccaacacgctcgtccagaggctgcacaagtccggcaagaagggggtgccgtggcagtactgccacccgcccgccaacaagaccgaggccgcgctggcgccggcgccggcgccggaggcagctccgccggcgcagcctgccggcgacggcggcaaggatgctgctgcgaaagcggcggacaagaagccggaggaggcggtgaaggagccgcaggtcgagagctccgagaagaagcagcctaagcaggaggccgcgggcacggagaagaaggcggaagcagagccagcaaaggaagaggcgaaagaagccgccgccgccgccgctaatgccaagaacgaggacgcagcaaagaagaacgacaagcccaaggacgccggcaagccggagcccgtcgccgtgacgtcggagaggtccctgcctcagcctgcgcccccgccgccggctccaaagtacgcgtacgaggaggagtaccgctactcctactacgcgccggcgccgcagccggtgatgagctaccacgc

SEQ ID NO: 36647 - protein, 230 aa, Panicum virgatum
  misc_feature: Ceres CLONE 1986224
  misc_feature (14)..(74): Pfam Name: HMA Pfam Description: Heavy-metal-associated domain
  misc_feature: SWISSPROT Homolog: EC 3.6.3.4 Copper-exporting ATPase
MPTGAATAPVQTVVLRVSIHCHGCKKKVRKVLKSVEGVQSVTVDAAQHKVTVTGTVDANTLVQRLHKSGKKGVPWQYCHPPANKTEAALAPAPAPEAAPPAQPAGDGGKDAAAKAADKKPEEAVKEPQVESSEKKQPKQEAAGTEKKAEAEPAKEEAKEAAAAAANAKNEDAAKKNDKPKDAGKPEPVAVTSERSLPQPAPPPPAPKYAYEEEYRYSYYAPAPQPVMSYH

SEQ ID NO: 36648 - DNA, 751 bp, Panicum virgatum
  misc_feature: Ceres CLONE 1986229
  misc_feature: Encodes the peptide sequence at SEQ ID NO. 36649
atcgcataaatcctccgccctctccctcatccgtaaacccctccctctctcgcttcccccgtgatctgtgctgcagatcggtcgacatggcgctcgtattgcattctggacctggaaacaagaatgctttcaaggcacttattgctgcagaatacaatggggttaaggttgagttgacaaagaattttgagatgggtgtcaccaacaagacccctgagtttcttaagatgaacccccttgggaaggtgcctgttctggagactcctgaaggtgctgtttttgagagcaatgctattgcacgctatgttgctcgcttgaatgatggcaaccctctttttgggtcttctcgtattgaacaagcccatgttgagcagtggatggactttgctgcaacagaagttgatcctggtgttgcatggtacttgtacccaaggcttggttacattccttattctcagacgacagaggaaacagctattgcctcgttgaagagagcgctcggttctctgaacacgcaccttgcctcaaagacattccttgttgggcattctgtcactctagctgacattgtattgacatgcaacctctaccatggatttgcacggatcttgaccaagagcttcacatccgagttcccgcatgtcgagaggtatttctggaccatggttaaccagcctaacttcaagaagggcatgggtgatgtcaagcaggcagagtcagtgcctcctgttccgaaaaagactgctgcccc

SEQ ID NO: 36649 - protein, 221 aa, Panicum virgatum
  misc_feature: Ceres CLONE 1986229
  misc_feature (1)..(76): Pfam Name: GST_N Pfam Description: Glutathione S-transferase, N-terminal domain
  misc_feature (104)..(197): Pfam Name: GST_C Pfam Description: Glutathione S-transferase, C-terminal domain
  misc_feature: SWISSPROT Homolog: EC 2.5.1.18 Glutathione transferase
MALVLHSGPGNKNAFKALIAAEYNGVKVELTKNFEMGVTNKTPEFLKMNPLGKVPVLETPEGAVFESNAIARYVARLNDGNPLFGSSRIEQAHVEQWMDFAATEVDPGVAWYLYPRLGYIPYSQTTEETAIASLKRALGSLNTHLASKTFLVGHSVTLADIVLTCNLYHGFARILTKSFTSEFPHVERYFWTMVNQPNFKKGMGDVKQAESVPPVPKKTAA

SEQ ID NO: 36650 - DNA, 678 bp, Panicum virgatum
  misc_feature: Ceres CLONE 1986238
  misc_feature: Encodes the peptide sequence at SEQ ID NO. 36651
ccccttcgattcgagcacacaaaccctctccgccgccgccgaggaagaggaggaagaagaagcacaagcgccggccaagatgaagaccattctggcgtcggagacgatggacatcccggaggaggtgacggtgaaggtggccgccaaggtggtgacggtggagggcccccgcgggaagctcacccgcaacttcaagcacctcaacctcgacttccagttgcaggagggcggccgcaagctcaaggtcgacgcctggttcggcacccgccgcaccatggccgccatccgcaccgccatctcccacgtccagaacctcatcaccggcgtcaccaagggataccgctacaagatgaggttcgtctacgcccacttccccatcaacgcctccatcaccaacgccaacaccgccatcgagatcaggaacttcctgggagagaagaaggtccggaaggtggacatgcttgagggtgtgaccatcttgcgctccgagaaggtcaaggatgagctcatcctcgacggcaacgacatcgagctcgtctctcgctctgccgccctcatcaaccagaaatgccatgtgaagaacaaggatatcagaaagttcttggatggcatctacgtcagtgacaagggtgccattaatgaggagcagtgagcttcattatctgcctagtcattagc

SEQ ID NO: 36651 - protein, 190 aa, Panicum virgatum; identical to SEQ ID NO: 18865
  misc_feature: Ceres CLONE 1986238
  misc_feature (12)..(86): Pfam Name: Ribosomal_L6 Pfam Description: Ribosomal protein L6
  misc_feature (98)..(177): Pfam Name: Ribosomal_L6 Pfam Description: Ribosomal protein L6

SEQ ID NO: 36652 - DNA, 715 bp, Panicum virgatum
  misc_feature: Ceres CLONE 1986254
  misc_feature: Encodes the peptide sequence at SEQ ID NO. 36653
aaaaaaaaaaaaaaaaaaaaaccgaacggaacgagacccccaacacacgtcaaagcggaaaacctcagataacccccaggaaatcgtattataatctcgccctccagcccccccccccccccccctgctccgctgcaactccactcggccgccccccaccctgatccttcccccagccattggtgcgtgcttgatcggatccatggacacccacatcggatccgtggacgggccggcgctggcggcggcgaacggcgcggtgggctgcccggcgtcggcgccggggtgcccgatggcgtccacgccggcgcagcccgcggcggcgctgacggccggggaggcgtcgctggggcgccacctcgcgcgccgcctcgtgcaggtcggcgtcggcgacgtcttcgccgtccccggggacttcaacctcacgctgctcgaccacctgatcgccgagcctgggctgcgcctcgtcggctgctgcaacgagctcaacgccgggtacgccgccgacgggtacgcgcgcgcgcggggcgtcggggcgtgcgccgtcacgttcaccgtcgggggcctcagcgtgctcaacgccatcgcgggcgcctacagcgagaacctgcccgtcatctgcatcgccggcgggcccaactccaacgactacgggaccaaccgcattctccaccacaccatcggcctccccaacttctcgcaggagctcccctgc

SEQ ID NO: 36653 - protein, 170 aa, Panicum virgatum
  misc_feature: Ceres CLONE 1986254
  misc_feature (47)..(170): Pfam Name: TPP_enzyme_N Pfam Description: Thiamine pyrophosphate enzyme, N-terminal TPP binding domain
  misc_feature: SWISSPROT Homolog: EC 4.1.1.1 Pyruvate decarboxylase
MDTHIGSVDGPALAAANGAVGCPASAPGCPMASTPAQPAAALTAGEASLGRHLARRLVQVGVGDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPNFSQELP

SEQ ID NO: 36654 - DNA, 702 bp, Panicum virgatum
  misc_feature: Ceres CLONE 1986257
  misc_feature: Encodes the peptide sequence at SEQ ID NO. 36655
atcctctgtttcccctctcccctcctcccccgattgctctcgatcttccagcgcgcgacaccatggccgacaaggcgtctccggagaagaagtcgtgggccgacgtcgaggaggaggaggaggccaaggccaaggcggctgcggagacggcggcggcctcgtcctcctccacctccgagtcggcggtggaggcgcaggccaagcagatcgagtcgctctccctcaccccgccggaggacgacgccgccggcgaggaggccccgcctctcctcgatgactccgacgacgcgcaaatccaagccgtgacttcgggcggcacggtgtacgagtcggccaccacgttcgaggatctgaagctgtcgcccgagctgctcaaggggctgcacgacgagatgggcttcagccgcccgagcaagatccaggcgatcaccctccccatgatcctcacgcctccctacaaggacctcgtcgcgcaggcgcacaacggctccggcaagaccacctgctttgtcctcggcatgctcagccgagtcgattccaatcgcaggatcccccaggccatctgcatttgcccgactagggagctcgcgcagcagaataaagcagttctgatgaggatgggcaagtttactggcattacatgtgcctgtgcgatcccaccagctcaaaaggattatgtgccggtctctaaaatgccgccca

SEQ ID NO: 36655 - protein, 213 aa, Panicum virgatum
  misc_feature: Ceres CLONE 1986257
  misc_feature: Functional homolog of the protein sequence given in SEQ ID NO 50816
  misc_feature: Useful for making plants with modulated cold sensitivity
  misc_feature: Useful for making plants with modulated heat sensitivity
MADKASPEKKSWADVEEEEEAKAKAAAETAAASSSSTSESAVEAQAKQIESLSLTPPEDDAAGEEAPPLLDDSDDAQIQAVTSGGTVYESATTFEDLKLSPELLKGLHDEMGFSRPSKIQAITLPMILTPPYKDLVAQAHNGSGKTTCFVLGMLSRVDSNRRIPQAICICPTRELAQQNKAVLMRMGKFTGITCACAIPPAQKDYVPVSKMPP

SEQ ID NO: 36656 - DNA, 716 bp, Panicum virgatum
  misc_feature: Ceres CLONE 1986266
  misc_feature: Encodes the peptide sequence at SEQ ID NO. 36657
taaaggcatgcaagcctatgttgcacaaacaacctttgcttctggatgcaaggatgtttcctgtaactcaacagatttgttcggcgaagccattgaagcagctaaagcagccgatattgttgttgtagttgctgggttgaacctgacagaagagcgtgaagactttgatagagtcagccttctccttccaggcaagcagatgaacctcatacaaactgttgctagtgtaacaaagaaaccccttgtattggttctcttgggtggtggtcctgttgatgtttcttttgcaaagcacgatccacgaattgcaagtatcctttggctcggatatcctggcgaggtcggtgggcaagtccttccagaaattctttttggaaagtacaacccaggaggaaagctggctatgacttggtaccctgaatccttcacagctattccgatgactgatatgaacatgagagctgattcttcacgtggttacccaggaagaacatatcgattttacactggagatgtagtatatggttttggttatggtttaagttactccaaatattcgtatagcatcttgtcggctcgaaagaagatcactgtttcgtgttcatcggttctggacactatccgtaggaagcctgcatatataaggagggatgggctagactttgtgaataccgaagatattgcatcatgtgaagctctaatattctcagttcgca

SEQ ID NO: 36657 - protein, 238 aa, Panicum virgatum
  misc_feature: Ceres CLONE 1986266
  misc_feature (1)..(184): Pfam Name: Glyco_hydro_3_C Pfam Description: Glycosyl hydrolase family 3 C terminal domain
  misc_feature: SWISSPROT Homolog: EC 3.2.1.21 Beta-glucosidase
KGMQAYVAQTTFASGCKDVSCNSTDLFGEAIEAAKAADIVVVVAGLNLTEEREDFDRVSLLLPGKQMNLIQTVASVTKKPLVLVLLGGGPVDVSFAKHDPRIASILWLGYPGEVGGQVLPEILFGKYNPGGKLAMTWYPESFTAIPMTDMNMRADSSRGYPGRTYRFYTGDVVYGFGYGLSYSKYSYSILSARKKITVSCSSVLDTIRRKPAYIRRDGLDFVNTEDIASCEALIFSVR

SEQ ID NO: 36658 - DNA, 634 bp, Panicum virgatum
  misc_feature: Ceres CLONE 1986274
  misc_feature: Encodes the peptide sequence at SEQ ID NO. 36659
accattccaaaccaaacacgagagctagcgtccggctagtgagagcagcagccagcaagcgggcaaggcaagagagaaagcaggcaggcaaacatgtgtggtggtgcgatcctcgcggagctcataccgagcgcgccggcgcgccgcgtcacgccgggccacgtctggcccgcggccaagcagcagaggagggccgacgacttcgaggccgcgttccgggagttcgactccgactccgactccgacgaggaggtggagagcaagccgctcggcttcaacgcttcccccgccggcgcggcgaccaggaagctgaggaggcagcagcagcagcagcagcagcgggagctggccgcgccggcgccgagcaggcgccgcaaggccgcgcagtacaagggcgtccggcgccgcccgtggggcaagtgggccgccgagatccgcgaccccgtcaagggcgtccgcgtctggctcggcaccttctcctccgccgaggccgccgcgctcgcctacgacgccgccgcgcgcgacatccgcgggcccagggccaagctcaacttcccctcgaacgccgacgcccctcccgccgccgggcgcaagcgcgcccgcgccgccgagttcgtcgacctcgtcgccgacg

SEQ ID NO: 36659 - protein, 180 aa, Panicum virgatum
  misc_feature: Ceres CLONE 1986274
  misc_feature (97)..(148): Pfam Name: AP2 Pfam Description: AP2 domain
  misc_feature: Functional homolog of the protein sequence given in SEQ ID NO 50520
  misc_feature: Useful for making plants with altered alkaloid content
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
MCGGAILAELIPSAPARRVTPGHVWPAAKQQRRADDFEAAFREFDSDSDSDEEVESKPLGFNASPAGAATRKLRRQQQQQQQRELAAPAPSRRRKAAQYKGVRRRPWGKWAAEIRDPVKGVRVWLGTFSSAEAAALAYDAAARDIRGPRAKLNFPSNADAPPAAGRKRARAAEFVDLVAD

SEQ ID NO: 36660 - DNA, 705 bp, Panicum virgatum
  misc_feature: Ceres CLONE 1986292
  misc_feature: Encodes the peptide sequence at SEQ ID NO. 36661
accaaaccgagagagaaagagatcgaaggcagacagctggagcagagtgtataagacctgaagcgccgtgtactagctagctcaacagaatcgctagctttttgccaacgaccaagagacagaagccgggtggcggcggcgggcgatcggcggcgagcgcatgggcaacgccctggggtgcgccggactcggcgagcggctggcggccgccgcgagggacggcgacgcggcggaggtgcggcggctgctggaggcgaacccggggcacgcgcggtgcgccgccttcggcagcctcaactcgccgctccacctcgccgccgccaaaggacaccacgagatcgctgcgttgctgctgcagaacggagctgacgtgaacgcccgaaacatttacggacagacggcgttgatgcaagcgtgccggttcggccactgggaggtggttcagacgctgctggttttcggatgcaacgtgtcgaaggtggacagcctcagcagccggacggcgctgcacctcgcagcggccggcggacacgtcaagtgcgccaggctgctgctggccgcggccgccggcgacggcggcaggttcgtgaacagggcgggcagcggcggcgtcacggcgctgcacctcgcggcgctgcacggccacgccgactgcgtgcacctgctcatcgacgagcacggcgacctcgccgcgcaaacccctcc

SEQ ID NO: 36661 - protein, 181 aa, Panicum virgatum
  misc_feature: Ceres CLONE 1986292
  misc_feature (44)..(76): Pfam Name: Ank Pfam Description: Ankyrin repeat
  misc_feature (149)..(181): Pfam Name: Ank Pfam Description: Ankyrin repeat
  misc_feature (77)..(109): Pfam Name: Ank Pfam Description: Ankyrin repeat
  misc_feature: SWISSPROT Homolog: EC 2.4.2.30 NAD(+) ADP-ribosyltransferase
MGNALGCAGLGERLAAAARDGDAAEVRRLLEANPGHARCAAFGSLNSPLHLAAAKGHHEIAALLLQNGADVNARNIYGQTALMQACRFGHWEVVQTLLVFGCNVSKVDSLSSRTALHLAAAGGHVKCARLLLAAAAGDGGRFVNRAGSGGVTALHLAALHGHADCVHLLIDEHGDLAAQTP

SEQ ID NO: 36662 - DNA, 750 bp, Panicum virgatum
  misc_feature: Ceres CLONE 1986296
  misc_feature: Encodes the peptide sequence at SEQ ID NO. 36663
aaagctcacctcagctgctgctctcctcgcgcgcggcctcccctccccttcgatctccgcctccggcgccggcgccggcaccatcagctgccaggactgcggcaaccaggccaagaaggactgcgcccacatgcgctgccgcacctgctgcaagagccggggcttcgactgcccaacgcacgtcaagtccacctgggtgcccgccgccaagcgccgcgagcgccagcagcagcttgccaccggcgccgccgagccatccaagcgaccgcgcgacgccggcgcccagccttcgtccaccacagccacaaccacttcctcgggagagcagcagcagcagatggccatggtgggcgagcggtacccacgggaggtgagctcggaggcggtgttccgctgcgtgcgcctgggccccgtcgacgaggcctacgccgaggtcgcgtaccagaccaccgtcagcatcgccggccacgtcttcaagggcatcctgcacgacgtcggcccggacccgtccgccgcggccgccggcggcttccgccacgccgccgaggggtcctccccgagcacggccgcggcgggcgaaggcagcgtcgcggggcccgtgtcgtcatcggctgtagtcatggacccgtacccgacgcccggcccctacggcggcccgcccttctccacggccatccgaggtgatcagacggccacacctcgattgacggctagctcttcattattccctttagacacatgttgatcgat

SEQ ID NO: 36663 - protein, 247 aa, Panicum virgatum
  misc_feature: Ceres CLONE 1986296
  misc_feature: The sequence is a functional homolog of SEQ ID NO 478 in the 10/666,642 US patent application
  misc_feature: The sequence is a functional homolog of SEQ ID NO 972 in the 11/435,388 US patent application
KLTSAAALLARGLPSPSISASGAGAGTISCQDCGNQAKKDCAHMRCRTCCKSRGFDCPTHVKSTWVPAAKRRERQQQLATGAAEPSKRPRDAGAQPSSTTATTTSSGEQQQQMAMVGERYPREVSSEAVFRCVRLGPVDEAYAEVAYQTTVSIAGHVFKGILHDVGPDPSAAAAGGFRHAAEGSSPSTAAAGEGSVAGPVSSSAVVMDPYPTPGPYGGPPFSTAIRGDQTATPRLTASSSLFPLDTC

SEQ ID NO: 36664 - DNA, 748 bp, Panicum virgatum
  misc_feature: Ceres CLONE 1986297
  misc_feature: Encodes the peptide sequence at SEQ ID NO. 36665
ttcctcctccattatctctctctctctttctaggcgctcccatctctctctagaaaaaaaaggagcgaggcgagcaggccggccggccggccatggggttcccgtcggtgtgctactgtgtgatcctgccgcagccgctcatcctggtgctgcagctgctggacctgctccggcacgccgtcctgctctgcctctcctcgctcgggctcgcggcgccaccggccgccgacgaccacccggccttcgcggccccgccgccggacctctgggcgctgcctccgtccctgcaggcggccgcggccgcggcgcccgcgcccacgccggccgccatcaaggcccgcctccccgccgtccggtacgccgacctcctccgcgcccaccgcgccccggccccggccacgtgcgccgtgtgcctgggcgcgctcgaggcgcggcaccgcgtccgggagctcggcaactgcgcgcacgccttccacaaggcctgcatcgacaagtgggtcgacaagggccaggccacctgcccgctctgccgcgcgctcctcctccccgacgacggcgccggcgagctcgccgcctcctcctcctcctcgcccttctccttctgagacctcgcgtcgcgcgcacggtccagctagccaagaagaaccggagcccacccagcccgattgagagccaggtcagtaaccagctcggtgtccatccctagctacctacccagctgatgcgcccccgtcatacttacggccgg

SEQ ID NO: 36665 - protein, 170 aa, Panicum virgatum
  misc_feature: Ceres CLONE 1986297
  misc_feature (104)..(146): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MGFPSVCYCVILPQPLILVLQLLDLLRHAVLLCLSSLGLAAPPAADDHPAFAAPPPDLWALPPSLQAAAAAAPAPTPAAIKARLPAVRYADLLRAHRAPAPATCAVCLGALEARHRVRELGNCAHAFHKACIDKWVDKGQATCPLCRALLLPDDGAGELAASSSSSPFSF

SEQ ID NO: 36666 - DNA, 1314 bp, Panicum virgatum
  misc_feature: Ceres CLONE 1986306
  misc_feature: Encodes the peptide sequence at SEQ ID NO. 36667
gggcctccaccatagtcgagttaccctccgcgtcattgccgtcggcaccatcgccgccgtgcgccgcccgcccgcgcccgcgccatcgcctctcctcgcgccgccgctccgctgctccacccgcaccgtctcgccgtgcgctgcctgcctccctcccactctgtttcccaattccaccctgttccccccactccaaacgccacgtgaccttgccggtgctccggtagcggcgcacgatgctccgccgtgtgcctccctccctacgccgcgccctcctctcctccgcctacacacactacggcggggcacaaatcctgaaccccatccattcaccttcccagaccctcctcccccaatggcggcgtcacgccgctgttgcctcctcctcggccccgctgcagtcgccgcctcctccatctccgcaacggggtccgtcgcggtcgggcggcggcggtccccctgtctcgtcgctgaaccccgccgaggtcgccaagttcgctgccatcgcagagacctggtgggatgcaaatggtccattcaaacctttgcatttgatgaatccaacccgcctgtcttttatccgctccactctttgtagacatttcaggagggatccatattcatctaagccacttgaaggcctcaaagttattgatgttggatgtggaggtggcattctgtcagagcctcttgctcggatgggagctacagttactgcaattgatgctgtcgacaagaatataaagatcgcaagtattcatgcggcatctgatccggaaactgcttccattgagtattgctgcacaacagctgaggcattggtaaaagagaaaaggctgtttgatgctgtaatttctcttgagcttcctagaggcacacatgagtggtccaaactggttacccctgaggagctttccctaatgctgcaaaaagcttctgtttccgttgaagagatggcagggttcatttataatccgcttagtggagagtggtctctgtcagatgatatcactgtgaactatattgcttttggtgtcaagaagagtgaaacaccatcgacaaattgcacataggcaagattattgtggttgaagaaaaagaattggcaatgtcttttgaatcttagtgctatggatacaaccacgttgtatggaagccccattgggaagttgtcaagctgacggacgagaggcagctgctaacaagtagagctagctctgctttcttttgattaattgtgtaataatgtaatacacggatgcttcagacagttttagcaattttgtggcaaatacaagggtagtgctttctctc

SEQ ID NO: 36667 - protein, 278 aa, Panicum virgatum
  misc_feature: Ceres CLONE 1986306
  misc_feature (139)..(229): Pfam Name: Methyltransf_11 Pfam Description: Methyltransferase domain
  misc_feature: SWISSPROT Homolog: EC 2.1.1.114 Hexaprenyldihydroxybenzoate methyltransferase
MLRRVPPSLRRALLSSAYTHYGGAQILNPIHSPSQTLLPQWRRHAAVASSSAPLQSPPPPSPQRGPSRSGGGGPPVSSLNPAEVAKFAAIAETWWDANGPFKPLHLMNPTRLSFIRSTLCRHFRRDPYSSKPLEGLKVIDVGCGGGILSEPLARMGATVTAIDAVDKNIKIASIHAASDPETASIEYCCTTAEALVKEKRLFDAVISLELPRGTHEWSKLVTPEELSLMLQKASVSVEEMAGFIYNPLSGEWSLSDDITVNYIAFGVKKSETPSTNCT

SEQ ID NO: 36668 - DNA, 306 bp, Panicum virgatum
  misc_feature: Ceres CLONE 1986325
  misc_feature: Encodes the peptide sequence at SEQ ID NO. 36669
gcacaacattctgttccttttcataactcagaagtgcagagcttgctttgtgccatctaaatcaaaagatggcaaacactaattctgcagaaggtgcacaccagaccaaccctgaaaaggtcaagctggtcactgttctgagcatcgacggtggcggtgttagaggaatcatcccggccgtcatccttgccttcctcgaagagaagctccaagaactggatggaccagatgctaggattgctgactacttcgacgttgttgccggcacgagcaccggcggtctcttgacggcgatgctcacagccc

SEQ ID NO: 36669 - protein, 79 aa, Panicum virgatum
  misc_feature: Ceres CLONE 1986325
  misc_feature: SWISSPROT Homolog: EC 3.1.1.5 Lysophospholipase
  misc_feature: Functional homolog of the protein sequence given in SEQ ID NO 51529
  misc_feature: Useful for making plants with modulated heat sensitivity
MANTNSAEGAHQTNPEKVKLVTVLSIDGGGVRGIIPAVILAFLEEKLQELDGPDARIADYFDVVAGTSTGGLLTAMLTA

SEQ ID NO: 36670 - DNA, 638 bp, Panicum virgatum
  misc_feature: Ceres CLONE 1986342
  misc_feature: Encodes the peptide sequence at SEQ ID NO. 36671
agaccgtgcacataggataggccagaagaaagaggttcaagtttttcgcttttgcacagagtatactattgaggaaaaagtgattgagagagcttacaagaagcttgcgttggatgctttggttattcagcaaggacgtttggcagagcagaaaagtgtcaataaggatgatcttctgcaaatggtaaggtttggtgctgaaatggttttcagttctaaagacagcacaataacagatgaggatatagatcgtattatagccaaaggagaggaaacaacagcagaacttgatgcgaaaatgaaaaagttcactgaggatgccattaaatttaagatggatgataacgctgaattgtatgattttgatgatgagaaggatgaaaacaaggttgatttcaagaaacttgtcagtgataactggatcgagccacctagaagagaaaggaagaggaactactccgagtctgagtactttaagcaagctcttcgccaaggtgcaccagcaaagcctagggaaccaaggattccaagaatgccacacttgcatgatttccagttcttcaacaaccaaaggctaaatgaattgtatgaaaaggaagtgcgatacctcatgcaagcaaaccagaagaaagatacca

SEQ ID NO: 36671 - protein, 212 aa, Panicum virgatum
  misc_feature: Ceres CLONE 1986342
  misc_feature: The sequence is a functional homolog of SEQ ID NO 1582 in the 10/412,699 US patent application
  misc_feature: The sequence is a functional homolog of SEQ ID NO 1581 in the 10/412,699 US patent application
  misc_feature: The sequence is a functional homolog of SEQ ID NO 1044 in the 10/225,066 US patent application
  misc_feature: The sequence is a functional homolog of SEQ ID NO 1846 in the 10/412,699 US patent application
  misc_feature: The sequence is a functional homolog of SEQ ID NO 2554 in the 10/374,780 US patent application
  misc_feature: The sequence is a functional homolog of SEQ ID NO 790 in the 10/412,699 US patent application
  misc_feature: The sequence is a functional homolog of SEQ ID NO 788 in the 10/412,699 US patent application
DRAHRIGQKKEVQVFRFCTEYTIEEKVIERAYKKLALDALVIQQGRLAEQKSVNKDDLLQMVRFGAEMVFSSKDSTITDEDIDRIIAKGEETTAELDAKMKKFTEDAIKFKMDDNAELYDFDDEKDENKVDFKKLVSDNWIEPPRRERKRNYSESEYFKQALRQGAPAKPREPRIPRMPHLHDFQFFNNQRLNELYEKEVRYLMQANQKKDT

SEQ ID NO: 36672 - DNA, 714 bp, Panicum virgatum
  misc_feature: Ceres CLONE 1986345
  misc_feature: Encodes the peptide sequence at SEQ ID NO. 36673
tctgatattattatcttggatgacaattttgcatcagtcgtgagggttgtcagatggggtcgatccgtttatgcgaacatacagaagtttatacagttccaactaacagtcaacgttgcagctttgataatcaatgtagttgctgctgtcagttctggaaatgtgccgctgaatgctgttcagttgctgtgggtcaacctaatcatggacactttgggtgcccttgcattggcgacagaaccacctacaaaccatctcatggagagacccccagtagggagaagggagtcaatgataacaaatatcatgtggagaaacttgactatcatggctttgtttcaagtttcagttctccttactctcaacttcaagggaataagcctcttgcagttgaaaaatgatgacccagcacatgcagataaagtgaaaaacaccttcatattcaacacatttgttctctgccaggtgttcaatgaattcaattcccgtaaaccagatgagctaaatatgttcaagggcattttaggaaaccacctctttattggcattatagctataacacttatacttcaggcacttatcgtggagtttcttggcaagtttgcctcaacagtcgagctaagctggcagctgtggttggtgtccattggtctggctttcttcagctgggcgttggctttcgtgggaaagcttatacctgttcccaaacgtcca

SEQ ID NO: 36673 - protein, 237 aa, Panicum virgatum
  misc_feature: Ceres CLONE 1986345
  misc_feature (89)..(236): Pfam Name: Cation_ATPase_C Pfam Description: Cation transporting ATPase, C-terminus
  misc_feature: SWISSPROT Homolog: EC 3.6.3.8 Calcium-transporting ATPase
SDIIILDDNFASVVRVVRWGRSVYANIQKFIQFQLTVNVAALIINVVAAVSSGNVPLNAVQLLWVNLIMDTLGALALATEPPTNHLMERPPVGRRESMITNIMWRNLTIMALFQVSVLLTLNFKGISLLQLKNDDPAHADKVKNTFIFNTFVLCQVFNEFNSRKPDELNMFKGILGNHLFIGIIAITLILQALIVEFLGKFASTVELSWQLWLVSIGLAFFSWALAFVGKLIPVPKR

SEQ ID NO: 36674 - DNA, 705 bp, Panicum virgatum
  misc_feature: Ceres CLONE 1986352
  misc_feature: Encodes the peptide sequence at SEQ ID NO. 36675
caaggatgcatttgatggtggtattgaatcattggataggaatgagggttcaaacaatgttctgagcagcattgacgatgaatcaacttcactcgccaccgttgttcatgagctggataaaactgtaggtatttggcgtaaaaatgagtctctagaggacattcagtgcaaccaggctgctccggagtgtacagttaagcataccagaattttgcaacatgctgctgaagtttacacacacaaagtctataagtctcttgaaaaagattttctagatggatgtggtgcaacttcatatcaggaagttcagtgtgatgaaacattgtataggttagagttcattctgcaaagaagtggtccaaaagtttgggtagttttccttaacacctcgaccctggacttgagctgtagttgcaaaaaatttgagaccatgggtgtactttgttcgcatgctctaaatgcactcagtctcaagaatgttgataggattcctgaaaagtatatttttaagcgatggacaaaatatgtcagaaaaggaacatatccatttccagttgatggatttgcagaacaagatcacagctatgcactcatgtatcgtaacacagctatgaggtttgtttatgatctattgatgaagagcaaaagtcatcaaaataccagaaaactaattctggatgtgcttgagagtggagaaaaatcgct

SEQ ID NO: 36675 - protein, 234 aa, Panicum virgatum
  misc_feature: Ceres CLONE 1986352
  misc_feature (123)..(159): Pfam Name: SWIM Pfam Description: SWIM zinc finger
KDAFDGGIESLDRNEGSNNVLSSIDDESTSLATVVHELDKTVGIWRKNESLEDIQCNQAAPECTVKHTRILQHAAEVYTHKVYKSLEKDFLDGCGATSYQEVQCDETLYRLEFILQRSGPKVWVVFLNTSTLDLSCSCKKFETMGVLCSHALNALSLKNVDRIPEKYIFKRWTKYVRKGTYPFPVDGFAEQDHSYALMYRNTAMRFVYDLLMKSKSHQNTRKLILDVLESGEKS

SEQ ID NO: 36676 - DNA, 1851 bp, Panicum virgatum
  misc_feature: Ceres CLONE 1986358
  misc_feature: Encodes the peptide sequence at SEQ ID NO. 36677
accacataacgccagggacccgcacgcgaaaccgccgcgccgtgctccgggcgatcggcgccgcaccgggctcccagtcccaaaccccaccggtcccaaacctccacggctccacctgcggcgccgttgcgtcagcagctcgactccaccaccgcccactcgtacctccgcatcgcatcgccgcgccgcgccgcgccgccgtcatccctcctctagctttcgcttcgctagcgctaccggagaccggaccggacccgccgcgccgccatggatgaggagtacgacgtgatcgtgctgggcacggggctcaaggagtgcatcctcagcggcctcctctccgtcgacggcctcaaggttctgcacatggacagaaatgactactacggaggagattccacctccctaaacctgaaccagctctggaagaggtttaggggggaagagaagccaccagcccatctaggtgcgagcaaagattacaatgtagacatggttccaaagtttatgatggcaaatggaactttggttcgtactctcattcatactgatgtgacaaagtatttgtcattcaaagctgttgatggaagctatgtcttcagcaaagggaagattcacaaggttcctgccactgacatggaggctctaaaatctcctttgatgggtctatttgagaaacgtagagcaaggaacttttttgtttatgtccaaaattacaatgaagctgatccagtaacacatcaggggttggacctcacaaggattacaactagagaattgatttcgaaacatggattgagtgatgacactgtggattttataggccacgcacttgctcttcacagggatgatcgttacctaaacgaaccagcccttgatactgtaaaaaggatgaagctttatgctgagtctcttgcacgcttccaaggaggttcgccttatatttatccattatatgggttgggtgagttgccacaggcttttgcacgtctaagtgctgtttatggtggaacttatatgttaaataagccagagtgcaagggaaagcatgtggtgttacttcagaaggtgaaacggctaaatgcaaaaaggttgtctgcgatccttcttacttgcctaacaaggaagattggaaaagttgcacgtgcaatcgctattatgagccacccaattccaaacacaaatgactcccactcagttcagattattttgccgcaagagcaacttgggcgcaagtcagacatgtatgttttctgttgttcgtacacacacaatgttgcgccaaaagggaagttcattgcgtttgtgtctgcggaagctgagactgataatccgcagtctgagctcaggcctggaattgatctacttggtcaagtagatgagctgttttttgatatgtatgacagatatgaacctgtcaatgaaccatctcttgataattgctttatctcaacgagttatgatgctactacacactttgagacaactgtgacagatgttctcagtatgtacacagcaattaccggacaaaccgttgatctcagcgttgacctgagtgctgccagtgctgctgaagaatactagagatctttgcatttactcaagacaccatactttttaagagcagtgctaggcaggccttgtgcccttgcctggtaatttgcaaagttacttcagctccaccatattgtggtgttcggatccatgcttgcagcagaagcattgtgcaaagttgttagtcggatgatggtggtggttcttttgttacttacatgatggtcgaatggctgtagactttaaactgtgctctttgtactcatcagtgctgtatcataatcacttcttagctatgcg

SEQ ID NO: 36677 - protein, 437 aa, Panicum virgatum
  misc_feature: Ceres CLONE 1986358
  misc_feature (1)..(430): Pfam Name: GDI Pfam Description: GDP dissociation inhibitor
MDEEYDVIVLGTGLKECILSGLLSVDGLKVLHMDRNDYYGGDSTSLNLNQLWKRFRGEEKPPAHLGASKDYNVDMVPKFMMANGTLVRTLIHTDVTKYLSFKAVDGSYVFSKGKIHKVPATDMEALKSPLMGLFEKRRARNFFVYVQNYNEADPVTHQGLDLTRITTRELISKHGLSDDTVDFIGHALALHRDDRYLNEPALDTVKRMKLYAESLARFQGGSPYIYPLYGLGELPQAFARLSAVYGGTYMLNKPECKGKHVVLLQKVKRLNAKRLSAILLTCLTRKIGKVARAIAIMSHPIPNTNDSHSVQIILPQEQLGRKSDMYVFCCSYTHNVAPKGKFIAFVSAEAETDNPQSELRPGIDLLGQVDELFFDMYDRYEPVNEPSLDNCFISTSYDATTHFETTVTDVLSMYTAITGQTVDLSVDLSAASAAEEY

SEQ ID NO: 36678 - DNA, 658 bp, Panicum virgatum
  misc_feature: Ceres CLONE 1986361
  misc_feature: Encodes the peptide sequence at SEQ ID NO. 36679
attcgcatccccattcccccctcgcgcgcatctcgtcgtcgagctccggtccgctcgaggaagggaaggagcggcagcgcgcggccagcccggcaatgacgatgatggcgccgcagccgcatcccctgccgctggcgcagccggcgccgttcggggacaccacgctgaccaaggtgttcgtgggcgggctggcgtgggagacccacaaggacacgctccgcgagcacttcgagcgctacggcgacatcctcgaggccgtcatcatctcccacaagctcaccggccgctccaagggctacggcttcgtgacgttcaaggaggcggacgcggcgaagaaggcgtgcgaggacgccacccccgtcatcaacggccgccgcgccaactgcaacctggcctccctcggcgccaagccgcggccccagccgctgcacctcctccgcccctcgctgccggccaccccggcgccgcacgcgcccgcgctcccgtccccgcaccagcccgcgccagccatcgcggtggggtccaggggcgtctcgccggtgccgtggtactaccacccctccacgacgcccccgtcggccgcgcactacgcccacgccgcgcaccagcagtaccacggcgtgctcccattctaccccgccgccaccacctacgggta

SEQ ID NO: 36679 - protein, 187 aa, Panicum virgatum
  misc_feature: Ceres CLONE 1986361
  misc_feature (27)..(97): Pfam Name: RRM_1 Pfam Description: RNA recognition motif. (a.k.a. RRM, RBD, or RNP domain)
MTMMAPQPHPLPLAQPAPFGDTTLTKVFVGGLAWETHKDTLREHFERYGDILEAVIISHKLTGRSKGYGFVTFKEADAAKKACEDATPVINGRRANCNLASLGAKPRPQPLHLLRPSLPATPAPHAPALPSPHQPAPAIAVGSRGVSPVPWYYHPSTTPPSAAHYAHAAHQQYHGVLPFYPAATTYG

SEQ ID NO: 36680 - DNA, 681 bp, Panicum virgatum
  misc_feature: Ceres CLONE 1986373
  misc_feature: Encodes the peptide sequence at SEQ ID NO. 36681
acctcgccgcgaacaaacagcccattaatccgctgtcgctcagctgatctactcggctccaagtcacagtcactccaccacgctggccatggctctgcaggccgctctcctcccttccactctctccgtccccaagaagggcaacctcgccgccgtggtgaaggacacggctttcctcaccgttccccagaagctgcgggttccgtcgctttcggtgcgggcgcaggccacggcgatggctcccgtggccacccccggggccagcacgtcgaccaaggacgccaagaagacgctgcgccagggggtggtggtgatcaccggcgcgtcgtcggggctcggcctggccgcggccaaggcgctggcggagacgggcaagtggcacgtcgtgatggcgtgccgcgacttcctcaaggcggccaagggcgccggcatggcggagggcagctacaccatcatgcacctggacctggcctccctcgacagcgtccggcagttcgtggacaacttccgccgcgccggcatgccgctcgactcgctcgtctgcaacgccgccatctaccggcccacggcgcggacgccgacgttcacggcggacgggtacgagatgagcgtgggcgtcaaccacctgggccacttcctcctggcgcgcctgctcctggacgacctccgcaagtccgacta

SEQ ID NO: 36681 - protein, 197 aa, Panicum virgatum
  misc_feature: Ceres CLONE 1986373
  misc_feature (72)..(197): Pfam Name: adh_short Pfam Description: short chain dehydrogenase
  misc_feature: SWISSPROT Homolog: EC 1.3.1.33 Protochlorophyllide reductase
MALQAALLPSTLSVPKKGNLAAVVKDTAFLTVPQKLRVPSLSVRAQATAMAPVATPGASTSTKDAKKTLRQGVVVITGASSGLGLAAAKALAETGKWHVVMACRDFLKAAKGAGMAEGSYTIMHLDLASLDSVRQFVDNFRRAGMPLDSLVCNAAIYRPTARTPTFTADGYEMSVGVNHLGHFLLARLLLDDLRKSD

SEQ ID NO: 36682 - DNA, 725 bp, Panicum virgatum
  misc_feature: Ceres CLONE 1986437
  misc_feature: Encodes the peptide sequence at SEQ ID NO. 36683
ccgccgctctcccctcccaaaccccgcgcgcccagatcctagggtttcccgatctcctccccctccccctccgccgcgggtcgccggcgaggagagcaccgccgcgatgttggagctacggttggtgcaggggagcctcctcaagaaggtcctggaggcgatccgcgacctggtcaccgaggccaacttcgactgctccgggaccggcttctcgctgcaggccatggactccagccatgtcgcgctcgtcgccctgctcctccgcgccgaggggttcgagcactaccgctgcgaccgcaacctctccatgggcatgaacctcaacaacatggccaagatgctccgctgcgccggcaacgaagacatcatcaccatcaaggccgacgatggatccgacaccgtcaccttcatgttcgagtcgcccaagcaagataagatcgcggacttcgagatgaagctcatggacatcgatagcgagcaccttggcatcccggattccgagtaccaggccatcgtccgcatgccgtctgctgagtttatgaggatctgcaaggacctcagcagcatcggggacacagttgtcatctcggtgactaaagagggcgtcaagttctcaacgtcgggagatattgggagtgcaaacattgtctgcagacagaaccaaactgttgacaagccagaagaagctaccattatagagatgcaagaaccagttttcttgacgt

SEQ ID NO: 36683 - protein, 206 aa, Panicum virgatum
  misc_feature: Ceres CLONE 1986437
  misc_feature (1)..(125): Pfam Name: PCNA_N Pfam Description: Proliferating cell nuclear antigen, N-terminal domain
  misc_feature (127)..(206): Pfam Name: PCNA_C Pfam Description: Proliferating cell nuclear antigen, C-terminal domain
MLELRLVQGSLLKKVLEAIRDLVTEANFDCSGTGFSLQAMDSSHVALVALLLRAEGFEHYRCDRNLSMGMNLNNMAKMLRCAGNEDIITIKADDGSDTVTFMFESPKQDKIADFEMKLMDIDSEHLGIPDSEYQAIVRMPSAEFMRICKDLSSIGDTVVISVTKEGVKFSTSGDIGSANIVCRQNQTVDKPEEATIIEMQEPVFLT

SEQ ID NO: 36684 - DNA, 1431 bp, Panicum virgatum
  misc_feature: Ceres CLONE 1986441
  misc_feature: Encodes the peptide sequence at SEQ ID NO. 36685
cttcttctgcggcttcgtcttcctccagaccagagtcccacacgcttcccattccactagcccccctccgcgtgagcgcgccggagccgcggatcctgccgccaagaatggaggcatgtccggacgacttccggtgccccatcacgctggaggtcatgacggaccccgtcatcctcccctccggccacaccttcgagcgccgcagcatccagcgctggctcgacggggggcacctcacctgccccgtcaccaacctcccgcttccgccctccccgccgctcatccccaaccacgcgctgcgccgcctcatagccaccgtcgcgccttcagcggtggccgcccccgccccctctgaggggcctgcgcaggggaggcaagaagcggcggcggcggttcagtcctcgtcgtccgtgccggcgctgctgaggctggccaagtccggcgccgccgggcggagggaggtgctggagtccggcaacgcggcggtgctgctgcggcacgcggcggccggggacgaggcggcggcccgggcgctcctgctcctcaccctggacggcgacgacgcgcgcgtcgggctcgtggcggacggcgccgtcgacgcgctctccgccgcggtgcgccacggstgcgcggtcgacgaactcgmrgccacsgcrctmaccagcctcgcyaycgtcgacgtcaacaaatgcagcatcggggcgcacccctcggccatcccggagctggtggggctcctccgccgcggcggcccgcgggagcgccgcgaggcggccacggccctctacgagctctgcaagctgccggagaaccgccgccgcgccgtgcgcgagggcgcggcgcccgcgctcgccgacttcgccgccgtcggctccgcccgcgccgtcgaggtgctcggcctcctcgccaagtgccgcgaggggcgccagcagctgtgcaagatccccggcatcgtgtccgtgctctcgggcgtcgccgggagcggcaactcccgggcaatcgagcaggccgtgctcgtcctcaactggatttgctcggagagcaacgaattggcattggaagcgataaagctgggagctttccagctctgcgagaccctggtgaacgacgacaactgcaagatcgccaagaacgcggtcgaattggcccggacgctcgagacagcgtgattcgaattgggctctgtccagagatgaaatttgtcataattttgatttggcacctgctcgattgggtgctggcctcattgtacagaggtagaaacagcaaaggtgaagcttctcatcttcttctctcgttctgttcatttccccttctcttttcatgttgtagcggcgcagaaagggggacagatcagtagaatttagttcgtgtccatatggttagaacaaaaaaaaaagaacatactagaactgcttccgtgtttcggag

SEQ ID NO: 36685 - protein, 353 aa, Panicum virgatum
  misc_feature: Ceres CLONE 1986441
  misc_feature (5)..(78): Pfam Name: U-box Pfam Description: U-box domain
  misc_feature (180)..(180): Xaa is any aa, unknown, or other
  misc_feature (189)..(189): Xaa is any aa, unknown, or other
MEACPDDFRCPITLEVMTDPVILPSGHTFERRSIQRWLDGGHLTCPVTNLPLPPSPPLIPNHALRRLIATVAPSAVAAPAPSEGPAQGRQEAAAAVQSSSSVPALLRLAKSGAAGRREVLESGNAAVLLRHAAAGDEAAARALLLLTLDGDDARVGLVADGAVDALSAAVRHGCAVDELXATALTSLAXVDVNKCSIGAHPSAIPELVGLLRRGGPRERREAATALYELCKLPENRRRAVREGAAPALADFAAVGSARAVEVLGLLAKCREGRQQLCKIPGIVSVLSGVAGSGNSRAIEQAVLVLNWICSESNELALEAIKLGAFQLCETLVNDDNCKIAKNAVELARTLETA

SEQ ID NO: 36686 - DNA, 1142 bp, Panicum virgatum
  misc_feature: Ceres CLONE 1986463
  misc_feature: Encodes the peptide sequence at SEQ ID NO. 36687
acagtcgtctccccccgttcagagttctgaccaagagtcgcaggctcgcagcatttccccacgcgcacccgaatatggccgctccggccgccgccgccgccgccgccgccgacacagccaccccgcctcctccaccgtcggcagagcccgcggctgcacccgcacccgcacccgcaccggatcaggtctctcatcctccccctcctcagcccgacgcacctgcgcaacccccggcgccagcgcctgcgccaacccccgcgccagcgcctgccccagccccgaagaagcggaagctggaggaggtggggttccatacctccgactactacaagatccgcgccgtcgtcgctgacctgcgtgtccgcttcgtccaggtttaccaagctactgatttccgcaacactgatgctgtgcgtgagatcctgaaagaaataaagggagtcatggaactatccaagaaaatgaggctcaagcttggtgctacatctgagcctgtgaaatcaacagagaagccttcagctgtacctgtgaagccagcagagaagcctgcagctggacctgtgaaggatgagcctgcgaaaccattggagaagccttcagttgaacgtgtgaaggatgaacatgcgaaaccattagagaagccttcagccgaacctgtgtaggatgagcctgtgaaaccattagagaagccatcatctgaacctatgaaggatgagcctgtgaaacccaccgagacggctccagcgggagaaaataatcaagttcccagggtaggtcagactacgatttctcctaataacgcaggtgttgattcagcagtcaagaatgataactcagatgcgcagcagtgaagatgctaagtggggacccaacccagtgagatggcggatcacccatagccgctcgacgaaaacgcagagtgactggtggatccccctaccagcttgagttgtcttgcctctcctggagataattcagtatggatgtgctaaccaaagaagagggatgaggacgtcaagatgcaaattagattgcgttgctcacattcattcattctgtgatgtgtggacctgaataatttgttccatcaaattgtagctgtgtagctggatcgtacgttacattgtgctgttgttaagtag

SEQ ID NO: 36687 - protein, 195 aa, Panicum virgatum
  misc_feature: Ceres CLONE 1986463
  misc_feature: Functional homolog of the protein sequence given in SEQ ID NO 50206
  misc_feature: Useful for making plants with altered carbohydrate content
MAAPAAAAAAAADTATPPPPPSAEPAAAPAPAPAPDQVSHPPPPQPDAPAQPPAPAPAPTPAPAPAPAPKKRKLEEVGFHTSDYYKIRAVVADLRVRFVQVYQATDFRNTDAVREILKEIKGVMELSKKMRLKLGATSEPVKSTEKPSAVPVKPAEKPAAGPVKDEPAKPLEKPSVERVKDEHAKPLEKPSAEPV

SEQ ID NO: 36688 - DNA, 739 bp, Panicum virgatum
  misc_feature: Ceres CLONE 1986465
  misc_feature: Encodes the peptide sequence at SEQ ID NO. 36689
attcatcggcccgtcttgttctttcttgatcgatccatctctctgctgctagctgcaagcaagccagcagctaggcagcagaattaataatagtcatgtccagcttcagctccagctccagcagcacagcggcggcggccgtcctcctccttgccgtctcattggccgccgccgtgaccgtgaacgagcccatcgccgacggcctctcctggagcttctacgactcgtcctgcccctcagtggagggcaccgtgcgctggcacgtcgccgaggcgctccgccgcgacatgggcatcgccgccggactcatcagaatcttcttccacgactgcttcccgcagggctgcgacgcgtccgtcctcctgtctgggtccaagagcgagcagcttgagatccccaaccagacgctgcgccccgaggccctgaagctcatcgacgacatccgcgccgccctccaccgtgcctgcggccccaaggtgtcgtgcgccgacatcaccacgctcgccaccagggacgccgtagtcgccaccggcggcccctacttcgacgtgcctctgggccgccgcgacgggttctcgccggcgtcgagcgacctcgtcggcaccctaccggcccccttcttcgacgtgccgacgctgatggaggcgttcaagaaccggagcctggacacggcggaactggtggcgctctccggcgcgcacaccgtggggcgcgggcactgcgccctcttcagcgaccg

SEQ ID NO: 36689 - protein, 214 aa, Panicum virgatum
  misc_feature: Ceres CLONE 1986465
  misc_feature (53)..(214): Pfam Name: peroxidase Pfam Description: Peroxidase
  misc_feature: SWISSPROT Homolog: EC 1.11.1.7 Peroxidase
MSSFSSSSSSTAAAAVLLLAVSLAAAVTVNEPIADGLSWSFYDSSCPSVEGTVRWHVAEALRRDMGIAAGLIRIFFHDCFPQGCDASVLLSGSKSEQLEIPNQTLRPEALKLIDDIRAALHRACGPKVSCADITTLATRDAVVATGGPYFDVPLGRRDGFSPASSDLVGTLPAPFFDVPTLMEAFKNRSLDTAELVALSGAHTVGRGHCALFSD

SEQ ID NO: 36690 - DNA, 783 bp, Panicum virgatum
  misc_feature: Ceres CLONE 1986512-R
  misc_feature: Encodes the peptide sequence at SEQ ID NO. 36691
cacctcttacaaaccaagtaaacagtggggttttaagaattctaccatatcagaatgctaccatgctggatcggtcaaggattcatgaagcaggacatgttattgatgaacatcgagacatgcgtctggatgtggatagcatgacttatgaagagcttgtagcattggaagagcagataggcgatgtcaatactggtttgacagaaagttacatccaagagaacttgaggtcaactttctatgttccaggagcagctggagtgtctgatcagttttctgagctctctttggagaatgatgcttgcataatatgccaggaagagtacgaagctgaagaacttataggaacccttgaatgcggccacaagtgccatgcggcgtgcataaagcaatggttgatgatgaagaacctctgccccatctgcaagacaacagcgttgtcatcagatagaaggaatggatgactgtcgccaataacattattggttatctacagcgagcaaaatttgctcaactttgtatatatagacacggttgcctgtatttaccgtccccttcactggggacataaactgaggtttccgaaaactgtacagacattttgtaggatattctttaggtgtttaacggccccatggagtgtgaagctcccatgctggccttgctagatgctcccttcctttctattgtacattgtatttatctactcttcttcaaaagagaagcacaagaacctttagttctgtacattctggagttgaaagaaaccaaaagtcttcctag

SEQ ID NO: 36691 - protein, 153 aa, Panicum virgatum
  misc_feature: Ceres CLONE 1986512-R
  misc_feature (101)..(141): Pfam Name: zf-C3HC4 Pfam Description: Zinc finger, C3HC4 type (RING finger)
  misc_feature: SWISSPROT Homolog: EC 6.3.2.19 Ubiquitin--protein ligase
PLTNQVNSGVLRILPYQNATMLDRSRIHEAGHVIDEHRDMRLDVDSMTYEELVALEEQIGDVNTGLTESYIQENLRSTFYVPGAAGVSDQFSELSLENDACIICQEEYEAEELIGTLECGHKCHAACIKQWLMMKNLCPICKTTALSSDRRNG

SEQ ID NO: 36692 - DNA, 1176 bp, Panicum virgatum
  misc_feature: Ceres CLONE 1986512
gatttctctcccccttccgttcccgaaaagctccccgtgcttataaattcgctgctcaccccgtcccgtcgcccccttccgatcgatcccccgccccccctccaccggataccaccgccaccgtcccgccaccaaccgattccgtctcagctcccgtgccgatcgcgacccgccccaccggccgccccgaccccgagagtggtgatgataaaggataattactgaacaaatttgctatagttctccttaaggaaatagaagttgacatcatgtcacatagaaatatggtctggacacatcagtcggttaatcctggatgggaacaaggacatgtccaagttcaatcagaaagttcctattatggaggctctggaattgattcatccaacctgggtgtgcaagttgctgccggagttccaggaaatactgctaatgttggtatctgtgatctgcggaatcatgagtgccagcatgttcataattcatacccacatgttggtgttacatcaagttttgtcttcccaactgctatgcacaaccctggaatggcaacagcagctgttaacatatatattcctcagactcaaagctttggactgggcaatgtgctaccaccatctttatatcatcaagttcccacaggaactatcgatgagagcagcagtagtgtcaattttggtgacacgggtagtggattcatcaaaaggaaaaatgcagttgtggctggtaaccatcattttcttaatgggtttgcaggttcaagttcatctgctcacgtgcctcaggatcctgcacgtgggccatggaatgcttcatttcaatcaaattgtttacccaactctgcagcttcaaacccatcagagttccacagtagcaatggttggccatttttagaaggaccttctgcagatgttcctagcagtttcagttcaatgcctgctcgaccagagttggtacctcatggtaactacgtgtttccaacttgtcacatgggccagtgcaatacatggattccacaggctgcaaatggtgttgctcatggagtaccacagtggggatatagtaattcattggccaatctaccaggaaccacagacatgccgaatgggattgttcaggggcctctacctcatttctcccagaatcctttgcatagtatgcaaatgcaagtacctc

SEQ ID NO: 36693 - DNA, 717 bp, Panicum virgatum
  misc_feature: Ceres CLONE 1986515
  misc_feature: Encodes the peptide sequence at SEQ ID NO. 36694
atgcggcggtgaccgcgcgtacggggcctcgtctctctgcgcacgcgcgcgcggcggccccggccgccgcgccgcccaccaccccggccacccccgcgcccgccgcggccccgcccactaccaccacgcctgcccccgccgcggcgccgcccaagtcctcccccaaggcggccacccccgccccggctcccaaggccaaggccaccccgcccgccaccccaccggtggccgagctgccccctgctgccacaccccccgccccggcagcggacacccccgccgccgcgcccaccaagcccgccgaggtccccgcccccgccccgtccaagaagaagaagaagaagtcatcctcctccaagagcaagaagaagaagagcaaggcccccgccccagcccccgtcgccgaggcccccaccacctccaagcactccaaggctaaggcacccgcgtccagcgaggccgacgcacccggcccggccggcgacggcatcgccgccgataccgcggtaagttgctctccgctctgctctctgcacctgcaacaggaatccattccgcaattccgtcctctcataataaaacggacctgacaaatcatctgtcttcatcatttaccgttagcctttaccattgtttgcttgccattatcagtttatcactggcctgctgtctgctgcagtcagattccagagtagaaagctaacaaagcggttaatc

SEQ ID NO: 36694 - protein, 195 aa, Panicum virgatum
  misc_feature: Ceres CLONE 1986515
  misc_feature: Functional homolog of the protein sequence given in SEQ ID NO 50275
  misc_feature: Useful for making plants with altered carbohydrate content
AAVTARTGPRLSAHARAAAPAAAPPTTPATPAPAAAPPTTTTPAPAAAPPKSSPKAATPAPAPKAKATPPATPPVAELPPAATPPAPAADTPAAAPTKPAEVPAPAPSKKKKKKSSSSKSKKKKSKAPAPAPVAEAPTTSKHSKAKAPASSEADAPGPAGDGIAADTAVSCSPLCSLHLQQESIPQFRPLIIKRT

SEQ ID NO: 36695 - DNA, 646 bp, Panicum virgatum
  misc_feature: Ceres CLONE 1986516
  misc_feature: Encodes the peptide sequence at SEQ ID NO. 36696
acgagcgccagccagtcaccacctacccgaagccgccgcgaccgatcgagccgagcgccccgcccccacgccgcgccgcgccgcgccgccaccgaaaccctagctcctcctcctcctcctcagccatggccaccgtctcgctcacgccgcaggtggtcttctccaccgagtcgggcggcgccctctcctccgccacaatcctccgtttcccgccaaacttcgtgcgccagctcagcaccaaggcccgccgcaactgcagcaacatcggcgtcgcgcagatcgtcgccgcggcgtggtcggactgccccgccggccgcccccactccggcggcggcggcagccgcgcccgcggcgtggcctcctcccacgccgcggccgcatcggccgccgccgccgccgcctccgcggcggcggaggtcagcgcaatccccaacgctaaggttgcgcagccatccgccgtcgtacaggccgagcgtaacctgctcggctccgacgccagccttgccgtccacgcgggcgagaggctgggaagaaggatcgccacggatgcgatcaccacgcccgtagtgaacacgtcggcctactggttcaacaactcgcaagagctaatcgatttcaaggaggggaggcgtgctcgcttcgagta

SEQ ID NO: 36696 - protein, 173 aa, Panicum virgatum
  misc_feature: Ceres CLONE 1986516
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAGRPHSGGGGSRARGVASSHAAAASAAAAAASAAAEVSAIPNAKVAQPSAVVQAERNLLGSDASLAVHAGERLGRRIATDAITTPVVNTSAYWFNNSQELIDFKEGRRARFE

SEQ ID NO: 36697 - DNA, 613 bp, Panicum virgatum
  misc_feature: Ceres CLONE 1986524
  misc_feature: Encodes the peptide sequence at SEQ ID NO. 36698
tggggaggtggggaaaaaatatctccaatcaaacaaaccctagcagcggttgttagggtttcggggagagatggcggcggcggcgaggcagcgcgggacggtgaagtggttcaatgacaccaaggggttcggcttcatctcccccgaggacggcagcgaggacctcttcgtccaccagtcgtcgatcaagtccgagggcttccgctccctcgccgagggcgaggaggtcgagttctccgtctccgagggcgacgacggccgcaccaaggccgtcgacgtcaccggccccgacggatccttcgtcaagggcggctccggtgggggcgggggcggcttcggctcccgcggcggggccggatctggcggcggcggccgcagctatggcggcagctggggcggcggcggtgcacgcagatctggcggcgggggcggcggaggctcctgctacaagtgcggggagcccggccacatggccagggactgccccagcgctgatggcggcggcgggtatggaggcggcggcggcggtggcggctgcttcaagtgtggggagtctggccacatggccagggactgccccagcggcggaggcggctacggcggtggcggctat

SEQ ID NO: 36698 - protein, 180 aa, Panicum virgatum
  misc_feature: Ceres CLONE 1986524
  misc_feature (6)..(73): Pfam Name: CSD Pfam Description: 'Cold-shock' DNA-binding domain
  misc_feature (123)..(140): Pfam Name: zf-CCHC Pfam Description: Zinc knuckle
  misc_feature (154)..(171): Pfam Name: zf-CCHC Pfam Description: Zinc knuckle
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 468 in the 11/479,226 US patent application
  misc_feature: The sequence is a functional homolog of SEQ ID NO 1126 in the 11/479,226 US patent application
  misc_feature: The sequence is a functional homolog of SEQ ID NO 2410 in the 10/374,780 US patent application
  misc_feature: The sequence is a functional homolog of SEQ ID NO 492 in the 10/412,699 US patent application
  misc_feature: The sequence is a functional homolog of SEQ ID NO 552 in the 10/225,066 US patent application
MAAAARQRGTVKWFNDTKGFGFISPEDGSEDLFVHQSSIKSEGFRSLAEGEEVEFSVSEGDDGRTKAVDVTGPDGSFVKGGSGGGGGGFGSRGGAGSGGGGRSYGGSWGGGGARRSGGGGGGGSCYKCGEPGHMARDCPSADGGGGYGGGGGGGGCFKCGESGHMARDCPSGGGGYGGGG

SEQ ID NO: 36699 - DNA, 667 bp, Panicum virgatum
  misc_feature: Ceres CLONE 1986531
  misc_feature: Encodes the peptide sequence at SEQ ID NO. 36700
tctcgctcatttccgcactgcgttctgagcttgatgttgctcgtgctcatgtaaggaggtttatcagagaacaaaaatcagatgcccacgaaattgagggcttaaaaaagcaacttacagaagaaatggaatcttggaaggtgaagcaaaaggagaaggttgcaaatgctctccagttcatagtttcggagctggacagtgagaagaagtcaaggaaaagagcagagaaggcaaacaagaagctaagcattgccttagccaacaatgaagcctcgctgcaggcagcaacaaaagaactcgaaagggaaaagaaatctagaggaagagttgagaagatctgcagcgagctcatcagaggcatcgaccaggacaaggctgaggtggaggcgctgaagagagaaactgagaaggcacaagaagagcttcagaaagaacgtgagatgcttcagcttgcggatgagtggcgcgaacagagagttcagatgaagctgctggaagcacggctacagtttgaggagaagaatgcagctgttaatcagctgcgcgacgaactccaagtgtatctggatactaggaaagaccaggaactaactaatgatccaattcaattgtaccatgcatctgaaactggcgcagctgcagctaatgcagttgcttgcagaaatgg

SEQ ID NO: 36700 - protein, 221 aa, Panicum virgatum
  misc_feature: Ceres CLONE 1986531
  misc_feature: SWISSPROT Homolog: EC 2.7.11.1 Non-specific serine/threonine protein kinase
SLISALRSELDVARAHVRRFIREQKSDAHEIEGLKKQLTEEMESWKVKQKEKVANALQFIVSELDSEKKSRKRAEKANKKLSIALANNEASLQAATKELEREKKSRGRVEKICSELIRGIDQDKAEVEALKRETEKAQEELQKEREMLQLADEWREQRVQMKLLEARLQFEEKNAAVNQLRDELQVYLDTRKDQELTNDPIQLYHASETGAAAANAVACRN

SEQ ID NO: 36701 - DNA, 683 bp, Panicum virgatum
  misc_feature: Ceres CLONE 1986541
  misc_feature: Encodes the peptide sequence at SEQ ID NO. 36702
atctctctccgcaatggcggccgcagctctccggccccatatcaccctcctctccggcggcagcggcccaatccccagcacaacccttcaaatccagccctttgtttctccccttccctttcgcagccgtggccgcaccgtacacgtctccaacgcctcgtcgtccccgtcttccccaccgacgccggagaaggaggcggtggccgaagcggttccgttgcctaccgcggaatcctgcgtcaacctcggcctcgagctcttctccaagggcagggtgagggatgctcttgagcaatttgagaatgccttggagctgaatccaacacctattgaagcccaggcagccctatataacaaggcatgctgccatgcatatagagaagaaagcaaaaaggcagcagaatgtttaaggacagctttgcaggactacaatctcaaatttggtaccatacttaatgatccagacttggcgccgttcagagcatcgccagaatttaaggaacttcaagaagaggctttgcgtggtggagaagatattggttctgggttccgaagagacctgaaactcattagtgaagtacaagcaccattccgtggtgttagaagattcttctatgtagctttaacagcagcagctggaatttcaacattctttaccattccccgacttatactagcagtcc

SEQ ID NO: 36702 - protein, 223 aa, Panicum virgatum
  misc_feature: Ceres CLONE 1986541
  misc_feature (72)..(105): Pfam Name: TPR_2 Pfam Description: Tetratricopeptide repeat
MAAAALRPHITLLSGGSGPIPSTTLQIQPFVSPLPFRSRGRTVHVSNASSSPSSPPTPEKEAVAEAVPLPTAESCVNLGLELFSKGRVRDALEQFENALELNPTPIEAQAALYNKACCHAYREESKKAAECLRTALQDYNLKFGTILNDPDLAPFRASPEFKELQEEALRGGEDIGSGFRRDLKLISEVQAPFRGVRRFFYVALTAAAGISTFFTIPRLILAV

SEQ ID NO: 36703 - DNA, 748 bp, Panicum virgatum
  misc_feature: Ceres CLONE 1986547
  misc_feature: Encodes the peptide sequence at SEQ ID NO. 36704
gtcacctcacctcggcggcgtcttcacaaacgccggcccttgcacgctcgatcgatcgattgatcgtccccccatcgctcgcctccgcaaccgatcggttcgagagagaggttcgcttgatccgaaggcttcgcgtgcgggatcttgaggcgagccgaggagcaagatgagggagtgcatctcggtccacatcgggcaggccggcatccaggtcggcaacgcgtgctgggagctttactgccttgagcacggcatccagcctgatggccatatgcccggagacaagactgtgggacactatgatgatgccttcaccaccttcttcagccagaccggcgcagggaagtacgtgcctcgtgcaatcttcgttgatcttgaacccactgtgatcgatgaggtgcgcactggcatgtaccgtcagctcttccaccctgagcagctcatcagtggcaaggaggatgctgccaacaactttgcccgtggacactacacaattggcaaggagattgttgacctgtgccttgaccgcatccgcaagcttgctgacaactgcactggccttcagggcttcctggtcttcaatgctgttggtggtggcactggttctggccttggttcactcctcctcgagcgcctgtctgtggactatggcaagaaatccaaactgggcttcactgtatacccatctccccaggtgtcaccctccgttgttgagcccctacacagcgtgctctccactcactcactc

SEQ ID NO: 36704 - protein, 193 aa, Panicum virgatum
  misc_feature: Ceres CLONE 1986547
  misc_feature (47)..(193): Pfam Name: Tubulin Pfam Description: Tubulin/FtsZ family, GTPase domain
  misc_feature: Functional homolog of the protein sequence given in SEQ ID NO 50141
  misc_feature: Useful for making plants with altered cell wall content and/or composition
MRECISVHIGQAGIQVGNACWELYCLEHGIQPDGHMPGDKTVGHYDDAFTTFFSQTGAGKYVPRAIFVDLEPTVIDEVRTGMYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSPSVVEPLHSVLSTHS

SEQ ID NO: 36705 - DNA, 740 bp, Panicum virgatum
  misc_feature: Ceres CLONE 1986551
  misc_feature: Encodes the peptide sequence at SEQ ID NO. 36706
gcttcgctctcaccgtatgttctgcatgtgaagagagagacagagagatagatcgagagggtgagagcaagaaagatagactgctagagtgacaaggcacaagctaagcgcagaaacacacacacacacacacacacagcccgaagagaccttcttgtcattgatctcccacggacattgccatttgccaacaggcccaacacgaacgagcagcagcctagttcgccgatgggtctcagattcgcgagcgaaggcagcaacatggctcgcgtactctcgttggtgttgttattggccacgctctcgagcatcctgccgccgtccgcgagccaggcggcaaccaggtgcgagtacccgaggcacgccgggcacgggtacaagcacccggtgggcgtgcggaaggtggtcgtggacgccggcggcgccggcgacttcacctccatccagcaggccgtcgactcagtgccggtgaacaacaccgtgcgcgtcatcgtgcagatcaacgccggcacctacagggagaaggtgctggtgccggcgtcgaagccgtacatcacgttccacggcgccgggcgtgacgtgacggtggagtggcacgaccgtgccagcgaccgcggccccgacgggcagccgctccgcacctacaacaccgcctccgtaaccgtcctctcttactatttcaccgctaagaacatcagcttcaagaacacagctccggcaccgatgcccggcacgcaggg

SEQ ID NO: 36706 - protein, 170 aa, Panicum virgatum
  misc_feature: Ceres CLONE 1986551
  misc_feature (58)..(170): Pfam Name: Pectinesterase Pfam Description: Pectinesterase
  misc_feature: SWISSPROT Homolog: EC 3.1.1.11 Pectinesterase
  misc_feature: Functional homolog of the protein sequence given in SEQ ID NO 51298
  misc_feature: Useful for making plants with altered cell wall content and/or composition
MGLRFASEGSNMARVLSLVLLLATLSSILPPSASQAATRCEYPRHAGHGYKHPVGVRKVVVDAGGAGDFTSIQQAVDSVPVNNTVRVIVQINAGTYREKVLVPASKPYITFHGAGRDVTVEWHDRASDRGPDGQPLRTYNTASVTVLSYYFTAKNISFKNTAPAPMPGTQ

SEQ ID NO: 36707 - DNA, 725 bp, Panicum virgatum
  misc_feature: Ceres CLONE 1986553
  misc_feature: Encodes the peptide sequence at SEQ ID NO. 36708
aaaccgaggagaccaaacgggcggggttgagcaacctcccggatctccagccagcctcctccgcgtcgccgccgcagcgatggccaccccggatctgctcttcaacctgcggaacctcttctacctgggcgcctaccaggcggccatcaacaacagcgacgtcccgggcctcgacgccgccgccgccgccgagcgcgacgccatcgtcttccgctcctacatcgccctcggctcctaccagctggtgatcaacgagatcgactcgtccgccgcgacgtcgctgcaggccgtgaagctgctcgcgctgtacctcaccggggacaaggaaggtgcaatctccagtctcaaggaatggttgagcgattcagcaattgggagcaatcctgttcttcgattgattgctggaattatatttatgcatgagcaggactacaatgaggccctcaagcacacacactctggaggaactctggatttgcatgcattgaatgtccagatcttcattaagatgcatcgttcagactatgctgagaagcaattgaagatcatgcaacaaattgacgaagaccacacactgacacaacttgcaaacgcatggttggacattgctgttggtggctctaagatccgtgaagcttacctcatattccaagactttgctgaaaagtacccaatgacagggatggttctgaatgggaaagcagtttgctgtatgcacatgggaa

SEQ ID NO: 36708 - protein, 215 aa, Panicum virgatum
  misc_feature: Ceres CLONE 1986553
  misc_feature (3)..(215): Pfam Name: Coatomer_E Pfam Description: Coatomer epsilon subunit
MATPDLLFNLRNLFYLGAYQAAINNSDVPGLDAAAAAERDAIVFRSYIALGSYQLVINEIDSSAATSLQAVKLLALYLTGDKEGAISSLKEWLSDSAIGSNPVLRLIAGIIFMHEQDYNEALKHTHSGGTLDLHALNVQIFIKMHRSDYAEKQLKIMQQIDEDHTLTQLANAWLDIAVGGSKIREAYLIFQDFAEKYPMTGMVLNGKAVCCMHMG

SEQ ID NO: 36709 - DNA, 1282 bp, Panicum virgatum
  misc_feature: Ceres CLONE 1986554
  misc_feature: Encodes the peptide sequence at SEQ ID NO. 36710
gtcaaagcgggagcactgcagacgatgttcacgcgggtggccggcgccgtcgccggggaaatccattcatggaaatctcacggcgtgggaggagatcgaggctgaagtggagaggatgtgaaccaccgcccgatggcggcagcgcactaccgctcccaccctcgccgtttatctgatctcttgcttatgctttattgttttgacatttcatatgaagcatcttgcttgttatatttgaatgtccagtgacctttatgcctccttacctgcagactaaaccattgtgccagaacctgtaccggaattcattcacttatcactgccttcaagaggacaaaactctgcagtttgatgatgaaatccagtttctagaacaatgtgagaggaataatgcacgtgtccttgtgcattgcatgacaggggaaaataggtaggcagcatttgttatagccttcttgatgaaatcaaggggatggagactggcacaatcttttcagtgggtgaaagaacggagaccaaagtgcaactatctgatgataattaaccattatcagcccaatcttctctacatgatccaaattaattagaaaggcaagttggctaggcatggttccaaactgtcaatttgagcaaagaaaatggcaaagtgattgggaactgatacattcaataccatctggaacagcttgaggggatcaatcaataatgtgaagctggtagcagtaagttgctctcttgattttctgatgcacaatcattcaaaattaaagcattggagcagcagtcagatcatggaggaggaggagccaaatcagggaaaggggttctaaagtcagctgctagagcaataacccttgtcggcccaatgctctattcatgtcccaaattagatgagtaggagccaacaaaagtatttcaaagctgagctgtgaagtgctgaagtaatcagaagaggaagcaagcagcaacaatgggaggacaagcaccagtccaggcgtcagccgcaaccgagacgacggcgcagtcgatccaagttgttgttcataatcctcctcctgctgccccagagtgccgaggaaggcaaggttgctgatgatgcagctgcctgaaaacaaaaacattatcttctgattctttcttttgtttttttattcgtgaggtacactttaatggcgtggtgagattaatagcttgtgctggcaagctgatagcttgtggaccaggttgtgcatcgctggattaagttaaacagaattttcttggaatatcaagctgtcattat

SEQ ID NO: 36710 - protein, 59 aa, Panicum virgatum
  misc_feature: Ceres CLONE 1986554
  misc_feature: SWISSPROT Homolog: EC 3.1.3.48 Protein-tyrosine-phosphatase
MPPYLQTKPLCQNLYRNSFTYHCLQEDKTLQFDDEIQFLEQCERNNARVLVHCMTGENR

SEQ ID NO: 36711 - DNA, 665 bp, Panicum virgatum
  misc_feature: Ceres CLONE 1986592
  misc_feature: Encodes the peptide sequence at SEQ ID NO. 36712
cacactgtctcctcccccaattcactagcagccctgcactgtgccacggcgccccctccaagctcgccgccaattaatactcacccccaccctcgcatccagccctccccctcctcctcccaccgcaagcaagcacgccgtcgatccgccgcctgccccgcgcgcgcgtggtctctccggcgatcttggaggcggcgctagccgctagctagctgctccgggccggctggcttgctggccaggggcactcgaaggagacgagggcgggagccagccaagtgaagtgaagtgaggcgagatggacctggtgccggtgccgcacccggacagcccgcactccgacaacagcggcggcgccggcatcggcatcggcggcgggggctcggcgtcgggcgcgctgtcgccggcggcgtcgccgagccggtacgagtcgcagaagcgccgggactggaacacgttcgggcagtacctgcggaaccaccgaccgccgctgtccctggcgcggtgcagcggcgcgcacgttctcgagttcctgcgctacctcgaccagttcggcaagaccaaggtgcacaccccggcctgccccttcttcggccacccggcgccgccggcgccctgcccgtgcccgctccgccaggcctggggcagcctcgacgcgctcgtcg

SEQ ID NO: 36712 - protein, 122 aa, Panicum virgatum
  misc_feature: Ceres CLONE 1986592
  misc_feature: Functional homolog of the protein sequence given in SEQ ID NO 51087
  misc_feature: Useful for making plants with modulated low light sensitivity
  misc_feature: Functional homolog of the protein sequence given in SEQ ID NO 51530
  misc_feature: Useful for making plants with modulated nitrogen use efficiency
  misc_feature: Functional homolog of the protein sequence given in SEQ ID NO 50807
  misc_feature: Useful for making plants with modulated flowering time
  misc_feature: Functional homolog of the protein sequence given in SEQ ID NO 50809
  misc_feature: Useful for biocontainment applications
  misc_feature: Functional homolog of the protein sequence given in SEQ ID NO 50808
  misc_feature: Useful for making plants with modulated biomass
MDLVPVPHPDSPHSDNSGGAGIGIGGGGSASGALSPAASPSRYESQKRRDWNTFGQYLRNHRPPLSLARCSGAHVLEFLRYLDQFGKTKVHTPACPFFGHPAPPAPCPCPLRQAWGSLDALV

SEQ ID NO: 36713 - DNA, 755 bp, Panicum virgatum
  misc_feature: Ceres CLONE 1986597
  misc_feature: Encodes the peptide sequence at SEQ ID NO. 36714
  misc_feature (657)..(657): n is a, c, t, g, unknown, or other
aatcgtgtcccagcagcctgtgacctgacctcactctgtccctcacagaagccgatctggtcatcaccaaccagctctcggcagccacacggccggccatggcggcggcaacggctaggcaagccaggcggccagcggccagagcagccctgctggccctcgccgtgtgcctcctgccggcggtggcccgcgcgcagctccgggtggggttctacgacaccacctgccccaacgccgagtcgctcgtccgccaggccgtcgccgccgccttcgccacggacgccggcgtcgccgccgggctcatccgcctccatttccacgactgctttgtcaggggctgtgatgcttcggtcctcctgagcgtgaaccccggcggcgggcagacggagcgcgacgccgccccgaacaacccgagcctccgcggcttcgaggtgatcgacgccgccaaggccgccgtggagcggagctgcccgcgcaccgtgtcgtgcgcggacatcgtggccttcgccgcccgcgacagcgtcggcctcaccggcagcgtcgcgtaccaggtccccgccggccggcgcgacggccgcgtctccaacaagtcggagaccgtcgacctgcctccgccctcgtccacggcgaaggaactcaccgacctgttcgccgccnagaacctcaccctcgaggacatggtcgtcctctccggcgcccacaccgtcggccgctccttctgcaactccttcgtcggccgcgtctgggaaccagac

SEQ ID NO: 36714 - protein, 218 aa, Panicum virgatum
  misc_feature: Ceres CLONE 1986597
  misc_feature (50)..(218): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50376
  misc_feature: Useful for making plants with altered carbohydrate content
  misc_feature: Functional homolog of the protein sequence given in SEQ ID NO 51443
  misc_feature: Useful for making plants with altered cell wall content and/or composition
  misc_feature (187)..(187): Xaa is any aa, unknown, or other
MAAATARQARRPAARAALLALAVCLLPAVARAQLRVGFYDTTCPNAESLVRQAVAAAFATDAGVAAGLIRLHFHDCFVRGCDASVLLSVNPGGGQTERDAAPNNPSLRGFEVIDAAKAAVERSCPRTVSCADIVAFAARDSVGLTGSVAYQVPAGRRDGRVSNKSETVDLPPPSSTAKELTDLFAAXNLTLEDMVVLSGAHTVGRSFCNSFVGRVWEP

SEQ ID NO: 36715 - DNA, 708 bp, Panicum virgatum
  misc_feature: Ceres CLONE 1986599
  misc_feature: Encodes the peptide sequence at SEQ ID NO. 36716
aatcactcccctccacccttcttccctcattccctggcggcgacggctgggcgagcggcgccgcccttcgccggcgacgaccacccaccaggtgctctttgctgtctatcatgtgctgggaaatgcggccgcagctcgggacgtcgcggcgcgccatctggagaagctggcccgtcctatgttcacaccacaagctgtccacatcttcccactccgcaaacaaggtcgccatggccaccgcctccccgccaccagccgagaagaagaggaacaaggacacggtcgttgtcatctcaggcccaaccggcgccgggaagagcaggctcgcgctcgaggtggccaggaggctcggaggcgagatcatcagcgccgactccgtccaagtctaccgcggcctcgacgtcgggtccgccaagccgtccgcggcggagatgggcgcggtgccgcaccacttgatcgacatactggacaccaccgacgattactccgccggggccttcttccgggatgcccgcagagcgacgcagcatgtccttgacaggggccgcgtgcccgtcgtcgcgggagggaccgggctctacctgcggtggtacatctacggcaagccagatgttccgcaatcctccatggacactacttcggctgtgtggtctgagctcatcggtttcagggagagcggccagtgggaggaagcggtggagctagtgg

SEQ ID NO: 36716 - protein, 199 aa, Panicum virgatum
  misc_feature: Ceres CLONE 1986599
  misc_feature (90)..(199): Pfam Name: IPPT Pfam Description: IPP transferase
  misc_feature: SWISSPROT Homolog: EC 2.5.1.8 tRNA isopentenyltransferase
MCWEMRPQLGTSRRAIWRSWPVLCSHHKLSTSSHSANKVAMATASPPPAEKKRNKDTVVVISGPTGAGKSRLALEVARRLGGEIISADSVQVYRGLDVGSAKPSAAEMGAVPHHLIDILDTTDDYSAGAFFRDARRATQHVLDRGRVPVVAGGTGLYLRWYIYGKPDVPQSSMDTTSAVWSELIGFRESGQWEEAVELV

SEQ ID NO: 36717 - DNA, 1303 bp, Panicum virgatum
  misc_feature: Ceres CLONE 1986604
  misc_feature: Encodes the peptide sequence at SEQ ID NO. 36718
acacgacgacatccaccccgagccgagcagagccagttctgctccccttgccgtcctccctccatcgtcctgcacctcgcgagaatccaaagctctatactcgtgtacttgcggcaaacccaaccccgcaccgactccccttcctccgcctcccttgcttctccgggagggaaggcacccgggaggccgccccgccacccttcgccaaaagccacgcgccaccgaacctcttttccctcaccccgtcgctttcgcgttcggcgcgggccccaacccggtgggtcggtcggtcgccgaggcgaagcgggggcgataaaggcgtcgccggcgagaggcgggatgatgagcggcggatcgtcgggcgggagggacgcggagggcgagtgggaggtccggccgggcgggatgctggtgcagcgcagggacggcgaggccgccggccccgccgtcaggatcagggtctcctacggcggaacctaccgtgacgtcatcgtgccggcgcaggccaccttcggtgagctgaagaggatccttgttcagactactggcgtggaacctgagaggcagaggcttttcttccgaggcaaggagaagagtgacagtgagttcctgcacgcagcaggtgtgaaggatggagcaaagttgcttcttcttgagaagcctgcccctgccaccgtggagcagaaggctgagccagtgattatggacgagagcatgatgaaggcatgtcaggccgtagctcgtgtcagagctgaagtagataagctctctgctaaggtgtgtgacttggagaagagtgtgcttggagggagaaaggttgaggataaagaatttgtcgtcttgacggagctgcttatgatgcagctgctgaaactcgatggcattgaagctgaaggagaagcaagggcgcagaggaaggctgaggtgcgccgtgtccagtccctcgtggagaccttggacaagctgaaagctagaaatgctaaccccttcagcgatcacaacaaagctgtttcggtgactacgcagtgggagacttttgagaacggcatgggcagcttgagcgcacccctgccacgtgtttcttcgacccaagacaacactgactgggaacagttcgactaggctctgatgaagctattgatgtatcatggatcttgtgagagatcggtatggacattcctttaactggcagcaaggcgttgtgtatatgcaccacgttggatgccttttgctgttcccactgcctgcgaatgataccaaatgataccgtgtgaaatgcatcgctcgttcgaggctcgttttc

SEQ ID NO: 36718 - protein, 260 aa, Panicum virgatum
  misc_feature: Ceres CLONE 1986604
  misc_feature (132)..(210): Pfam Name: BAG Pfam Description: BAG domain
MMSGGSSGGRDAEGEWEVRPGGMLVQRRDGEAAGPAVRIRVSYGGTYRDVIVPAQATFGELKRILVQTTGVEPERQRLFFRGKEKSDSEFLHAAGVKDGAKLLLLEKPAPATVEQKAEPVIMDESMMKACQAVARVRAEVDKLSAKVCDLEKSVLGGRKVEDKEFVVLTELLMMQLLKLDGIEAEGEARAQRKAEVRRVQSLVETLDKLKARNANPFSDHNKAVSVTTQWETFENGMGSLSAPLPRVSSTQDNTDWEQFD

SEQ ID NO: 36719 - DNA, 659 bp, Panicum virgatum
  misc_feature: Ceres CLONE 1986616
  misc_feature: Encodes the peptide sequence at SEQ ID NO. 36720
gcttcctctccgccgcccgacccgatggcgccgccgctcgccggcgtggtccgcctcgccgcggcttcccgcgtgctggtcctggccctctccctcctcgcccgcctcctcttccgcccctacgacacctccgcgtcgctcgccccgccctgcctctcctcttccccctccgccgcgtccgcgaatctctccgccgccgtttcgtcgctggccgtctgggacggcgtccacttcgcccgcgccgccgagtgcgggtacgagtacgagcagtccttcgccttcctcccgctcctcccggcctccctcgcgctcctcgcccgatccctgttcgcgccgctggtgccggtgctggggtacagggccgtgctcgtgctctccgggtatgtcctcaacaatgtcgcgttcgtcgccgccgcggcctacttctacagattatccgtgttgatcttgaaggaccagagagcagcttatcgagcatctgttctgttctgtttcaaccctgcttctgtattttactcgtcattgtattcggaaagtctttatgccctgttttctcttggaggactgttttacctgttttcgggtgctaatactgttgcagtgataatgctcgctctctctggttcagctaggtccaatggagcacttaatgctggtta

SEQ ID NO: 36720 - protein, 211 aa, Panicum virgatum
  misc_feature: Ceres CLONE 1986616
  misc_feature (1)..(211): Pfam Name: Mannosyl_trans2 Pfam Description: Mannosyltransferase (PIG-V))
MAPPLAGVVRLAAASRVLVLALSLLARLLFRPYDTSASLAPPCLSSSPSAASANLSAAVSSLAVWDGVHFARAAECGYEYEQSFAFLPLLPASLALLARSLFAPLVPVLGYRAVLVLSGYVLNNVAFVAAAAYFYRLSVLILKDQRAAYRASVLFCFNPASVFYSSLYSESLYALFSLGGLFYLFSGANTVAVIMLALSGSARSNGALNAG

SEQ ID NO: 36721 - DNA, 727 bp, Panicum virgatum
  misc_feature: Ceres CLONE 1986619
  misc_feature: Encodes the peptide sequence at SEQ ID NO. 36722
acacacgcacaaacctacatatcgatcaccatctaggaagcacaaaacaacacctactgatcatcgcaagttcagctcaggttaaagggctagacatgtcaagggcgttggagcctctcattgtggggaaggtgattggcgaggtgctggaccacttcaaccccaccgtcaagatgatggtcacctacaactccaacaagcaggtcttcaatggacacgagttcttcccctccgcagtggccaacaagccgcgtgttgaggtccaagggggcgatctcaggttcctcttcacattggtgatgactgaccctgatgtgccaggacctagtgatccatacctcagggagcaccttcactggattgttactgatattcctgggacaactgatgcttcttttgggaaggagctagtgagctacgagaacccaaggccaaacattggcatccacaggttcatattcgtgctgttccggcagagccgccggcaggcggtgaacccgccgccgtcgagggaccgcttcagcacccgccaattcgccgaggagaacgacctgggcctccccgtcgccgccgtctacttcaacgcgcagcgcgagaccgccgcccgccggcgctagccgctgaccaactgcagctgaacgtacgaaacccgaccccaaccaacgaccctacgcacgcacctgatcttgcatggacagacgagaacctacgatttaatcaatcaatt

SEQ ID NO: 36722 - protein, 173 aa, Panicum virgatum
  misc_feature: Ceres CLONE 1986619
  misc_feature (19)..(165): Pfam Name: PBP Pfam Description: Phosphatidylethanolamine-binding protein
  misc_feature: The sequence is a functional homolog of SEQ ID NO 2 in US patent 7208653
  misc_feature: Functional homolog of the protein sequence given in SEQ ID NO 51458
  misc_feature: Useful for making plants with modulated flowering time
  misc_feature: The sequence is a functional homolog of SEQ ID NO 2 in US patent 7196246
MSRALEPLIVGKVIGEVLDHFNPTVKMMVTYNSNKQVFNGHEFFPSAVANKPRVEVQGGDLRFLFTLVMTDPDVPGPSDPYLREHLHWIVTDIPGTTDASFGKELVSYENPRPNIGIHRFIFVLFRQSRRQAVNPPPSRDRFSTRQFAEENDLGLPVAAVYFNAQRETAARRR

SEQ ID NO: 36723 - DNA, 618 bp, Panicum virgatum
  misc_feature: Ceres CLONE 1986636
  misc_feature: Encodes the peptide sequence at SEQ ID NO. 36724
gattctcatccatcccttccctcaaccaccgctgtctcttcctccgcccgtgcgccgccgcccgcccgcccctccctgcgccgccgccatcacgcctccgcctgcccgcccctgcgccgccgccgtcacgccgcggccagcctccgccgcgctcgcccctgctgccgccgcggcgctcgcccgccggagctcctctgccgcgcgctcgcccgcctctggtcgacgccctcctgcgcaggcccgccggagctccgccgccgccgcccgccgccggcgctggggaagaatacattgttgggccttcgtgggctttaaagctacgcccgccaccgaattcaggcatgggagaaggtggagaagagaaatcattcaatttccttcaggttttgctcgagggcagcatagctggaggaaccgctggtgttgtggttgaaacggcgctgtaccctattgacacgataaaaaccaggcttcaggctgctcgaggtggaagccgaattgaatggaaaggcctctattctggattggctggaaatcttgctggtgttctcccggcttctgcgatatttgtgggagtgtatgaaccgactaaaagaaaactattggagacacttcctg

SEQ ID NO: 36724 - protein, 92 aa, Panicum virgatum
  misc_feature: Ceres CLONE 1986636
  misc_feature (15)..(91): Pfam Name: Mito_carr Pfam Description: Mitochondrial carrier protein
MGEGGEEKSFNFLQVLLEGSIAGGTAGVVVETALYPIDTIKTRLQAARGGSRIEWKGLYSGLAGNLAGVLPASAIFVGVYEPTKRKLLETLP

SEQ ID NO: 36725 - DNA, 716 bp, Panicum virgatum
  misc_feature: Ceres CLONE 1986653
  misc_feature: Encodes the peptide sequence at SEQ ID NO. 36726
agtcttcacgctccaacgaccaccgcgatcgaggcagcccgttcgccgctccgcccgccggccgccgtcacccggcagcgagcatgcaccacgatcccaaccccttcgacgagggcgccgacgacaaccccttctcgaatggaggaggaggaggtgcaggagcgcgtggtggaggcggcaagtcgcagttcgggttccggccggcggagcccgtcgggttcggcggcggcaggggcgacgcgaccgtcggcatccccctcgacaccatgaacgattcgaagggcaaagcgaaggagctgtcgcaatgggaatcagatctcaggaggcgagaggcggatatcaggaggagggaggaagctctcaagagtgctggggtgcccatggaggacaagaactggccgccattcttcccaatcatccaccacgacattgccaatgagataccagcaaacgctcagaagttgcagtatcttgcgttcgcgagctggcttggcatagtgctttgtctcttctggaattttattgctgtcattgtctgttggatcagagggggagattccaagctatttttcctggctacaatctatggtatgcttggcatccctttgtcctacttgatgtggtataggcctctctaccgagcaatgagaactgacagtgctttcagctttggatggtttttcctatgttacctgctccacattggcttttgcata

SEQ ID NO: 36726 - protein, 210 aa, Panicum virgatum
  misc_feature: Ceres CLONE 1986653
  misc_feature (101)..(210): Pfam Name: SCAMP Pfam Description: SCAMP family
  misc_feature: Functional homolog of the protein sequence given in SEQ ID NO 50850
  misc_feature: Useful for biocontainment applications
MHHDPNPFDEGADDNPFSNGGGGGAGARGGGGKSQFGFRPAEPVGFGGGRGDATVGIPLDTMNDSKGKAKELSQWESDLRRREADIRRREEALKSAGVPMEDKNWPPFFPIIHHDIANEIPANAQKLQYLAFASWLGIVLCLFWNFIAVIVCWIRGGDSKLFFLATIYGMLGIPLSYLMWYRPLYRAMRTDSAFSFGWFFLCYLLHIGFC

SEQ ID NO: 36727 - DNA, 739 bp, Panicum virgatum
  misc_feature: Ceres CLONE 1986657
  misc_feature: Encodes the peptide sequence at SEQ ID NO. 36728
ttttgcccccctccctcctccccacctctcgttctctcctccctcctccgcctccccacccctctcccttctcgcgcgcgcgcccccgcccagatctagggttcccccgcggcgaagatgagcagcccccatggcggcctcgacgaccagatcgagcggctcatgcagtgcaagccgctccccgagcccgaggtcagagcgttgtgtgagaaggcgaaggagattctgatggaggaaagcaatgttcagcctgtaaagagtcctgttacaatttgtggtgatattcatggacaatttcatgatcttgctgaactcttccggattggtggaaagtgtccagatacaaactacttgtttatgggagattacgttgaccgtggctactattctgttgaaactgtcacgcttttggtggctttaaaagttcgctatcctcagaggatcaccattctcagaggaaaccacgaaagccgacagatcactcaagtttatggattctatgatgagtgcttaaggaagtatggaaatgcaaatgtctggaaaaccttcacggacctctttgactacttccccttgacagcattggttgagtcagaaatattttgcttgcatggtggattatcaccatctatcgagaccctcgataacatccgcaacttcgatcgcgtccaagaagttcctcatgaaggtccaatgtgtgatcttctgtggtctgatccagatgatcgatgtggttggg

SEQ ID NO: 36728 - protein, 207 aa, Panicum virgatum
  misc_feature: Ceres CLONE 1986657
  misc_feature (48)..(189): Pfam Name: Metallophos Pfam Description: Calcineurin-like phosphoesterase
  misc_feature: SWISSPROT Homolog: EC 3.1.3.16 Phosphoprotein phosphatase
  misc_feature: The sequence is a functional homolog of SEQ ID NO 13 in US patent 7271316
MSSPHGGLDDQIERLMQCKPLPEPEVRALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGW

SEQ ID NO: 36729 - DNA, 1419 bp, Panicum virgatum
  misc_feature: Ceres CLONE 1986660
  misc_feature: Encodes the peptide sequence at SEQ ID NO. 36730
aaaacccgcaacagtaaacacgcgcactcatcacactccccaagctaagccaaagctcccctcaccccatggcagcagcaatgccgcggctccccacctcctcgtcccccctcctgccgtgcctcctcctcctcctcctcgccgcgccgtgccccgcggcgcgggccgcgcggttcgcgtgcaatgccacggcgccgcgggcctccacgtgccaggcgctcatctcctacgcgccgcccaacggcacggccgcggccacgctcgccgccgtgcgcgcgctcttccagctccgctcccaccgcgcgctgctggcggccaacggcctcccgctctccacgccgcccacggcgcccgcgcccgcgccgctgcgggtgcgcctgccctgcctctgctcgggcggcgccggggccaccttccagcggcccacctaccgggtccgcgccggggacacgctcgacgccatcgcgcggcacgccttcgcgggcctcgtcacctaccaggacatcgccgccgccaacaacgtctccgaccccaacaaggtcgccgtcggccagcagctctggatccccgtgccctgcagctgcgaccccgtcggcggtgaccccgtcgtgcacctcacgtacgtcgcgccggccgggagctccgtcgccggcatcgcgcaggagttcggctacacggaggagaccattctcgcggtgaacaagatgcccgacgccaagggccttctcgctggccaggttcttgatgtgccgctccgaacttgtggttctgcgattagcaacacagccattgaccgcaaccttcttgtcccaaatggaagctacatcctcactgctaacaactgtgtcaagtgtggctgcagttccagcacatggcagttggactgccagccagcacagggattaagctcgtcgttctgccctaccgccaagtgcggggacatgttccttggcaacacatcctccacctcatcctgtgagagcaggacgtgctcctacgctgggtacaccaacagcacatctttcgccatcctcaccaacatcaccaccagcaacgtgtgcaatgctgggatggctccaatggcgcagccggctcattccttggcattccggttggagtctgcgcggttgagatggacggagctggttgtctctcttcacgtcgtcttgctctgtctaggctatctgcgccaagactgaatgctgctgtcatctgtattttgttagactctgggcccctgattcgtagcttgatgttgtgagtaatgtggtgcagtgcttgcgagactttggcctgtacctggttggatctgcaagtgcaaacgcaaggggaacactttgttttgtgttagaaggtagatcaggaaacaattgtactttgtcaaacttttgcaaagatactttctctggttatgatttt

SEQ ID NO: 36730 - protein, 376 aa, Panicum virgatum
  misc_feature: Ceres CLONE 1986660
  misc_feature (121)..(167): Pfam Name: LysM Pfam Description: LysM domain
  misc_feature (185)..(228): Pfam Name: LysM Pfam Description: LysM domain
  misc_feature: SWISSPROT Homolog: EC 3.5.1.28 N-acetylmuramoyl-L-alanine amidase
MAAAMPRLPTSSSPLLPCLLLLLLAAPCPAARAARFACNATAPRASTCQALISYAPPNGTAAATLAAVRALFQLRSHRALLAANGLPLSTPPTAPAPAPLRVRLPCLCSGGAGATFQRPTYRVRAGDTLDAIARHAFAGLVTYQDIAAANNVSDPNKVAVGQQLWIPVPCSCDPVGGDPVVHLTYVAPAGSSVAGIAQEFGYTEETILAVNKMPDAKGLLAGQVLDVPLRTCGSAISNTAIDRNLLVPNGSYILTANNCVKCGCSSSTWQLDCQPAQGLSSSFCPTAKCGDMFLGNTSSTSSCESRTCSYAGYTNSTSFAILTNITTSNVCNAGMAPMAQPAHSLAFRLESARLRWTELVVSLHVVLLCLGYLRQD

SEQ ID NO: 36731 - DNA, 1641 bp, Panicum virgatum
  misc_feature: Ceres CLONE 1986665
  misc_feature: Encodes the peptide sequence at SEQ ID NO. 36732
acgtcgtcctcctccgactcttgtccctcgagtcgagagttgcttttgttcctccacccgccatccacgcagtgaggttccccgatggcggagcagcctcctagctctgcgccgcaagatagttctggtgggactgaatccttcgacaatctggtaattcaagctccacagccggtgagggaggattacatacagaatgctgttaagtttctttcacatccgaaggtgaagggttctcccgtattccacaggcgatccttccttgaaaagaaaggccttacaaatgaagaaattgatgaagcctttcgtagggttcctgaccctaagccaaatggaactgaaactgcatctgctggttcacaacaagcaaacaaccacaaccaatctgatgcactgcaaccttatgcggaacaaccacaagctgctactggctctatcactgctggaactatttcgccacatacgaaggcacagtttagctgggtcaacacactccttggtgcaggtctttttcttggtttgggggctagtgctgccataaccctcaagaaatggtttatccctagtctaaaatcttggacccgtacagtcgttgctgaagaagatgagaatgcgaaggatgaactcagttgcaaactctacgaagaaattagggaagccataaacatttctgcatcaaccttttctgatatagctagaacaaaccaagaagtgcttgcttcgaaagatgaagataggaaggtacttatgaagttaacggaagcatttgagtcacaagcaaatgtgtttaaatccttgaatgagaccttattaaatcatatcagggagaatcggttttcacaatacaacctattggaagagcatgttcagcctgcaccatggaatggggcgattgactatcaagggagagcttctccgcaaactaatatgtatccaacaccaccaaacagcagttttgactcagggaggcattcattcatgccattgcctgaacccacttatggatcatattctggatcttacactgagcgcgtgcagaggccagggtacggattccagccccagatgagcaatgaccgacagaacctcagtttgcggagcaactaccaaggggtttctttgaatcaccacaccggcaatgccattgatgaccctgcagtggttgcagtggaattccagcgccgctgggtccccccgcagccaccaggtgtcatcatgccggaagctgcggccgcgatccgacagcccaggtctgttccaaggcagcagtcgcagccagtcgatggtcactcgagcaccgatgttctgagaccatctgagcgcgttgtggcgacaacagagcagatgaacggcacccctggagcacctgatggagagttggcaggtgatggcggtgccgcgacagccagcgccagcagcagcggtgggagtgaagagcagcagcaggaagccgcttgagggaagcttttggtgatgcccttgcagagctccattgctgagtggtatatttgggttttgctgcacctatttgtgtttagcgtacagcagatatgaaagtttacccatctcatgtataaagttgcaactgtatgactgtatgtacatataccactgccactcaggaaagtaataattcgatgt

SEQ ID NO: 36732 - protein, 457 aa, Panicum virgatum
  misc_feature: Ceres CLONE 1986665
  misc_feature (31)..(162): Pfam Name: Pex14_N Pfam Description: Peroxisomal membrane anchor protein (Pex14p) conserved region
MAEQPPSSAPQDSSGGTESFDNLVIQAPQPVREDYIQNAVKFLSHPKVKGSPVFHRRSFLEKKGLTNEEIDEAFRRVPDPKPNGTETASAGSQQANNHNQSDALQPYAEQPQAATGSITAGTISPHTKAQFSWVNTLLGAGLFLGLGASAAITLKKWFIPSLKSWTRTVVAEEDENAKDELSCKLYEEIREAINISASTFSDIARTNQEVLASKDEDRKVLMKLTEAFESQANVFKSLNETLLNHIRENRFSQYNLLEEHVQPAPWNGAIDYQGRASPQTNMYPTPPNSSFDSGRHSFMPLPEPTYGSYSGSYTERVQRPGYGFQPQMSNDRQNLSLRSNYQGVSLNHHTGNAIDDPAVVAVEFQRRWVPPQPPGVIMPEAAAAIRQPRSVPRQQSQPVDGHSSTDVLRPSERVVATTEQMNGTPGAPDGELAGDGGAATASASSSGGSEEQQQEAA

SEQ ID NO: 36733 - DNA, 715 bp, Panicum virgatum
  misc_feature: Ceres CLONE 1986682
  misc_feature: Encodes the peptide sequence at SEQ ID NO. 36734
aacccccgagctcggcggcgacggcgcgggcgacccgagcgcgccgccatgaaggtctccatcaagacgctcaagggctccagcttcgagatcgagatggacccctccagcaaggttgctgatgttaaaaagctcattgagactacacaagggcagaatgtctacccagctgatcaacagatgcttattcatcaagggaatgttctaaaaaatgagacgacactcgaagagaacaaagttcttgagaacaatttcattgttataatgttgtccaagaagggatcatcaagtgctggtactgctaaggctcccacaagtcagacctcagttgatagggcgattcctgcctcccctgcaactcaaccaccagcagcagcaccagcacccattgtgcctgttagtgcacctgccccaactgcagcagctggtccagctccaacctctacggcaatcactgaagcggatccttatggtcaagctgcgtcaaaccttgttgctggtggcaatctagaagcaactatacagtctattcttgaaatgggtggaggcgcatgggaccgtgacactgttgtgcgggctcttcgggctgcatataacaacccagagcgtgctgttgaatatttatattctggggttcctgagcaggaagaggcccctgctgttactgctgctgcaccagctcctgcaagcggccaacctgctgatccagttcagg

SEQ ID NO: 36734 - protein, 222 aa, Panicum virgatum
  misc_feature: Ceres CLONE 1986682
  misc_feature (6)..(79): Pfam Name: ubiquitin Pfam Description: Ubiquitin family
  misc_feature (153)..(192): Pfam Name: UBA Pfam Description: UBA/TS-N domain
MKVSIKTLKGSSFEIEMDPSSKVADVKKLIETTQGQNVYPADQQMLIHQGNVLKNETTLEENKVLENNFIVIMLSKKGSSSAGTAKAPTSQTSVDRAIPASPATQPPAAAPAPIVPVSAPAPTAAAGPAPTSTAITEADPYGQAASNLVAGGNLEATIQSILEMGGGAWDRDTVVRALRAAYNNPERAVEYLYSGVPEQEEAPAVTAAAPAPASGQPADPVQ

SEQ ID NO: 36735 - DNA, 755 bp, Panicum virgatum
  misc_feature: Ceres CLONE 1986683
  misc_feature: Encodes the peptide sequence at SEQ ID NO. 36736
gttctaaacaacacgaacaacccaagaaaagcactttacggaacggtgaacaatgtgcgggggcgccatcctcgcggagctgatcccgtcgccgcgccgggcggcgtcgaagccggtgaccgcgggccaccttaggccggcgggctccgactccaagaaagccggcagcgggaggagcaagaggcaccagctcgccgacgtcgacgactttgaggccgccttcgaggacttcgccgacgattttgacgaggaggaggtcgaggacgaccaccacttcgtgttctcgtccaaatccgcattctccccagcccacggcgggcgcgcggcgccggcgacccagaagaagcgcggccgccgccacttccgcggcatccggcagcgcccctggggcaagtgggcggcggagatccgcgacccgcacaagggcacccgcgtctggctcggcaccttcaacaccgccgaggacgccgcccgggcctacgacgtcgaggcacgccgcctcagcggcagcaaggccaaggtcaacttccccgcggccggcgcgcgcccacgccgcggcaacgcgccgagaccgcagcgccaccatgctgcagcgcagcccgcgttgctcgcaggagagaagcagagggaggaggaggtcgtggtgaagcctgaaattggggcgtcgttcgacgtgggcagcttcttcgacatgaccttctccgccttccccgcggcggcgccgggcatggagagctccttcaccggcagcgccc

SEQ ID NO: 36736 - protein, 234 aa, Panicum virgatum
  misc_feature: Ceres CLONE 1986683
  misc_feature (102)..(153): Pfam Name: AP2 Pfam Description: AP2 domain
  misc_feature: Functional homolog of the protein sequence given in SEQ ID NO 50249
  misc_feature: Useful for making plants with altered lignin content
MCGGAILAELIPSPRRAASKPVTAGHLRPAGSDSKKAGSGRSKRHQLADVDDFEAAFEDFADDFDEEEVEDDHHFVFSSKSAFSPAHGGRAAPATQKKRGRRHFRGIRQRPWGKWAAEIRDPHKGTRVWLGTFNTAEDAARAYDVEARRLSGSKAKVNFPAAGARPRRGNAPRPQRHHAAAQPALLAGEKQREEEVVVKPEIGASFDVGSFFDMTFSAFPAAAPGMESSFTGSA

SEQ ID NO: 36737 - DNA, 1271 bp, Panicum virgatum
  misc_feature: Ceres CLONE 1986690
  misc_feature: Encodes the peptide sequence at SEQ ID NO. 36738
atctctctctctctctctccgcaacacacaaaccattgatagatagttgataccaataccagtcaccgatccatggacatggcgtcgacgctgcagctgccggcgcgcgtggaggcgctcagcggcctctccgccatcccgcccgagtacgtccgccccgccgacgagcgagccgacctcggagacgccttcgacgtcctggcgcgcgacgacaccggtaccgcgccgcggatccccgtcgtcgacatctcccccttcctgctccgcgccgacaacgaggaccgcgtagtggaggccgtgcgcgccgccgccgccgactggggcgtcatgcacatcgccggccacggcatccccgccgaggtcatggaccgcctgcgcgccgccggcgccgccttcttcgccctccccatccacgccaaggaggcctacgccaacgaccccgccgccggccgcctccagggctacggcagccgcctcgccgccaacgccagcgggcagcgcgagtgggaggactacctcttccacctggtgcaccccgacgccctggccgagcacgcgctctggcccgcgcacccgccgggctacgtcgccgccacgcgcgagttcggccgccgcatccgtgagctggcctcggcgctgctggccatcctctccgcggggctcctcggccccggccgcggggacgcgctggagaaggagctcaccggcgcggaaggcgacgacctgcggctgcagctcaagatcaactactacccgcggtgcccgcagccggagctggccgtcggcgtggaggcccacacggacgtgagcgcgctgtccttcgtcctccacaacggcgtgccggggctgcaggtgcgccacgccggccgctgggtcacggcgcgcgacgagccgggcaccatcatcgtgcacgtcggcgacgccctcgagatcctcagcaacggccgctacaccagcgtgctgcaccggggcctcgtcaaccgcgacgccgtgcgcgtctcctgggtcgtcttctgcgagccgccgccggacgccgtgctgctgcgcccgctgccggacctcgtcacgccggaccacgcgcccaggttcacgccgcgcaccttcaggcagcacctcgaccgcaagctcttcaacaaggcagctgctgcttgtattggtcacgacgaagagcagcaccagcagaacgaggaataatgagccaccatccccatcgccaccatatattaattattattgcatcatccggccacgcatatatttaattatatttc

SEQ ID NO: 36738 - protein, 373 aa, Panicum virgatum
  misc_feature: Ceres CLONE 1986690
  misc_feature (218)..(317): Pfam Name: 2OG-FeII_Oxy Pfam Description: 2OG-Fe(II) oxygenase superfamily
  misc_feature: SWISSPROT Homolog: EC 1.14.11.19 Leucocyanidin oxygenase
MDMASTLQLPARVEALSGLSAIPPEYVRPADERADLGDAFDVLARDDTGTAPRIPVVDISPFLLRADNEDRVVEAVRAAAADWGVMHIAGHGIPAEVMDRLRAAGAAFFALPIHAKEAYANDPAAGRLQGYGSRLAANASGQREWEDYLFHLVHPDALAEHALWPAHPPGYVAATREFGRRIRELASALLAILSAGLLGPGRGDALEKELTGAEGDDLRLQLKINYYPRCPQPELAVGVEAHTDVSALSFVLHNGVPGLQVRHAGRWVTARDEPGTIIVHVGDALEILSNGRYTSVLHRGLVNRDAVRVSWVVFCEPPPDAVLLRPLPDLVTPDHAPRFTPRTFRQHLDRKLFNKAAAACIGHDEEQHQQNEE

SEQ ID NO: 36739 - DNA, 126 bp, Panicum virgatum
  misc_feature: Ceres CLONE 1986690-R
aacaaggcagcggcggccggaacgggccacgacgaagagcagcaccagcagaacgaggaaaaaggagccaccacccccaccgccaccaaaaagaaaaaaacaaggcaccacccggccacgcaaaaa

SEQ ID NO: 36740 - DNA, 628 bp, Panicum virgatum
  misc_feature: Ceres CLONE 1986700
  misc_feature: Encodes the peptide sequence at SEQ ID NO. 36741
accttgcgcctgtcgacagaattcagctccagctcctgctccggtcgttcgagaatgtcaagccttgaggagccgcttggtctcggagacctgccaaagttgagtattaacagacttggaagcttctcccagccaagtgcttatcgtagggcagccgctgatgaccgaaacactcgcaatcgcaggtacaacagctcctgcaatggtggcgcgcccatggtcttccatgccaattctcatgcatggcaccagcaatgccgtcaggccgattcatcatgcgatgcagtggacgtggagcttagagatctccctcggaaggttatgtgggatctaccaagctttgtgaagattgttggagttggaccccgagatggcctgcaaaacgaaaagggcaatgtaccaacatctgtaaagatacaaccgatacacaaattagtggctgcaggtttatcagtagttgaagccacaagttttgtatccccaaaatttgtgccgcagctagctgatgcaaaggaagccctcaaaggtatccagcagatgccaaatgtgcgatatcctgtgttaactcctaacctcagtgtaagttctatatcttttcttatagaactctactacactcacagcatct

SEQ ID NO: 36741 - protein, 191 aa, Panicum virgatum
  misc_feature: Ceres CLONE 1986700
  misc_feature: SWISSPROT Homolog: EC 4.1.3.4 Hydroxymethylglutaryl-CoA lyase
MSSLEEPLGLGDLPKLSINRLGSFSQPSAYRRAAADDRNTRNRRYNSSCNGGAPMVFHANSHAWHQQCRQADSSCDAVDVELRDLPRKVMWDLPSFVKIVGVGPRDGLQNEKGNVPTSVKIQPIHKLVAAGLSVVEATSFVSPKFVPQLADAKEALKGIQQMPNVRYPVLTPNLSVSSISFLIELYYTHSI

SEQ ID NO: 36742 - DNA, 692 bp, Panicum virgatum
  misc_feature: Ceres CLONE 1986707
  misc_feature: Encodes the peptide sequence at SEQ ID NO. 36743
aggcagccagaacagggcaacaggcggcaccagctcagctcgtcgtcactctcctcctcagtcctcaccacccacctaccactcccctcactgctaatagatagctcatctcagctcgtctttccttgctccagccagctccatccacccaactaaccatggagatgcgggtggcgctggccctgctcgtggtcgccgtggcggcgtcgcagctgccgtcggcggcggaggcggccaactacacggtgggcgacgacaagggctggaaccccgatgtggactacacggcctgggtcaagaagcacaagccattctacaagggggactggctcatcttcgagtaccagacggggcgtgcggacgtggtgcaggtgggcgaggtggggtacgacaagtgcgacaaggccggcgccctcagcagctacagcaagggcacctcctacgccttccagctcaaggaggccaaagactactacttcatctgcagctacggctactgctacaccggcatgaagctccacctcaccgccaagccctccggcacctcctccggcaagcagagcggcagcggctcctccgatggttcctcatctgatgatgattcctcctcttccgatgactcctccgacacgccctcgccatcctccaagaaagccaagcccaagtcgtcgtccagcgccgcgtcgccgttc

SEQ ID NO: 36743 - protein, 177 aa, Panicum virgatum
  misc_feature: Ceres CLONE 1986707
  misc_feature (36)..(118): Pfam Name: Cu_bind_like Pfam Description: Plastocyanin-like domain
MEMRVALALLVVAVAASQLPSAAEAANYTVGDDKGWNPDVDYTAWVKKHKPFYKGDWLIFEYQTGRADVVQVGEVGYDKCDKAGALSSYSKGTSYAFQLKEAKDYYFICSYGYCYTGMKLHLTAKPSGTSSGKQSGSGSSDGSSSDDDSSSSDDSSDTPSPSSKKAKPKSSSSAASP

SEQ ID NO: 36744 - DNA, 579 bp, Panicum virgatum
  misc_feature: Ceres CLONE 1986713
  misc_feature: Encodes the peptide sequence at SEQ ID NO. 36745
gaacgctcaaagctccattagaaaaaccacagcagaagaccaaccagagatctaccgatccgacgccagcggcaaccgcagcgctataaaatggccgctccggcctcctcgtccgccgccgcagccgccgcgcccgcgtcttcgtcaccgcccaagcctccaaacaacgccgccaccagcaccaccacgaccaccatgctcgatccacagtcgtcgccctaccccgacgccgcggcctccagcgtcagctccgcaagcagcagcagcagcagcagccaggcggaccggtcgtcgaccttctccctggactcctcgtcggacgcgacgccgtcgtcgtccccgcggcgcccgcaccgggcgagcgacgtggcgtgggcgcccatccggggccgggcgctcgggccgcgggacttcacgctcctccgccgcgtcggggccggggacatcggcaccgtctacctctgtcgcctcgagggcggccaggccgaggccgccgcccccgcgtgcgcctacaccatgaaggtggtggaccgccgcgcgctcgccaggaagggcaagctgggccgcgccgccgccgag

SEQ ID NO: 36745 - protein, 162 aa, Panicum virgatum
  misc_feature: Ceres CLONE 1986713
  misc_feature: SWISSPROT Homolog: EC 2.7.11.1 Non-specific serine/threonine protein kinase
MAAPASSSAAAAAAPASSSPPKPPNNAATSTTTTTMLDPQSSPYPDAAASSVSSASSSSSSSQADRSSTFSLDSSSDATPSSSPRRPHRASDVAWAPIRGRALGPRDFTLLRRVGAGDIGTVYLCRLEGGQAEAAAPACAYTMKVVDRRALARKGKLGRAAA

SEQ ID NO: 36746 - DNA, 606 bp, Panicum virgatum
  misc_feature: Ceres CLONE 1986721
  misc_feature: Encodes the peptide sequence at SEQ ID NO. 36747
actagctttccccttctctgcagtccgggaagcacacggcggaagcaagggattaaagggaccatggggcagaagcatcttctgttgctcacttgtttttgggtcctgtcatgtgccttactgcttcatgcttcctccgatggactgctaagaatcaacctcaacaagaagagactggacaagggagctttgactgctgcgaaattggctaggcatgagactcgccttcggagaaggtttgatggttctcgccagtctcttggtgactcaagcgatgacatagttcctttggacaactacctggacactcaatactttggagagattggcatcggcacgccaccacagaacttcactgtgatattcgacactggaagctccaacttgtggattccctcctcaaaatgctatttctcgatagcatgctacttacaccacagatacaggtcagtcaagtcgaagacttacaaaaagaacggggaaacttgcacaataacatatggttctgggcaaattgctggcttcttcagtgaagacaatgtgttggtgtggacaatgtttgaacatgctgccacctaatcataattttcgtgatgaacatcataa

SEQ ID NO: 36747 - protein, 171 aa, Panicum virgatum
  misc_feature: Ceres CLONE 1986721
  misc_feature: SWISSPROT Homolog: EC 3.4.23.40 Phytepsin
MGQKHLLLLTCFWVLSCALLLHASSDGLLRINLNKKRLDKGALTAAKLARHETRLRRRFDGSRQSLGDSSDDIVPLDNYLDTQYFGEIGIGTPPQNFTVIFDTGSSNLWIPSSKCYFSIACYLHHRYRSVKSKTYKKNGETCTITYGSGQIAGFFSEDNVLVWTMFEHAAT

SEQ ID NO: 36748 - DNA, 723 bp, Panicum virgatum
  misc_feature: Ceres CLONE 1986744
  misc_feature: Encodes the peptide sequence at SEQ ID NO. 36749
cccaaaacatctctcacccaagactttactttcgctcaagactagcgataacaaagaccttctctcgtccgattactatctatccacatcactttcgcgacagatcaccgccaccatgcagatcttcgtcaagaccctaaccggcaagaccatcaccctcgaggttgagtcttccgacactatcgacaatgtcaagtccaagattcaggacaaggagggcatcccccccgaccagcaacgtttgattttcgccggcaagcagcttgaggacggccgcactctctctgattacaacattcagaaggagtccactcttcatcttgttctccgcctccgtggtggtatgcaaattttcgtcaagaccctcactggcaagaccatcactcttgaggtcgagtcgtccgataccatcgacaatgttaagtcgaagatccaggacaaggagggtatccctcctgaccagcagcgcctgatttttgctggaaagcaactggaagacggtcgaacccttgccgactacaacatccagaaggaatctacccttcatctcgtcctccgcctccgtggtggtatgcaaatcttcgtcaagacccttactggaaagaccattactctggaagtcgagtcatccgataccattgataatgtgaagagcaagatccaggacaaggagggtattcccccggatcaacagcgactcatctttgctggcaagcaacttga

SEQ ID NO: 36749 - protein, 202 aa, Panicum virgatum
  misc_feature: Ceres CLONE 1986744
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(202): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLADYNIQKESTLHLVLRLRGGMQIFVKTLTGKTITLEVESSDTIDNVKSKIQDKEGIPPDQQRLIFAGKQL

SEQ ID NO: 36750 - DNA, 741 bp, Panicum virgatum
  misc_feature: Ceres CLONE 1986763
  misc_feature: Encodes the peptide sequence at SEQ ID NO. 36751
aaaagggcacccccactcgcgcctcactttggcctcccaccgcccacatgcgcgcacagtccactcctcctccctagctgctttgcttttccggcgagcagagctgagctccgtcacaccagtaccagtagtctcagaccagctccgaacccaactagccgccaccagtaggtgtaggcaggtcgcaatgagcaaggagaagcacccccgcgactggatcctccggcgctgctgcggcgccgtctgcgcctgcgtcctcacgctcgccgccgtcgtgggcttcatcgtgctcgtcatctacctggcgctccgcccctccaagccctccttctacctccaggacgtgcagctccgctccatcgacctcagcgaccccgcgctctccctcaacctccaggcgacgatcgcgtcgcgcaacccgaacgagcgcgtgggcgtctactacaagaccctggacgcgttcgcgacgtaccgggacgagccggtgacggtgccggtggcgctgccggccatctaccagggccacaaggacgcgtcggtgtggtcgccggtgctgtcgggggagtcggtgcccgtggcggcgtacgcggcggacgccatgcggcaggacatcgcggccgggtacgtgctgctccacgtccgggtggacggccgcgtcaagtggaaggtcggaagctgggtctcgggcgggtaccacctcttcgtccactgccccgcgctgctcgccgcctggggcggcgc

SEQ ID NO: 36751 - protein, 184 aa, Panicum virgatum
  misc_feature: Ceres CLONE 1986763
  misc_feature (38)..(175): Pfam Name: Hin1 Pfam Description: Harpin-induced protein 1 (Hin1)
MSKEKHPRDWILRRCCGAVCACVLTLAAVVGFIVLVIYLALRPSKPSFYLQDVQLRSIDLSDPALSLNLQATIASRNPNERVGVYYKTLDAFATYRDEPVTVPVALPAIYQGHKDASVWSPVLSGESVPVAAYAADAMRQDIAAGYVLLHVRVDGRVKWKVGSWVSGGYHLFVHCPALLAAWGG

SEQ ID NO: 36752 - DNA, 731 bp, Panicum virgatum
  misc_feature: Ceres CLONE 1986766
  misc_feature: Encodes the peptide sequence at SEQ ID NO. 36753
gtcaagcttcgaatcctcccctcctcctccccacctcctccctctccaacgccaaaacccccccgcggccggcgaattccccacgcgcgcggcctcccggcccgatcggatcctcgccagggattccgatggagaggtacgagctgctcaaggacatcggctccggcaacttcggggtggcgcggctcatgcggaacagggagaccaaggagctcgtcgccatgaagtacatcccccgggggctcaagattgacgagaatgtggcgagggagatcataaaccaccgctcgctgcggcaccccaacatcatccgcttcaaggaggtcgtgctcacgcccacgcacctcgccatcgtcatggagtacgccgccggcggcgagctcttcgaccggatctgcagcgccggcaggttcagcgaggatgaggcgaggtatttcttccagcagctcatctgcggtgtcagctactgccacttcatgcaaatttgccaccgggacttgaagctggagaacacgctgctggatggcagcccggcgccgcgcctgaagatctgcgactttggctactccaagtcatcactgctgcactcgaagcctaagtcgacggtcggaactccagcttacattgctccagaggtgctctcacgtcgggaatatgacggcaagatggcagacgtttggtcttgtggagtgactctttacgtgatgctggttggtgcatacctttttgag

SEQ ID NO: 36753 - protein, 200 aa, Panicum virgatum
  misc_feature: Ceres CLONE 1986766
  misc_feature (4)..(199): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50598
  misc_feature: Useful for biocontainment applications
  misc_feature: Useful for making plants with modulated biomass
  misc_feature: Useful for making plants with modulated time to senescence
  misc_feature: Functional homolog of the protein sequence given in SEQ ID NO 50599
  misc_feature: Useful for making plants with modulated water use efficiency
MERYELLKDIGSGNFGVARLMRNRETKELVAMKYIPRGLKIDENVAREIINHRSLRHPNIIRFKEVVLTPTHLAIVMEYAAGGELFDRICSAGRFSEDEARYFFQQLICGVSYCHFMQICHRDLKLENTLLDGSPAPRLKICDFGYSKSSLLHSKPKSTVGTPAYIAPEVLSRREYDGKMADVWSCGVTLYVMLVGAYLF

SEQ ID NO: 36754 - DNA, 713 bp, Panicum virgatum
  misc_feature: Ceres CLONE 1986787
  misc_feature: Encodes the peptide sequence at SEQ ID NO. 36755
aaaaaaccctagccccgagcagccgcagcggccagcactgcacgtcccctgcctccctctcgccgccgccgccccacccttccgtcgacaccatgagggagtgcatctcgatccacatcggtcaggccggtatccaggtcggaaacgcgtgctgggagctctactgcctcgagcatggcattcaggctgatggccagatgcctggtgacaagaccattggaggaggtgatgatgctttcaacaccttcttcagtgagactggcgctgggaagcacgtcccccgtgctgtatttgttgaccttgagcccactgtgattgatgaagtgaggactggcacttaccgccagctcttccaccctgagcagctcatcagtggcaaggaggatgctgccaacaacttcgcccgtggtcactacaccattggcaaggagattgttgacctgtgccttgaccgcatcaggaagcttgccgacaactgtactggtctccagggcttccttgtcttcaacgctgttggtggaggaacaggctctggtcttggttccctcctccttgagcgcctgtctgttgactatggcaagaagtccaagctcgggttcactgtgtacccatctccccaggtctccacttcagtggtggagccatacaacagtgtcctgtccacccattccctcctggagcacactgatgttgctatcctgctcgacaatgag

SEQ ID NO: 36755 - protein, 206 aa, Panicum virgatum
  misc_feature: Ceres CLONE 1986787
  misc_feature (49)..(206): Pfam Name: Tubulin Pfam Description: Tubulin/FtsZ family, GTPase domain
  misc_feature: Functional homolog of the protein sequence given in SEQ ID NO 50141
  misc_feature: Useful for making plants with altered cell wall content and/or composition
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAILLDN

SEQ ID NO: 36756 - DNA, 651 bp, Panicum virgatum
  misc_feature: Ceres CLONE 1986810
  misc_feature: Encodes the peptide sequence at SEQ ID NO. 36757
ccgcagtttcgctccccgtctcctctcttatggtgccccgccgcgtgccgcgccaccactagcgcgctgccccttccccgtccgtccatggccgccgcgtcgttcgcccgcgccttgcttctcctcgtcgtcgtcctctttctggccggcgcggcgcgcggcaagacggtgaagagagacgtgaaagcattgaatgagataaaatcttcactgggctggagagttgtatactcatgggttggcgatgacccttgcgggcatggtgatctaccaccctggtctggtgtgacatgctcacagcaaggggattacagagttgtgactgaactggaagtctatgctgtatctatagttggtcctttcccaacagcagtaactaacctgttggatctgagaagattggatcttcacaataacaagttgacagggccaattcctccgcagattggacggttaaaacatctcagggtattgaacctgaggtggaataagcttcaagatgtgcttcctcctgaaattggtgaactcaagaaactgacacacttgtacttgagcttcaacaattttaaaggcgagattccagtggagcttgcaaacctgccagaacttcgttacctttatcttcatgagaaccgattcacgggggcggat

SEQ ID NO: 36757 - protein, 187 aa, Panicum virgatum
  misc_feature: Ceres CLONE 1986810
  misc_feature (28)..(70): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAASFARALLLLVVVLFLAGAARGKTVKRDVKALNEIKSSLGWRVVYSWVGDDPCGHGDLPPWSGVTCSQQGDYRVVTELEVYAVSIVGPFPTAVTNLLDLRRLDLHNNKLTGPIPPQIGRLKHLRVLNLRWNKLQDVLPPEIGELKKLTHLYLSFNNFKGEIPVELANLPELRYLYLHENRFTGA

SEQ ID NO: 36758 - DNA, 701 bp, Panicum virgatum
  misc_feature: Ceres CLONE 1986812
  misc_feature: Encodes the peptide sequence at SEQ ID NO. 36759
gaaacacacgttggcccctcccgcatccgccaaaaaaaaaaaacatcccgcccccagaaaccccaaaaatccccggcggcggcgatggacctctcctcggcgggttccggcggcaactcgctgccgtcggtcggccccgacgggcagaagcggcgcgtgtgctacttctacgacccggaggtgggcaactattactacgggcagggccacccgatgaagccgcaacgcatccggatgacgcactcgctgctcgcccgctacggcctcctcaaccagatgcaggtctaccgccccaaccccgcccgcgaccgcgacctctgccgcttccacgccgacgactacatcaacttcctccgctccgtcacgcccgagacgcagcaggaccagatccgcctcctcaagcgcttcaacgtcggcgaggactgccccgtctttgacggcctctacagcttctgccagacctacgccggcgcctccgtcgggggcgccgtcaagctcaaccacggccacgacatcgccatcaactggtcggggggcctgcatcacgccaaaaagtgcgaggcgtccggcttctgctacgtcaacgacatcgtgctcgccatactcgagctcctcaagcaccacgagagagttctgtatgttgatatcgatatccaccatggagacggagttgaggaggctttctatacaacagacagggt

SEQ ID NO: 36759 - protein, 205 aa, Panicum virgatum
  misc_feature: Ceres CLONE 1986812
  misc_feature (24)..(205): Pfam Name: Hist_deacetyl Pfam Description: Histone deacetylase domain
MDLSSAGSGGNSLPSVGPDGQKRRVCYFYDPEVGNYYYGQGHPMKPQRIRMTHSLLARYGLLNQMQVYRPNPARDRDLCRFHADDYINFLRSVTPETQQDQIRLLKRFNVGEDCPVFDGLYSFCQTYAGASVGGAVKLNHGHDIAINWSGGLHHAKKCEASGFCYVNDIVLAILELLKHHERVLYVDIDIHHGDGVEEAFYTTDR

SEQ ID NO: 36760 - DNA, 1223 bp, Panicum virgatum
  misc_feature: Ceres CLONE 1986813
  misc_feature: Encodes the peptide sequence at SEQ ID NO. 36761
atcactccattcccttactctcgttgttgttgttcttcttcttgccctctagcttgctttccccaatccccgttacgcctctgcaccctgagctcctcgccttccttgttcaacttggtggtagtgggcactccttaccacctccaatcaccaagaaccagcctgtccaggctggtcaacatgaggcagttaccaccggggctgccaccaccggggctgccaccaccgccagagcctccgtccaagacgacccggcagcaagaggtgctgccacagcggctatcagcggctccttccaagattatcctgcagccgcgtgaccggacctcgccggcgatgtggttcgcggccatcgtctgctttgccttcagcatcatcctgatcgtggctggcatggtcatcttgatcatcttcctggcagtcaagccaagggcaccgtccttcgacacggccaacgccagcctcaacagtgtctacgtcgactcaccagcctacttcaacggcgatatgacgctcgtggccaacttctccaaccccaaccagaagatcgacgttgtgttccggtccgccaccgtggagctcttcttccgggacaggcccatggccgtgcaggtgctgccatcgtttgcgcagcgtcggggccagtttcaggtcctgaacttgcacatggtgtcaagccgtgtgctgctgccaccggaggtggccatggagcttgtgaaccaggtgaggagcaacagggtcgtgtacaccatcagaggctccttcaaggtggaggccagattttggtttagccactactcatactggatgaacacagtctgtgaggtggagctcacagctcctccttgtggagttcttgttgccaggagatgcagaacaaagtgactgacttctgaaattccccatccagttctattgttgtatcaagccatagatctttttcttttgtatactgaaattgggcaggctaaagtaaaacatactcatggttgatgtgaatttgatgttggttcatctctgggttgagctcttgctggctcagttgccgctggagcctgaaggctacctgaagcacagtagaaaactgtaagaaagctgaacatagagttcaacaagtgtgtaactctttgcttcctttgaagcaatttagtgggttttatcaaagtattattgcaggtgtagaagatacaagaatcacaaaactctgctcgcacatgtgtttc

SEQ ID NO: 36761 - protein, 234 aa, Panicum virgatum
  misc_feature: Ceres CLONE 1986813
  misc_feature (78)..(214): Pfam Name: Hin1 Pfam Description: Harpin-induced protein 1 (Hin1)
MRQLPPGLPPPGLPPPPEPPSKTTRQQEVLPQRLSAAPSKIILQPRDRTSPAMWFAAIVCFAFSIILIVAGMVILIIFLAVKPRAPSFDTANASLNSVYVDSPAYFNGDMTLVANFSNPNQKIDVVFRSATVELFFRDRPMAVQVLPSFAQRRGQFQVLNLHMVSSRVLLPPEVAMELVNQVRSNRVVYTIRGSFKVEARFWFSHYSYWMNTVCEVELTAPPCGVLVARRCRTK

SEQ ID NO: 36762 - DNA, 760 bp, Panicum virgatum
  misc_feature: Ceres CLONE 1986823
  misc_feature: Encodes the peptide sequence at SEQ ID NO. 36763
acagcccacggtacagtaccggctctgcaaagatccacgcagtaaaatccccatgatcccaatgcagtgagatcccattccgccgttccctccaaacatgttcgaacgcacagccttcaattttcgcagtactgcgcacgtgcgaagctgctgcgacaagctgccggcgtcgtgtcggcgccggaggaggagctgctgcagcagcgggcagcaggagctccggcggccaggcggggaagaagcagcggcagcggcagcggccgcaggtggaggggatgttcgtgttcgggagctcggtggtggacaacggcaacaacaacttcctcaacggctccggcgtgcgcgccgactacctcccctacggcgtggacttcccgctgggcccctccgggcgcttctccaacggccgcaacgtcatcgacgcgctcggcgagctcctccgcctccaggggctcgtcccgcccttcgccgacccgcgcacccgcggccgcgccgccctgcacggcgtcaacttcgcctccggcggctccggcatcctcgaccacaccggccagctcaccggcgaggtggtgagcctgcggcagcagatcagcaacttcgaggcggtgaccctccccgacctgcgggcccagctgcgaggagcggcggcgaccgccggcgaccacaggatcaggcgccaggattccttccagcgctgctacctgtccaagtgcctcttcgtcattgggacaggtggcaacgactacctgctcaactactt

SEQ ID NO: 36763 - protein, 161 aa, Panicum virgatum
  misc_feature: Ceres CLONE 1986823
  misc_feature: SWISSPROT Homolog: EC 3.2.1.51 Alpha-L-fucosidase
MFVFGSSVVDNGNNNFLNGSGVRADYLPYGVDFPLGPSGRFSNGRNVIDALGELLRLQGLVPPFADPRTRGRAALHGVNFASGGSGILDHTGQLTGEVVSLRQQISNFEAVTLPDLRAQLRGAAATAGDHRIRRQDSFQRCYLSKCLFVIGTGGNDYLLNY

SEQ ID NO: 36764 - DNA, 1892 bp, Panicum virgatum
  misc_feature: Ceres CLONE 1986838
  misc_feature: Encodes the peptide sequence at SEQ ID NO. 36765
aaggcacactcctctcctctcctctcctgctgcagtcccactagccatggatccaaccaaggtacaagccatgcatccaggcctgtttctttttcgtattaactaataattattaatctctaggactctagctagtagtagtatttagtagaaatggaataataattgtatactagctaatcgatggttgcattgcatacggcggcatgcagttccggccgtcgagcgcgcacgacggcggcgtgacgacgacgaacgccggcgcgccggtgtggaacgacaacgaggccctgacggtgggcccgcgcgggccgatcctgctggaggactaccacctgatcgagaaggtggcccacttcgcccgcgagcgcatcccggagcgcgtggtccacgcgcgcggcgcctccgccaagggcttcttcgagtgcacccacgacgtgtcggacctcacctgcgccgacttcctccgcgcccccggcgcccgcacgccggtgatcgtccgcttctccacggtgatccacgagcgcggcagcccggagacgatccgcgacccgcgcgggttcgccgtcaagttctacacccgggagggcaactgggacctgctgggcaacaacttccccgtcttcttcatccgcgacggcatcaagttccccgacgtgatccacgccttcaagcccaacccgcggtcgcacgtgcaggagtactggcgcgtcttcgacttcctctcgcaccacccggagagcctccacaccttcttcttcctcttcgacgacgtcggcgtgcccgccgactaccgccacatggagggcttcggcgtcaacacctacaccttcgtcagcgccgccggcaaggccagctacgtcaagttccactggaagcccgcctgcggggtgcgctgcatcctcaccgacgaggaggcggcgctcgtcggcgggcgcaaccacagccacgccacgcaggacctgtacgacgccatcgccgccggcagcttccccgagtggcagctgctggtgcaggtgatggacccggacacggaggaccggtacgacttcgacccgctggacgacaccaagacgtggcccgaggacctgctgccgctgcggccggtggggcggctggtgctggaccggaacgtggacaacttcttcaacgagaacgagcagctggccttcggccccgggctggtggtgcccgggatctactactcggacgacaagatgctgcagtgccgggtgttcgcgtacgccgacacgcagcgctaccggctggggcccaactacctgatgctgcccgtgaacgcgccgcgctgcgcgcaccacaacaaccactacgacggcgccatgaacttcatgcaccgggacgaggaggtggactactacccgtcgaggcacgcgccgctgcggcaggcgccgccggtgccggtgccggcgaggccgctggcggggaggagggagaaggccaccatcaggaagcccaacgacttccagcagcccggggagaggtaccgctcctgggacgccgacaggcaggagaggttcgtcaggaggttcgccgactcgctgggacaccccaaggtcagccaggagctcagatccatctggatcgacctgctctcgaagtgcgacgcgtcgctggggaagaagatcgccacccgcctcaacgtcaagccaagcatgtgatcgatccatctgcagacaaaggcaatagcttatatatcgagcgagcaataagacagacagacagacgatacgagccagcagctagcagtgtcgtctttgctgctggttaccacgtcgtcgtcgttactgtgtcagtcctatataggactatgtctcgtacccatgtcctactctactactacacacttgaattatatttatcgacgatggatg

SEQ ID NO: 36765 - protein, 490 aa, Panicum virgatum
  misc_feature: Ceres CLONE 1986838
  misc_feature (15)..(399): Pfam Name: Catalase Pfam Description: Catalase
  misc_feature: SWISSPROT Homolog: EC 1.11.1.6 Catalase
MQFRPSSAHDGGVTTTNAGAPVWNDNEALTVGPRGPILLEDYHLIEKVAHFARERIPERVVHARGASAKGFFECTHDVSDLTCADFLRAPGARTPVIVRFSTVIHERGSPETIRDPRGFAVKFYTREGNWDLLGNNFPVFFIRDGIKFPDVIHAFKPNPRSHVQEYWRVFDFLSHHPESLHTFFFLFDDVGVPADYRHMEGFGVNTYTFVSAAGKASYVKFHWKPACGVRCILTDEEAALVGGRNHSHATQDLYDAIAAGSFPEWQLLVQVMDPDTEDRYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAPPVPVPARPLAGRREKATIRKPNDFQQPGERYRSWDADRQERFVRRFADSLGHPKVSQELRSIWIDLLSKCDASLGKKIATRLNVKPSM

SEQ ID NO: 36766 - DNA, 713 bp, Panicum virgatum
  misc_feature: Ceres CLONE 1986851
  misc_feature: Encodes the peptide sequence at SEQ ID NO. 36767
aaaaggggaagagtacccttaagcctactggctaccagtgccttcctccaaatcctgatatctgtaggcaaaagttgctgccgttctcccacaagttccactctatcagacaccactatatgagcccatataagcagttcgtccacaataatcccacccttgatccattaatcgctgagaggtgttcttagagccggaagattacctgcagagttctgtgctgctccttaaggtgtgagctgtgcagattgcagagctcagcttcagcttctgcattgctttcaatggggaggcactcctgctgttacaagcagaagctgaggaaggggctctggtctcctgaggaagatgagaagctcatgaaccacataaccaaacatgggcacggctgctggagcactgtcccaaagcttgcagggcttcagagatgtggcaagagctgcaggctgagatggataaattacctgaggcctgacctcaaaaggggtgcattctctcaggaagaggaagaccttatcattgaactccatgctgttttgggaaacaggtggtctcagattgcaacacggttgcctggaagaactgataacgagatcaagaatctgtggaactcaagcatcaagaagaagctccgacagaaaggcattgaccccaacacccacaagccccttgccgaggttgatagcaaagcagctccaacaatcagtactgag

SEQ ID NO: 36767 - protein, 142 aa, Panicum virgatum
  misc_feature: Ceres CLONE 1986851
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: Functional homolog of the protein sequence given in SEQ ID NO 50235
  misc_feature: Useful for biocontainment applications
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 824 in the 10/412,699 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: Functional homolog of the protein sequence given in SEQ ID NO 50236
  misc_feature: Useful for making plants with modulated biomass
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1917 in the 10/374,780 US patent application
  misc_feature: The sequence is a functional homolog of SEQ ID NO 442 in the 10/412,699 US patent application
  misc_feature: Functional homolog of the protein sequence given in SEQ ID NO 50478
  misc_feature: Useful for making plants with altered lignin content
  misc_feature: Functional homolog of the protein sequence given in SEQ ID NO 50232
  misc_feature: Useful for making plants with altered alkaloid content
  misc_feature: Useful for making plants with modulated nitrogen use efficiency
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1004 in the 11/435,388 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 1002 in the 11/435,388 US patent application
  misc_feature: The sequence is a functional homolog of SEQ ID NO 1010 in the 11/435,388 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: Functional homolog of the protein sequence given in SEQ ID NO 50234
  misc_feature: Useful for making plants with altered cell wall content and/or composition
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 296 in the 11/479,226 US patent application
  misc_feature: The sequence is a functional homolog of SEQ ID NO 1073 in the 10/374,780 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 836 in the 10/412,699 US patent application
  misc_feature: The sequence is a functional homolog of SEQ ID NO 58 in the 10/666,642 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 271 in the 11/479,226 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 569 in the 10/374,780 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: Functional homolog of the protein sequence given in SEQ ID NO 50479
  misc_feature: Useful for making plants with altered terpenoid content
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 822 in the 10/412,699 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1681 in the 10/374,780 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: Functional homolog of the protein sequence given in SEQ ID NO 50480
  misc_feature: Useful for making plants with modulated low light sensitivity
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 794 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 446 in the 10/412,699 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 796 in the 11/435,388 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 790 in the 11/435,388 US patent application
  misc_feature: The sequence is a functional homolog of SEQ ID NO 743 in the 10/666,642 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 36 in US patent 7193132
  misc_feature: Functional homolog of the protein sequence given in SEQ ID NO 50239
  misc_feature: Useful for making plants with modulated flowering time
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1572 in the 10/374,780 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 2178 in the 10/374,780 US patent application
  misc_feature: The sequence is a functional homolog of SEQ ID NO 186 in the 10/412,699 US patent application
  misc_feature: The sequence is a functional homolog of SEQ ID NO 126 in the 10/412,699 US patent application
  misc_feature: The sequence is a functional homolog of SEQ ID NO 1566 in the 10/374,780 US patent application
  misc_feature: Functional homolog of the protein sequence given in SEQ ID NO 50240
  misc_feature: Useful for making plants with modulated drought sensitivity
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 1563 in the 10/374,780 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 1692 in the 11/479,226 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: Functional homolog of the protein sequence given in SEQ ID NO 50241
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 1565 in the 10/374,780 US patent application
  misc_feature: The sequence is a functional homolog of SEQ ID NO 1564 in the 10/374,780 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 2898 in the 10/374,780 US patent application
  misc_feature: The sequence is a functional homolog of SEQ ID NO 494 in the 10/225,066 US patent application
  misc_feature: The sequence is a functional homolog of SEQ ID NO 1054 in the 10/225,066 US patent application
  misc_feature: The sequence is a functional homolog of SEQ ID NO 144 in the 10/412,699 US patent application
  misc_feature: The sequence is a functional homolog of SEQ ID NO 2264 in the 10/374,780 US patent application
  misc_feature: The sequence is a functional homolog of SEQ ID NO 912 in the 11/435,388 US patent application
  misc_feature: The sequence is a functional homolog of SEQ ID NO 150 in the 10/412,699 US patent application
  misc_feature: The sequence is a functional homolog of SEQ ID NO 830 in the 11/435,388 US patent application
  misc_feature: The sequence is a functional homolog of SEQ ID NO 132 in the 10/412,699 US patent application
  misc_feature: The sequence is a functional homolog of SEQ ID NO 1968 in the 10/374,780 US patent application
  misc_feature: The sequence is a functional homolog of SEQ ID NO 309 in the 11/479,226 US patent application
  misc_feature: The sequence is a functional homolog of SEQ ID NO 582 in the 11/435,388 US patent application
  misc_feature: The sequence is a functional homolog of SEQ ID NO 454 in the 10/374,780 US patent application
  misc_feature: The sequence is a functional homolog of SEQ ID NO 568 in the 11/435,388 US patent application
  misc_feature: The sequence is a functional homolog of SEQ ID NO 90 in the 10/225,068 US patent application
MGRHSCCYKQKLRKGLWSPEEDEKLMNHITKHGHGCWSTVPKLAGLQRCGKSCRLRWINYLRPDLKRGAFSQEEEDLIIELHAVLGNRWSQIATRLPGRTDNEIKNLWNSSIKKKLRQKGIDPNTHKPLAEVDSKAAPTIST

SEQ ID NO: 36768 - DNA, 663 bp, Panicum virgatum
  misc_feature: Ceres CLONE 1986859
  misc_feature: Encodes the peptide sequence at SEQ ID NO. 36769
catctgctcctccactccactccactccactcatctcttctccgaggcgagcgcaaacccgcctcgcttctcgtcaaaccctagcgccccgctagcccgcgtcgctgccccgccccggatcaagcccgcacagcgcccgagcgtgcgtctccctcccggattcgagcggcgggcggcgggatggggtccgactccaaggagctgctcgggatcgagcccctcgagctccggttcccattcgagacaaagaagcagatctcatgctctatgcagctaacgaacagaacggatgactatatcggcttcaaggttaagacgacgagcccgaagaagtactgcgtccgaccaaacagcggcattgtgccaccacggtccaccagcgatgtcattgtgtcaatgcaagcgcaaaaggaggcaccacccgatatgcaatgcaaggacaagtttctcgtgcaaagtgttattgtggctgaaggcacgtcagcaaaggacataactggagatatgtttaccaaaaaatcaggtaatgtggtggatgaggtgaagttgagggttgtctacgtcccaccacccaagccgccatccccggtgcgtgagggatctgaagaaggctcgtcacctagacattcattgtctgatggaagcaacttgaattatcaagag

SEQ ID NO: 36769 - protein, 160 aa, Panicum virgatum
  misc_feature: Ceres CLONE 1986859
  misc_feature (8)..(115): Pfam Name: Motile_Sperm Pfam Description: MSP (Major sperm protein) domain
MGSDSKELLGIEPLELRFPFETKKQISCSMQLTNRTDDYIGFKVKTTSPKKYCVRPNSGIVPPRSTSDVIVSMQAQKEAPPDMQCKDKFLVQSVIVAEGTSAKDITGDMFTKKSGNVVDEVKLRVVYVPPPKPPSPVREGSEEGSSPRHSLSDGSNLNYQ

SEQ ID NO: 36770 - DNA, 616 bp, Panicum virgatum
  misc_feature: Ceres CLONE 1986879
  misc_feature: Encodes the peptide sequence at SEQ ID NO. 36771
gcctctccccgacggccgcactgctccgcttccgccctccgcccgtcgcccgctgcccaccctcccctacccggctcaccccagccggccgccgccctgccgccccttcgcacagcgcccctacgccttgcgcggccggcggctccacccgcctcccggcgcgccgcgcggctgcggcctgcggcttgcgggcgcgtctgttcgctgggtccagcctgcgccttgctacggccgcccgtcaacttccgccgtcgtcgcccactgcagccctctgcccgtcggcactgttattggatgtacatgtatactgggtccgcccctgattacagagatgaacgtggcagcgccaccacatcttcgcctatatgaattcgccaagaccgctctcatcaaaatttttgcctttccttatgccacggtctgtgacttgtattgcgatggtggagttgatacggacaagtggtgtgatgcccaggttggtcactatataggaatcgatgcctctgcatcgggtgtcagcgatgcccgtgagctatgggagaacaagaggaaacctttcactgccgagttcattgagttggatccttctgatgatgatttcgaagctcaagtgcag

SEQ ID NO: 36771 - protein, 94 aa, Panicum virgatum
  misc_feature: Ceres CLONE 1986879
  misc_feature: SWISSPROT Homolog: EC 2.1.1.56 mRNA (guanine-N(7)-)-methyltransferase
MNVAAPPHLRLYEFAKTALIKIFAFPYATVCDLYCDGGVDTDKWCDAQVGHYIGIDASASGVSDARELWENKRKPFTAEFIELDPSDDDFEAQV

SEQ ID NO: 36772 - DNA, 702 bp, Panicum virgatum
  misc_feature: Ceres CLONE 1986882
  misc_feature: Encodes the peptide sequence at SEQ ID NO. 36773
  misc_feature (611)..(611): n is a, c, t, g, unknown, or other
ccttccctgctgcttgctggcgttgggttgctgccggaccggaggagtgagctgaaaaggaggaggagagtgtgtgggagactgggagtgcgagaccgagccgcgtgatcttcccttgttaggttgctggtggccatggcggcagcggcggcgccgtacgcgcaggtgatggaggacatgcgcagggggcgggacctcgccacgcagctgcaggcgctgctccgggactcgcccgaggccggccgcctcgtcgaccggatcctccacgccatgtcccgcaccatcgagacggccagggcggcggccgcggcggaggagggctccgaggggcagagcgaggtcacctgcgctggcagcggcgccggcaagaggaaggccgccggaggaggggacaagagggccgcctgccggagaagagcccagaattcgtccactgtcacggtgaccatcaaggatattgaggacgggcacgcctggcgcaagtacgggcagaaggagatacaaaactccaagcacccaaaggcctacttccggtgcacgcacaagtacgaccagcagtgcgcggcgctgcggcaggtgcagcgctgcgacgacgacccggacgccttcanggtcacctacatcggcgtgcacacctgccgggaccccgccgccgtcgcgccggtcgtgctccaatcggccgacgagctccacgccggttcc

SEQ ID NO: 36773 - protein, 188 aa, Panicum virgatum
  misc_feature: Ceres CLONE 1986882
  misc_feature (108)..(170): Pfam Name: WRKY Pfam Description: WRKY DNA -binding domain
  misc_feature (159)..(159): Xaa is any aa, unknown, or other
MAAAAAPYAQVMEDMRRGRDLATQLQALLRDSPEAGRLVDRILHAMSRTIETARAAAAAEEGSEGQSEVTCAGSGAGKRKAAGGGDKRAACRRRAQNSSTVTVTIKDIEDGHAWRKYGQKEIQNSKHPKAYFRCTHKYDQQCAALRQVQRCDDDPDAFXVTYIGVHTCRDPAAVAPVVLQSADELHAG

SEQ ID NO: 36774 - DNA, 605 bp, Panicum virgatum
  misc_feature: Ceres CLONE 1986883
  misc_feature: Encodes the peptide sequence at SEQ ID NO. 36775
ctccccccgtcgtctcctccccggccctcttctcctcctcttcctcttctccaccaacgccaaaacccaggaaacccacactcactcaatggaggtctccaccaagcagctcctccccatgcctcatcagcaggaccccaactccccttcctcttccacctcctcgtcgtcgtcctcctccacctcaccgtctcacccccaccaccgtgcgcagccccacaacctcccaccgtcgccccggcccatcccgcgtaccatcgacaccaccccgttccccaccaccttcgtgcaggccgacaccacgtccttcaagcaggtcgtccagatgctcaccggcgccgagcagccaatcaagaacgacgcgacggcggcagcggccgcgggcaacagcggcggcggccaggcggctggcgggccgtgccggcccaagaagccgtctttcaagctgtacgagcggcggagcagcctgaagaacctcatgatgatcgcgccgctggcgatgggcccgccgccgtcgccacggagggcgacgccggagatcctctcgccgagcgtgctggacttcccgtccctgaagctcagcagcccggtgacgccgctgaccg

SEQ ID NO: 36775 - protein, 172 aa, Panicum virgatum
  misc_feature: Ceres CLONE 1986883
  misc_feature (60)..(90): Pfam Name: VQ Pfam Description: VQ motif
MEVSTKQLLPMPHQQDPNSPSSSTSSSSSSSTSPSHPHHRAQPHNLPPSPRPIPRTIDTTPFPTTFVQADTTSFKQVVQMLTGAEQPIKNDATAAAAAGNSGGGQAAGGPCRPKKPSFKLYERRSSLKNLMMIAPLAMGPPPSPRRATPEILSPSVLDFPSLKLSSPVTPLT

SEQ ID NO: 36776 - DNA, 709 bp, Panicum virgatum
  misc_feature: Ceres CLONE 1986893
  misc_feature: Encodes the peptide sequence at SEQ ID NO. 36777
accagcgcttgaggacacgctcctcgtgtcctctccctccgccgcccaacacatccccgtcggcccatccagatccgtgtccatccatcattccgccgcaacaagcgcttcctcctcctctcttcctgctgttgctttggcttcaactcgattgctagtcgcaatgatggatgacggggacctggatttctcaaacccagacacattcttgtgcccggcaattggcaacgatccgcccaccagctgctccatggacagctacttcgatgacatcttgaaggatacagagcaccacgcttgcacccacacccacacctgcaacccgccggtccacgaccattcgcacacccacacctgtgtccatgtccacaccaagattgttgcggcttcaccggatgccgctgagaccgcggaatcgccgtctgagaacaacaccaccaagaagcgcccgtctggtaaccgagcagcggtgaggaagtaccgggagaagaagaaggctcacacagcgtcgttggaggaagaggtggtccacttgagggctttgaaccagcagctcatgaagaagctccaaaatcacgccgcgcttgaggcggaggtagccaggcttcgctgcctgcttgttgatatcagagggaggattgagggggagattggtgcttttccttatcagaggccagccacgaacatcggtttggtgtctagtgttgac

SEQ ID NO: 36777 - protein, 180 aa, Panicum virgatum
  misc_feature: Ceres CLONE 1986893
  misc_feature (86)..(143): Pfam Name: bZIP_2 Pfam Description: Basic region leucine zipper
  misc_feature: The sequence is a functional homolog of SEQ ID NO 208 in the 10/225,068 US patent application
  misc_feature: The sequence is a functional homolog of SEQ ID NO 2360 in the 10/374,780 US patent application
  misc_feature: The sequence is a functional homolog of SEQ ID NO 372 in the 10/412,699 US patent application
  misc_feature: The sequence is a functional homolog of SEQ ID NO 863 in the 11/479,226 US patent application
  misc_feature: The sequence is a functional homolog of SEQ ID NO 1707 in the 11/479,226 US patent application
MDDGDLDFSNPDTFLCPAIGNDPPTSCSMDSYFDDILKDTEHHACTHTHTCNPPVHDHSHTHTCVHVHTKIVAASPDAAETAESPSENNTTKKRPSGNRAAVRKYREKKKAHTASLEEEVVHLRALNQQLMKKLQNHAALEAEVARLRCLLVDIRGRIEGEIGAFPYQRPATNIGLVSSV

SEQ ID NO: 36778 - DNA, 566 bp, Panicum virgatum
  misc_feature: Ceres CLONE 1986894
  misc_feature: Encodes the peptide sequence at SEQ ID NO. 36779
attaatacttctttgcccactaacccccccccccccaacacacacaaaccatcaatccttcacaagcgttctaataagcctcttcctctctctctctctctctctctctctctctctctctctctctctctctctctctctctctctctctctctccccttaaaaactccctgcctcatccagcccggaacacacacagaaccagagggcttttcacctacatgcatgatcatgcaggcaatgtggaagccggcatggttagaggccctcaacacacagaagttcttcgtagcatgctccttccatgagcatgcaaaaaagaatgaaaagaacatctgttgccttgactgctgcaccagcatctgcccgcactgtgtgggagcacaccgtgtacaccggctcctgcaggtgcggcggtacgtctaccacgacgttgttcggctggaggaccttgagaagcttattgattgctccagcgttcactcttatactattaacagctctaaggtcatcttcctgaagaagagaccgcataatatgcatttcaaggggtcagggaatatctg

SEQ ID NO: 36779 - protein, 113 aa, Panicum virgatum
  misc_feature: Ceres CLONE 1986894
  misc_feature (24)..(113): Pfam Name: PLATZ Pfam Description: PLATZ transcription factor
  misc_feature: The sequence is a functional homolog of SEQ ID NO 666 in the 10/666,642 US patent application
MIMQAMWKPAWLEALNTQKFFVACSFHEHAKKNEKNICCLDCCTSICPHCVGAHRVHRLLQVRRYVYHDVVRLEDLEKLIDCSSVHSYTINSSKVIFLKKRPHNMHFKGSGNI

SEQ ID NO: 36780 - DNA, 1275 bp, Panicum virgatum
  misc_feature: Ceres CLONE 1986898
  misc_feature: Encodes the peptide sequence at SEQ ID NO. 36781
gcagccagttccacgctcgcttcgcgccgccggctccgctcccttgcttacaagcaccggcaaggaaaggctcggtctttccccggccgtgctccaccacaccaatggaggctcctctcctccccgtttccaccgcggccgcctcttcgtcctccgtcgacatcgacgacgtcgccgccgacgccgtcccggcccctcgggtggcttcctcctccccttccacgcagagcgtcgtgttccgcgtcgtggccgtgatcgccatcgcgtgcgcgtccctgttcgcgcagcacgaggccgccaagggcttcggcatcgacgtcgtgagcgccggtgcccagcgcggcggtgacgccggccggcggttcgacctcttcttcgtgtccaacggccgcgccgagcgcatcctgcagtacgccagccgcggcgtggaacgcgcgctcttcccggacgcgtcgttcccgcgcaagcacgtccggcgcgtcaccgtcaagatggccgggcacaacctcaccgcgggcgccacggtggacgcctccgcggctcccggcgagtacgtcatctccctgagccccgcgctcgtatccggcactgccaccggcacggcagccgccgacgccgtggccgctgcggtgcgccgcgccgtggcgcgcatgtggctgtgggacggccgcggcgccccccccgcgcgcgtgaccgaggccatgagtggagtacctcgcctccgccgcggccggcgacgccgcggccgaggtggaggcgacgcctctgtcgtcgtcgtcgggcgacgggggacgccggtgcatgtcggcacggttcctgaggcacctcgagcggcagcgcgaggacttcgtcgcccggctgaaccgggcgatgagggaccggtggagcgacgctgccgtggacgcggcgctcggcgcgccggcccgccacgcctgcgcggcctaccgcgcggcgacatcgtcctcgaccggccaggacggaccccgccgccgccacgctgcagctgactccacgtcgtccagcgtggcagcgtgagggcggtctgaagcaagggcagttccggtattgtacacgcccatgtgcgccacgccccggtgcatattaaaaccgccattagcggctaagcgcggggtggggcatggccgcggccctaattgtggccggaggtgagtgagtggtcgctgtcacactgtagtttcatatgctggtgcttgtaatgatcctagtatggttttgtcgtaccagtgtgatgtgagcaatagatttttcgttgcc

SEQ ID NO: 36781 - protein, 300 aa, Panicum virgatum
  misc_feature: Ceres CLONE 1986898
  misc_feature (65)..(267): Pfam Name: BSP Pfam Description: Plant Basic Secretory Protein
MEAPLLPVSTAAASSSSVDIDDVAADAVPAPRVASSSPSTQSVVFRVVAVIAIACASLFAQHEAAKGFGIDVVSAGAQRGGDAGRRFDLFFVSNGRAERILQYASRGVERALFPDASFPRKHVRRVTVKMAGHNLTAGATVDASAAPGEYVISLSPALVSGTATGTAAADAVAAAVRRAVARMWLWDGRGAPPARVTEAMSGVPRLRRGRRRRGRGGGDASVVVVGRRGTPVHVGTVPEAPRAAARGLRRPAEPGDEGPVERRCRGRGARRAGPPRLRGLPRGDIVLDRPGRTPPPPRCS

SEQ ID NO: 36782 - DNA, 1392 bp, Panicum virgatum
  misc_feature: Ceres CLONE 1986918
  misc_feature: Encodes the peptide sequence at SEQ ID NO. 36783
cagttcgaaatctcaaatccatccatcccacaacccccccaccccgctccacgcctccactcccctccactccactccactccatccccatcccccgatcctcgagcggcggcggccggcgatggcggcgagcaacatcggcatgatggacggcgcctacttcgtcgggcgcaacgagatcctcgcgtggatcaacaccacgctgcagctcggcctctccaaggtggaggaggcggcgtcgggcgcggttgcatgccagctgatggatgcggcgcacccgggggcggtgccgatgtacaaggtcaacttcgacgccaagacggagtacgacatgatccagaactacaaggtcctgcaggacgtgttcaacaagctcaagatcaccaagcacatagaggtgaacaaactcgtcaaaggaagaccccttgacaatttggagtttatgcagtggatgaaaagatactgcgattctgtcaatggtggcttcatgaccagctacaatgcttctgagagaagggaaagcagcaaaggtggaaaagaaaccaacagaagaacatcagtgccctctcacacgccggccaagtctacatctacaggacacaaggctcaatcttcatcacatggcgctaagcggggaagtgggcaagctgcgaatgcgccacaacgcagtgctaaaccatcaccagccaactctggtggaccagcttataatgaacagatcactgagctgaagctcctggttgatagcctggagaaggagagagatttctacttctccaaattgcgggacattgagatcctgtgccagagccctgaagctgagcacgtgccggtccatgctatccagaacatactctatacatcagaggacgaccccgcaacagtggctgaagctcaggcgatggtttcacagcagcagcagccggcgctgagccccatcctggaggcgtccgatgagaggccgaaaccagaggcggcgaacaagcggaagagcatctccgacctggaggagtttgggatggcatccagctcacggcagaggctctccgacatctctgacgtgcagctgtctggatccccactgatgagtttcagttgaagcaactgtcgttgctacaaaatcggtctcgtcattgctgttatgacctagtttttgccctcgttatccgccacagaatttgtggccatttgctacaaattcatatattattttatgatctaaggttgtattactcgttgcttctatgactctgtccgattgaactattttgtgtggctgcatgctgcggtcagcctgtaggttgccggttgcatggatggccatgtttggttagcatcttgaaatttttttcgaaaaagacgaatgtatgtatagagtactaaacaaaattt

SEQ ID NO: 36783 - protein, 325 aa, Panicum virgatum
  misc_feature: Ceres CLONE 1986918
  misc_feature (209)..(255): Pfam Name: EB1 Pfam Description: EB1-like C-terminal motif
  misc_feature (15)..(116): Pfam Name: CH Pfam Description: Calponin homology (CH) domain
MAASNIGMMDGAYFVGRNEILAWINTTLQLGLSKVEEAASGAVACQLMDAAHPGAVPMYKVNFDAKTEYDMIQNYKVLQDVFNKLKITKHIEVNKLVKGRPLDNLEFMQWMKRYCDSVNGGFMTSYNASERRESSKGGKETNRRTSVPSHTPAKSTSTGHKAQSSSHGAKRGSGQAANAPQRSAKPSPANSGGPAYNEQITELKLLVDSLEKERDFYFSKLRDIEILCQSPEAEHVPVHAIQNILYTSEDDPATVAEAQAMVSQQQQPALSPILEASDERPKPEAANKRKSISDLEEFGMASSSRQRLSDISDVQLSGSPLMSFS

SEQ ID NO: 36784 - DNA, 665 bp, Panicum virgatum
  misc_feature: Ceres CLONE 1986927
  misc_feature: Encodes the peptide sequence at SEQ ID NO. 36785
aacctcacacccccctccttccaccccgagcttctcccttcgtttaaacccaaaccctaatcgcgacctccgttcccccaaaatcctacccgtgcggcggccatggacggcggcggtggcggaggcggcgccggcggagtcgggggaggcgtcatggtgggcggcggggtcggccccggcggcggcggcgtgggtgggggcgggggcgggggcgggggcggcgacgtggagctcgtcagcaagacgctgcagttcgagcacaagctgttctacttcgatctgaaggagaacccgcgggggaggtacctcaagatctccgagaagacctcggcaacgcgctccaccatcatcgtccccgtcgacggagtcgcctggttcctcgacctcttcgactactacatccgcaccgacgagcgcgacgccttcagcaaggagctgcggctccagaccaaggtgttctatttcgatattggggagaacaagagaggccgattcctcaaggtttcagaggcctctgtcaacagaaatcgtagtacaataattgttccggctggcagctctggtgaagagggttgggaagcattcaggaatgtgctattggaaataaataacgaggcttctcggctgtatgtcctaccaaatcatccaaatcagcaacacatggg

SEQ ID NO: 36785 - protein, 187 aa, Panicum virgatum
  misc_feature: Ceres CLONE 1986927
  misc_feature (23)..(172): Pfam Name: PurA Pfam Description: PurA ssDNA and RNA-binding protein
MDGGGGGGGAGGVGGGVMVGGGVGPGGGGVGGGGGGGGGGDVELVSKTLQFEHKLFYFDLKENPRGRYLKISEKTSATRSTIIVPVDGVAWFLDLFDYYIRTDERDAFSKELRLQTKVFYFDIGENKRGRFLKVSEASVNRNRSTIIVPAGSSGEEGWEAFRNVLLEINNEASRLYVLPNHPNQQHM

SEQ ID NO: 36786 - DNA, 725 bp, Panicum virgatum
  misc_feature: Ceres CLONE 1986954
  misc_feature: Encodes the peptide sequence at SEQ ID NO. 36787
gtttttcctcctccactccctcccccgcctccactactccccttcgaggcgctgcccaggtaagtcggcggcgagcggcggcgatgacgacccgcttcaagaagaaccgcaagaagcgcggtcacgtgtccgccgggcacggccgtatcgggaagcacaggaagcaccccggtggccgcggtaacgccggtggcatgcaccaccaccgcatcctctttgacaagtaccatccggggtacttcggcaaggtgggcatgcgctacttccacgagctccgcaacaggttcacttgcccggctgtcaacgtcgagcgcctctggtcgatggtgcccgccgagaaggcggcggaggccggcgccgacaaggccccgcagatcgacgtcacccagttcggctacttcaaggtgctcgggaaggggaagctgccgtccaagcccatcgtcgtcaaggccaagctcatctccaaggttgccgagaagaagatcaaggccgccggcggcgccgtcgtgctcactgcctaggtttcagtccttgtctgcctcggttttgagatctatatctgaactagtagtgctttcctgtctcatctatttgtgttaagaagacttgctagcttttaaattgctctggctcctgcctgggacagtgcttatgaggatttttgcacttagtgatgtcagttcatatcaaatatctcagatatatcaacgctatcttttactacc

SEQ ID NO: 36787 - protein, 145 aa, Panicum virgatum
  misc_feature: Ceres CLONE 1986954
  misc_feature (107)..(139): Pfam Name: L15 Pfam Description: Ribosomal protein L15
MTTRFKKNRKKRGHVSAGHGRIGKHRKHPGGRGNAGGMHHHRILFDKYHPGYFGKVGMRYFHELRNRFTCPAVNVERLWSMVPAEKAAEAGADKAPQIDVTQFGYFKVLGKGKLPSKPIVVKAKLISKVAEKKIKAAGGAVVLTA

SEQ ID NO: 36788 - DNA, 722 bp, Panicum virgatum
  misc_feature: Ceres CLONE 1986975
  misc_feature: Encodes the peptide sequence at SEQ ID NO. 36789
agccagccgcccaaaaagccaggcgcaaatcgcaacctcgccttctgtcccctccccgtccccggctcctcgttcccctctcgccgcccgcctcccggcggcgatcgaggcggcgccaataaccgagggcgggccgctcctctctccaccgagccccatccacggcgcctccgccccgagtctcccccgcacccaggttggcagccgccgcgccgcgatggatttggatctgtggatctccaaggtcaaggagggccagcacctcgccgagcacgagctccagtccctctgcgaatacgtgaaggagatcctcatcgaagagtccaacgtgcagccggtgaacagccccgtgacggtgtgtggtgacatccacgggcagttccatgacctgatgaagctgtttgcgactggtggccacgttccggagaccaactatattttcatgggtgattttgtggaccgtggcttcaacagtctggaggttttcaccattctcttgctactaaaagcaaggtatccagctcacataacccttctgcgtggaaaccatgaaagtaggcagctgacacaggtgtatggtttctacgatgagtgccagaggaagtatggtaatgccaatgcatggcggtactgcactgatgtttttgattaccttacactttcagcgatcattaatggccaagtcctctgtgttcatggcggtctttctcctgatgtacgca

SEQ ID NO: 36789 - protein, 168 aa, Panicum virgatum
  misc_feature: Ceres CLONE 1986975
  misc_feature (43)..(168): Pfam Name: Metallophos Pfam Description: Calcineurin-like phosphoesterase
  misc_feature: SWISSPROT Homolog: EC 3.1.3.16 Phosphoprotein phosphatase
  misc_feature: The sequence is a functional homolog of SEQ ID NO 13 in US patent 7271316
MDLDLWISKVKEGQHLAEHELQSLCEYVKEILIEESNVQPVNSPVTVCGDIHGQFHDLMKLFATGGHVPETNYIFMGDFVDRGFNSLEVFTILLLLKARYPAHITLLRGNHESRQLTQVYGFYDECQRKYGNANAWRYCTDVFDYLTLSAIINGQVLCVHGGLSPDVR

SEQ ID NO: 36790 - DNA, 1407 bp, Panicum virgatum
  misc_feature: Ceres CLONE 1986990
  misc_feature: Encodes the peptide sequence at SEQ ID NO. 36791
aaaaatatgttcttagcacgccgccaactgctccattcctcgcgggttatccatactaattccgctgaaacctccaccatctccacgaaatccccgaaaaaggtcggatcttttggctaaagccagcagtcttctccacaaaaaccacgagaaagattggccagcctcctcctgcgagtctgccctggcttctagtgctgcccgcttctagaacgcgtccagaattcgtggactcccccccgccccccgacccagctcacacgccaagtcccggtacaaagcccacggagtttcccccgattccaattcgagttcttcgctttcagttagtcgccgccgccgttgaattgaacccacctcgccgggttcaggttcgcccccaattttttctttctgctaggaggccgcggcgaccatgggcaactgctgcggcacgccggcgacgcaggaaggcagcaaccgccggaagaagccgaaggcgaacccgtacaacgtctcgtacaaccgcggggcggcgccgctgccggcgcgcccggggctggtggtgctgcgggacccgacggggcgggacctcggcgcgcactacgagctcggcggcgagctgggccggggcgagttcgggatcacgtacctgtgcacggagctggccacgggggatcggtacgcgtgcaagtccatctccaagcggaagctgcggacgcccgtggacgtggaggacgtgcgccgggaggtggacatcatgcgccacatgccggcgcacccaaacatcgtcagcctccgcggcgcctacgaggacgaggacgccgtgcaccttgtcatggagctctgcgagggaggggagctcttcgacaggatcgtcgcccgggggcactacaccgagcgcgccgccgccgccgtcacgcgcaccatcgtggaggtcgtccagatgtgccacaggcacggcgtcatgcaccgagaccttaaaccagagaacttcttatttgaaaacaagaaggagagtgcccctctgaaagcaattgattttgggctgtccgtgttcttcaggcctggtgaacgatttactgaaatcgtaggcagtccttactacatggctccagaggttttaaagcgaaactatggccctgaagttgatgtctggagtgctggagtgatactttacatacttctttgtggtgtaccaccattctgggcagaaactgaacagggagtagcacaagcaattatacgatctgtggtagatttcaaaagagagccatggcccagagtatctgagcctgctaaagatcttgtcaggaggatgctagacccgaatccgcgcactcggtttactgcagcacaagtacttgaacatccatggttacatgactctaaaaagatgccagacatttctctcggtgatgctgtccg

SEQ ID NO: 36791 - protein, 330 aa, Panicum virgatum
  misc_feature: Ceres CLONE 1986990
  misc_feature (57)..(315): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 2 in US patent 7084323
MGNCCGTPATQEGSNRRKKPKANPYNVSYNRGAAPLPARPGLVVLRDPTGRDLGAHYELGGELGRGEFGITYLCTELATGDRYACKSISKRKLRTPVDVEDVRREVDIMRHMPAHPNIVSLRGAYEDEDAVHLVMELCEGGELFDRIVARGHYTERAAAAVTRTIVEVVQMCHRHGVMHRDLKPENFLFENKKESAPLKAIDFGLSVFFRPGERFTEIVGSPYYMAPEVLKRNYGPEVDVWSAGVILYILLCGVPPFWAETEQGVAQAIIRSVVDFKREPWPRVSEPAKDLVRRMLDPNPRTRFTAAQVLEHPWLHDSKKMPDISLGDAV

SEQ ID NO: 36792 - DNA, 610 bp, Panicum virgatum
  misc_feature: Ceres CLONE 1986990-R
  misc_feature: Encodes the peptide sequence at SEQ ID NO. 36793
ggaccttcggataataatggatgctgctgatgttgataacaatgggaccctggactacgcggaatttgtgactgtgtctgttcatgtgaggaaaataggaaatgacgaacacattcaaaaggccttcacatacttcgaccgggataagagtgggtacattgaaattgaagagcttagagaggcactggccgacgaactggaggcaaatgatgaagacattatcaatggtatcatccgagatgtggacacagataaggacgggaaaataagctacgatgagtttgcggcaatgatgaaggccggcactgactggaggaaggcgtcccggcagtactcgcggcagcggttcagcaacctcagcctgaagctccagaaggacgggtccatcggcgccgagacacggtagggctctgagcagaggacagcgagaaattatacaccgcggctggtgtcttgaggctgtgtttgtgcgtagctagtacatactgggtgtttgttcgtccgttcgatggtttaatgtgatgtgacgggtttggtcgtcaagctatttctcactttttatgtttctctgttacacggtaaaagaaaaaaaatcttcacttgagctgcg

SEQ ID NO: 36793 - protein, 134 aa, Panicum virgatum
  misc_feature: Ceres CLONE 1986990-R
  misc_feature (73)..(101): Pfam Name: efhand Pfam Description: EF hand
  misc_feature (37)..(65): Pfam Name: efhand Pfam Description: EF hand
  misc_feature (1)..(29): Pfam Name: efhand Pfam Description: EF hand
  misc_feature: SWISSPROT Homolog: EC 2.7.11.1 Non-specific serine/threonine protein kinase
DLRIIMDAADVDNNGTLDYAEFVTVSVHVRKIGNDEHIQKAFTYFDRDKSGYIEIEELREALADELEANDEDIINGIIRDVDTDKDGKISYDEFAAMMKAGTDWRKASRQYSRQRFSNLSLKLQKDGSIGAETR

SEQ ID NO: 36794 - DNA, 667 bp, Panicum virgatum
  misc_feature: Ceres CLONE 1987030
  misc_feature: Encodes the peptide sequence at SEQ ID NO. 36795
agaccaccacggccccgggtagctagctgagtaccaaaaccaccagcaaacccatcgataatactttttgctctgctagcagccatggcttctactactacttgttgccttagcctgttagtgctggtagcgctggcgtcggcggcgtcggcgcagctgtcgtcgacgttctacgacacgtcgtgccccagggccctggccaccatcaagagcgcggtgaacgcggcggtggccaaggaggctcgcatgggggcgtccctgctcaggctgcacttccacgactgctttgtccaaggctgtgatgcgtccattctgctggcggggaacgagcagaacgatcctcctaatttaactctgagaggcttcgacgtcatcgccaacatcaaggcgcagttggaggccatctgcaagcagaccgtctcctgcgccgacatcctcgccgtcgccgcccgcgactccgtcgtagcgctgggagggccgtcatggagtgttccgctggggagacgggactcccccaaagctgcaagcacgagcacggtaaatcagtttctgatcccccctacagctagcctcgccgaactgattaaagggtacggcgacttgggcctcaacccaaccgacatggttgccctctcaggtgctcacacgatcgggcaggcgcattgcc

SEQ ID NO: 36795 - protein, 194 aa, Panicum virgatum
  misc_feature: Ceres CLONE 1987030
  misc_feature (41)..(194): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50228
  misc_feature: Useful for making plants with altered carbohydrate content
  misc_feature: Functional homolog of the protein sequence given in SEQ ID NO 50229
  misc_feature: Useful for making plants with altered cell wall content and/or composition
MASTTTCCLSLLVLVALASAASAQLSSTFYDTSCPRALATIKSAVNAAVAKEARMGASLLRLHFHDCFVQGCDASILLAGNEQNDPPNLTLRGFDVIANIKAQLEAICKQTVSCADILAVAARDSVVALGGPSWSVPLGRRDSPKAASTSTVNQFLIPPTASLAELIKGYGDLGLNPTDMVALSGAHTIGQAHC

SEQ ID NO: 36796 - DNA, 630 bp, Panicum virgatum
  misc_feature: Ceres CLONE 1987031
  misc_feature: Encodes the peptide sequence at SEQ ID NO. 36797
aagtaacagccaactctctctctctctctcctccggagtcactccgggctacggacgggagcccgacatcgacgcatcccctgcttctatccaaagtccaatccagcctccggccgtgtcctcccttcccttgcggcgaaaccctagccccgccccgccccgcccgtatgtcgactgcttgatcggcccagcagtcggacccacctctgcccttggcccccatctgatgttcctctcccgcatcgtcctgcgcgacctggactccatcgactcgccggcctccatggcgtcctcgaagaaggtggtgacccgcgacgagtgggagcggaagctccgcgacgtcaagatccgcaaggaggacatgaaccgcctcgtcatgaacttcctcgtcaccgagggcttcgttgacgccgccgacaagttccgcatcgagtccggcacccagccggagattgacctggcgaccatcacggatcggatggaggttaagaaagcagtccaatcggggaatgttcaggaggccatcgagaaaatcaacgatcttaatcccacgattctggacacaaatccccaactatactttcatcttcagcagcagaaactattagagttgattcgcgcgggaaaaat

SEQ ID NO: 36797 - protein, 134 aa, Panicum virgatum
  misc_feature: Ceres CLONE 1987031
  misc_feature (44)..(70): Pfam Name: LisH Pfam Description: LisH
MFLSRIVLRDLDSIDSPASMASSKKVVTRDEWERKLRDVKIRKEDMNRLVMNFLVTEGFVDAADKFRIESGTQPEIDLATITDRMEVKKAVQSGNVQEAIEKINDLNPTILDTNPQLYFHLQQQKLLELIRAGK

SEQ ID NO: 36798 - DNA, 708 bp, Panicum virgatum
  misc_feature: Ceres CLONE 1987038
  misc_feature: Encodes the peptide sequence at SEQ ID NO. 36799
ctccattccctccgctgctgcgcatcaacaacgcccgatctgatggaagctgcagtggctactacctcctccctggtcctcttctccagtactcccaggagatcactcacaagcttcaagacttccccctcattgcttcgaccttcttgcagcagctgctccgtgcccagtgcgaagcagcagcatccggtttgcctcgatgtgccaaggttacccagcagcaagaagaagaacagcatcctgaggtgttcctccagtcttgctgatggcccatcaacccctggttcttcagtaagatgggttcttgaccctgcaggcgacggcgattggcgccacatcggctacaaagttgcacgccccggcgcgttcgagatagcctccgatgcgctgaccgttggtcgggtcgctgacaaggctgacatcgtcctccccgttgccacagtctctagcacgcacgctcggctggagaagaaagacgggaggctgctggtgacggacctgggtagcaccaacggcacctacatcaacgagcgctgcctcaaccctggcttcccaattcccattgaccccggcagcctgctcatcttcggtgacatccacttggcgatgtttcgtgtgaggaagatgatagttgaggtgcccagcgagatggatgcggcccagcaagaaactaaggctgaggtagtatcagctgtagttgaagatact

SEQ ID NO: 36799 - protein, 221 aa, Panicum virgatum
  misc_feature: Ceres CLONE 1987038
  misc_feature (116)..(183): Pfam Name: FHA Pfam Description: FHA domain
  misc_feature: SWISSPROT Homolog: EC 1.14.13.90 Zeaxanthin epoxidase
MEAAVATTSSLVLFSSTPRRSLTSFKTSPSLLRPSCSSCSVPSAKQQHPVCLDVPRLPSSKKKNSILRCSSSLADGPSTPGSSVRWVLDPAGDGDWRHIGYKVARPGAFEIASDALTVGRVADKADIVLPVATVSSTHARLEKKDGRLLVTDLGSTNGTYINERCLNPGFPIPIDPGSLLIFGDIHLAMFRVRKMIVEVPSEMDAAQQETKAEVVSAVVED

SEQ ID NO: 36800 - DNA, 1702 bp, Panicum virgatum
  misc_feature: Ceres CLONE 1987051
  misc_feature: Encodes the peptide sequence at SEQ ID NO. 36801
actagccgagttccgcagagaaaggcgtcttcgcactcgcctctctccgcgcttcaaagcttctcctcccatttcccaccgccgccgccgcccacccttccgacgacaccatgagggagtgcatctcgatccacatcggccaggccggtatccaggtcggaaacgcgtgctgggagctgtactgcctcgagcatggcattcagcctgatggtcaaatgcccagtgacaagacagttggaggaggtgatgatgcattcaacaccttcttcagtgagactggcgctgggaagcatgttccccgtgctgtgtttgttgatcttgagcccactgtcattgatgaggtgaggactggcacttaccgccagcttttccaccctgagcagctcatcagtggcaaggaggatgctgccaacaactttgcccgtggtcactacaccattggcaaggagattgttgacctatgccttgaccgcatcaggaagcttgccgacaactgcactggtctccagggcttcctcgtgttcaacgctgttggtggaggaacaggctctggccttggttccctcctccttgagcgcctgtctgttgactatggcaagaagtccaagctcgggttcactgtgtacccatctccccaggtctccacctcagttgttgagccatacaacagtgtcctgtccacacactccctcctcgagcacactgatgttgctatcctgcttgacaatgaggccatctacgacatctgccgccgctcccttgacattgagcgcccaacctacactaacctcaacaggcttgtgtctcaggttatctcatctcttactgcctccctgaggttcgatggtgctctgaatgttgatgtgaatgagttccagaccaacttggtgccctacccaaggatccacttcatgctttcatcctatgcgccagtgatctctgctgagaaggcctaccatgagcagctgtcagtcgctgagatcactaacagtgccttcgagccatcctccatgatggccaagtgtgaccctcgccatggcaagtacatggcctgctgcctcatgtaccgtggagatgttgtgcccaaggacgtgaatgctgctgtggccaccatcaagaccaagcgcaccatccagtttgtggactggtgcccgactgggttcaagtgcggcatcaactaccagcctcccagcgtggtgcctggcggtgatctggccaaggtgcagcgcgctgtgtgcatgatctccaactccaccagtgtggttgaggtgttctcccgcatcgaccacaagtttgacctcatgtacgccaagcgcgccttcgtgcactggtatgtgggtgagggcatggaggagggtgagttctcggaggcccgtgaggaccttgctgcgctggagaaggactatgaggaggttggtgctgagtttgacgatggtgaggagggtgacgagggcgatgagtactagacgacccttcctggtgcttctctgtcaggcctgcgtgctgctactagccagtgatctgcctgagtggctcgtactattgtgttatgttttgtctgtctgtttgaactttgagtcgttcatgtgtggtttacaacacctgatgttgtaagagtgtaagactcgaatgttggttttccttttcgctactgggtactatgaatgtttgttatgatcaataatagtgtctgtgctgcttc

SEQ ID NO: 36801 - protein, 451 aa, Panicum virgatum
  misc_feature: Ceres CLONE 1987051
  misc_feature (49)..(246): Pfam Name: Tubulin Pfam Description: Tubulin/FtsZ family, GTPase domain
  misc_feature (248)..(393): Pfam Name: Tubulin_C Pfam Description: Tubulin/FtsZ family, C-terminal domain
  misc_feature: Functional homolog of the protein sequence given in SEQ ID NO 50141
  misc_feature: Useful for making plants with altered cell wall content and/or composition
MRECISIHIGQAGIQVGNACWELYCLEHGIQPDGQMPSDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAILLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDDGEEGDEGDEY

SEQ ID NO: 36802 - DNA, 618 bp, Panicum virgatum
  misc_feature: Ceres CLONE 1987077
  misc_feature: Encodes the peptide sequence at SEQ ID NO. 36803
ccacaggaatccgccgccataatcccctccgcattgctggcgccgggctccctcctccacttccccgccggaatccgcttccctcccccttcgtttgcttcggttcggtggtatgagcggctggtgaattggtgacacgatgaggaaggcgctgctgctgctgctgctcgtcctctgctgcctcgccgcttccagcgaggcggcggcggtgctgggggaggaggaggcgtcggcggagctggcggtggtggtggacccgtcgtggcggttcccgagccagcggctgcgtgacgcctacgtcgcgctgcagacgtggaagcagcaggccatcttctccgacccccgcaacttcaccgccgactgggtgggcccgggggtctgcaactacaccggcgtcttctgcgcgcccgtgccgcgcggggagcccggcgccggggagctcgccgtggcgggcatcgacctcaaccacggcgacatcgcggggtacctcccctcggagctcggcctcctcgccgacctcgcgctgctgcacctcaactccaaccgcttctgcggcctcgtccccgccacgttccgccggctccgcctcctcgtcgagctcgacctcagcaacaaccg

SEQ ID NO: 36803 - protein, 159 aa, Panicum virgatum
  misc_feature: Ceres CLONE 1987077
  misc_feature: SWISSPROT Homolog: EC 2.7.11.1 Non-specific serine/threonine protein kinase
MRKALLLLLLVLCCLAASSEAAAVLGEEEASAELAVVVDPSWRFPSQRLRDAYVALQTWKQQAIFSDPRNFTADWVGPGVCNYTGVFCAPVPRGEPGAGELAVAGIDLNHGDIAGYLPSELGLLADLALLHLNSNRFCGLVPATFRRLRLLVELDLSNN

SEQ ID NO: 36804 - DNA, 723 bp, Panicum virgatum
  misc_feature: Ceres CLONE 1987084
  misc_feature: Encodes the peptide sequence at SEQ ID NO. 36805
actcctctcctgatttctcacgcgagctccaagtcgcgttctattccatcatggcgccccctcagatctcccgcaaaaccctcggcttcctgcttctcctggtcgccgctgccgtctcgccggccgccgccgacgatgtggtggccctgacggaggccgactttgagaaggaggtcggccaggaccgcggcgccctcgtcgagttctacgcgccatggtgcggccactgcaagaagcttgcccctgagtatgaaaaacttggtgcaagtttcaagaaggctaaatctgtattgatcgcaaaggttgactgtgacgagcacaagagtatatgcagcaagtatggagtttctggataccccacaattcaatggttccccaaaggttctttggagccgaagaagtatgagggtcaacgttctgtggaagccctcgcagaatttgttaacagcgaagcaggcaccaatgtaaagatagctgcagttccttcaagtgtcgtgattctgactccagagacctttgactcaattgtgcttgatgaaaccaaagatgtccttgttgagttctacgccccatggtgtggtcactgcaagcatcttgctccggtttatgagaagctggcttcagttttcaagcaggatgagggtgttgtgattgccaatcttgatgctgacaaacacactgacttggctgaaaagtatggtgtttctggttttccccacttga

SEQ ID NO: 36805 - protein, 224 aa, Panicum virgatum
  misc_feature: Ceres CLONE 1987084
  misc_feature (29)..(134): Pfam Name: Thioredoxin Pfam Description: Thioredoxin
  misc_feature (147)..(223): Pfam Name: Thioredoxin Pfam Description: Thioredoxin
  misc_feature: SWISSPROT Homolog: EC 5.3.4.1 Protein disulfide-isomerase
MAPPQISRKTLGFLLLLVAAAVSPAAADDVVALTEADFEKEVGQDRGALVEFYAPWCGHCKKLAPEYEKLGASFKKAKSVLIAKVDCDEHKSICSKYGVSGYPTIQWFPKGSLEPKKYEGQRSVEALAEFVNSEAGTNVKIAAVPSSVVILTPETFDSIVLDETKDVLVEFYAPWCGHCKHLAPVYEKLASVFKQDEGVVIANLDADKHTDLAEKYGVSGFPHL

SEQ ID NO: 36806 - DNA, 1201 bp, Panicum virgatum
  misc_feature: Ceres CLONE 1987100
  misc_feature: Encodes the peptide sequence at SEQ ID NO. 36807
aagtccccgtctggccatctcgcactctccccaatccccgagcccgagcccgagggcaccgccggccgccgccacccgcgtcctcctaccgccggccgccacccgcacggccgcgcctcccgctggctgccacctgccgcactgcgcccgcgggccgcgacccctgcgccctgctggtgcctgctgggcgcctgggcgatcgcgcacctcccgccggccgcggcaaacccggcgcgccggcgcctccagtgcggccgaacgccggccaccgccccgacccttcgagccggcgcccagttgcagcagctaggcagctagctgaccagctccattgccaatcccctcactgttttccagcccagccgccctcagcctgtccccataaccagcagttcccccagctcaccggtggcagcacacgacgagctcggcggcgtggcacgaggcaggtagggtgcgtggccggcggggtgtttgctgcactgaaaactaagccgaaccaaagccacgcttggccgcaacagcggtccagaacggcaccgtcctccgtgatcggcgagccgtatcgggggaaccctactggggcccatggccatggccgtggcggaggcacgggcgcggcaggagaaagtgaggaagttcgaggagttcgtggaccagcgtctgaagcccgaccttgccaacgccatcaagcagcgcgataaggtgtttgagcagcagaagaccttcttggatttgaagaggaacattgaaaatttggagatgaatggtgtcaccagcatgcggtccatggtcaatcttggctcggaggtgtacatgcaggcagaagtaccagatacaaggcacattttcgtggatattggtctaggttttcatgtggaatttacttggcaagaagctttacagtttatatctgtaagagaggcaaggttggctaggcaaatagatgaatacacgcatctcattgcaagcataaaagcacagatcaagctggtatgtgaaggtatccgtgagctgctgcagctaccaccggagacagagttatcacctaggaatacatggtagaataatagaatttggtagaataatcgaacttgtaaaatgtggtgcagttctgcaagatggttccatttttatatggcagcaacttggcttaaaatctgatgaccttctgcagttgaaattaaccaacccttgtagt

SEQ ID NO: 36807 - protein, 156 aa, Panicum virgatum
  misc_feature: Ceres CLONE 1987100
  misc_feature (24)..(144): Pfam Name: Prefoldin Pfam Description: Prefoldin subunit
MAVAEARARQEKVRKFEEFVDQRLKPDLANAIKQRDKVFEQQKTFLDLKRNIENLEMNGVTSMRSMVNLGSEVYMQAEVPDTRHIFVDIGLGFHVEFTWQEALQFISVREARLARQIDEYTHLIASIKAQIKLVCEGIRELLQLPPETELSPRNTW

SEQ ID NO: 36808 - DNA, 632 bp, Panicum virgatum
  misc_feature: Ceres CLONE 1987112
  misc_feature: Encodes the peptide sequence at SEQ ID NO. 36809
accattccaaaccaaacacgagagctagcgtccggctagtgagcactgagcagcagccagcaagcgggcaaggcaagagagaaagcaagcaggcaaacatgtgtggtggtgcgatcctcgcggagctcataccgagcgcgccggcggccaagcagcagcggagggccgacgacttcgaggccgcgttccgggagttcgactccgactccgacgaggaggtggagagcaagccgctcggcttcaacgcttcccccgccggcgcggcgaccaggaagctgaggaggcagcagcagcagcagcgggagctggccgcgccggcgccgagcaggcgccgcaaggccgcgcagtacaagggcgtccggcgccgcccgtggggcaagtgggccgccgagatccgcgaccccgtcaagggcgtccgcgtctggctcggcaccttctcctccgccgaggccgccgcgctcgcctacgacgccgccgcgcgcgacatccgcgggcccagggccaagctcaacttcccctcgaacgccgacgccgctcccgccgccgggcgcaagcgcgcccgcgccgccgagttcgtcgacctcgtcgccgacgaggacgagcagcagcgccacgcagcgtccggcgtccag

SEQ ID NO: 36809 - protein, 177 aa, Panicum virgatum
  misc_feature: Ceres CLONE 1987112
  misc_feature (82)..(133): Pfam Name: AP2 Pfam Description: AP2 domain
  misc_feature: Functional homolog of the protein sequence given in SEQ ID NO 50520
  misc_feature: Useful for making plants with altered alkaloid content
  misc_feature: The sequence is a functional homolog of SEQ ID NO 1769 in the 10/374,780 US patent application
  misc_feature: Functional homolog of the protein sequence given in SEQ ID NO 50249
  misc_feature: Useful for making plants with altered lignin content
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: Functional homolog of the protein sequence given in SEQ ID NO 50227
  misc_feature: Useful for biocontainment applications
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 1289 in the 10/374,780 US patent application
  misc_feature: The sequence is a functional homolog of SEQ ID NO 1435 in the 10/412,699 US patent application
  misc_feature: Functional homolog of the protein sequence given in SEQ ID NO 51001
  misc_feature: Useful for making plants with modulated oxidative stress sensitivity
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: Functional homolog of the protein sequence given in SEQ ID NO 50344
  misc_feature: Useful for making plants with altered sterol content
  misc_feature: Useful for making plants with altered terpenoid content
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
MCGGAILAELIPSAPAAKQQRRADDFEAAFREFDSDSDEEVESKPLGFNASPAGAATRKLRRQQQQQRELAAPAPSRRRKAAQYKGVRRRPWGKWAAEIRDPVKGVRVWLGTFSSAEAAALAYDAAARDIRGPRAKLNFPSNADAAPAAGRKRARAAEFVDLVADEDEQQRHAASGV

SEQ ID NO: 36810 - DNA, 587 bp, Panicum virgatum
  misc_feature: Ceres CLONE 1987115
  misc_feature: Encodes the peptide sequence at SEQ ID NO. 36811
gatagcatcgcctatagccatggccgctgcttctttccttattagctgcttggtggtggtggtggtgctggcctccggggcgtcggcgcagctgtcatccaccttctacgacacgtcgtgccccaatgcgctgtccaccatcaggaccgccctgaaccccgcggtggcgcaagaacctcccatgggggcgtccctgctcaagctgcacttccacgactgctttgtccaaggctgccacccctccgttctgctgaatgacaccaaccgcggggaacaaaacccccttcccaaccctggatccctgaagggcttccgcgtcatccacaacatcaaagcgcaactggaagctttgtgcccccaaaacgtctcctgcgcccaactcctcaccgtccccccccgccaatccgtcctaaccctccgccggccctcatggaaccttccactgggaagaaaggaatctaccaattcaagccccaacatggcaaataaccacctcccaccttctcaatttaacctcccaccacctattcctgcctttccaaaccagaacctccaccccaccaaactggttgctctcccaagcgctc

SEQ ID NO: 36811 - protein, 189 aa, Panicum virgatum
  misc_feature: Ceres CLONE 1987115
  misc_feature (41)..(189): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50228
  misc_feature: Useful for making plants with altered carbohydrate content
MAAASFLISCLVVVVVLASGASAQLSSTFYDTSCPNALSTIRTALNPAVAQEPPMGASLLKLHFHDCFVQGCHPSVLLNDTNRGEQNPLPNPGSLKGFRVIHNIKAQLEALCPQNVSCAQLLTVPPRQSVLTLRRPSWNLPLGRKESTNSSPNMANNHLPPSQFNLPPPIPAFPNQNLHPTKLVALPSA

SEQ ID NO: 36812 - DNA, 705 bp, Panicum virgatum
  misc_feature: Ceres CLONE 1987118
  misc_feature: Encodes the peptide sequence at SEQ ID NO. 36813
aaatgatccgttcaggcaatcatctcaagctaggacaaagcttccctctggtattgaaatgagtgtccatgtgcttacaacaggctattggcccacatatccaccaatggatgtgaaactcccgcatgaactgaacgtgtatcaggatatatttaaagagttctatttgagcaagtacagtggaaggcgtttaatgtggcaaaattctttgggacactgtgtcttgaaagcagactttcccaaaggcaaaaaggaacttgcggtgtcattatttcagagtgtggttttgatgttgttcaatgacgcacaaaaactaagcttcctcgacatcaaagattccactggcatcgaggataaagaattgagaagaacactgcagtcacttgcatgtggtaaagttcgtgttctccaaaagataccgaaagggagagatgtagaggataaggatgaatttgtattcaatgaagaatttagtgctccactctatcgcataaaggtaaatgctattcaaatgaaggagacagtagaagaaaacacgagcaccactgagagagtgtttcaggatcggcagtatcaggtcgatgctgccattgttcgaataatgaagaccaggaaggtcctcagccacaccctactaatagctgaactttaccagcagctcaagtcccagttaagccagctgatatcaagaaagaattgagagct

SEQ ID NO: 36813 - protein, 232 aa, Panicum virgatum
  misc_feature: Ceres CLONE 1987118
  misc_feature (1)..(158): Pfam Name: Cullin Pfam Description: Cullin family
NDPFRQSSQARTKLPSGIEMSVHVLTTGYWPTYPPMDVKLPHELNVYQDIFKEFYLSKYSGRRLMWQNSLGHCVLKADFPKGKKELAVSLFQSVVLMLFNDAQKLSFLDIKDSTGIEDKELRRTLQSLACGKVRVLQKIPKGRDVEDKDEFVFNEEFSAPLYRIKVNAIQMKETVEENTSTTERVFQDRQYQVDAAIVRIMKTRKVLSHTLLIAELYQQLKSQLSQLISRKN

SEQ ID NO: 36814 - DNA, 661 bp, Panicum virgatum
  misc_feature: Ceres CLONE 1987119-R
  misc_feature: Encodes the peptide sequence at SEQ ID NO. 36815
attaagacacattctgctggtagtgagatgccttctgattgaaccatttcctgaatctgccctcaatgaacaagctggaaagatgctacttgaaaactatgaggagtatgcacggcatgcaaggctatacactggcatccatgcgctcaggcctaagaacaagttgaagagtggagctatttctgagtcaaccacagctctaaatgtgggccagtccaatactgttctcggtgagaacacacctttggcaaccactgctgcggcgaaagcattgggtaaaaactcgcaggatcagaatgctgctacgtctgatcctgttgtaggagcatccactgcaccgaaggatgcgccacatgctgccaaagctccagttgataagaagaagctggatgcaaggaagaaaagcttgaagagattgtagtcgaataatcctgggaggcgaggggtgcttagtggtagataaaataatgatctcttcactagtgctagattcaacatatgcctggtagaactgaaaagaaaagtgaagaggacaaacagcgcgagaggcatctcatggctggtagtctgtgctctctgttgggacttgggacaaactgtcggcaattacagttatcattcatttatttggaagaatacttgcctttttctgctgattccc

SEQ ID NO: 36815 - protein, 139 aa, Panicum virgatum
  misc_feature: Ceres CLONE 1987119-R
  misc_feature: SWISSPROT Homolog: EC 6.3.2.19 Ubiquitin--protein ligase
LRHILLVVRCLLIEPFPESALNEQAGKMLLENYEEYARHARLYTGIHALRPKNKLKSGAISESTTALNVGQSNTVLGENTPLATTAAAKALGKNSQDQNAATSDPVVGASTAPKDAPHAAKAPVDKKKLDARKKSLKRL

SEQ ID NO: 36816 - DNA, 384 bp, Panicum virgatum
  misc_feature: Ceres CLONE 1987119
ccgtttcggcaactcgacgctcaaatctcagttccggcctcgtccgctctcttcttccctcccctctccgcggtgtgcccttcgcttctccccgcgcctagggtttcctcctcctcctcccccagcgcaggcctgcactaccccaaccgccacggcggcggccccttccggccgctagagactccccaaccgccgtccgtccgaattgcgtcttcccttcgcctcccctgccgccccgcggccccgccccagaggggaaccctgcgctcccctatcggtcattgcctgggtagatacgagcggcggtggcgatctctggacgtaccgcgggaagcggaggcaggccaaggccagcgagggggagatcggggggggggggggggt

SEQ ID NO: 36817 - DNA, 1292 bp, Panicum virgatum
  misc_feature: Ceres CLONE 1987120
  misc_feature: Encodes the peptide sequence at SEQ ID NO. 36818
gacaaacacttggctcacacagaaaaccctccaccatctctcgcccccgccgcgcgatccatcgccgcgccgcccgagaagcgccgggagatccggagatggggggaggcctggaggtcgacctgtcgcacggggccgtggcagcgctgtggatgtcgctgccgtcgaggtgccgccccgtgctgcaggtggcggacgtgcgccacgtgccggacggcagcggcctctcccctgcgccggtgcagcggtaccgcctcgacctctccgacggcgtgcactcgcagcccggcacgctcgccgcctccctcaaccacctcgccagggacgggaccctccgccggggatccgtggttcaggtcctcgacttctactgcgactaccgccgcaggaccatcatcgtcattcagttacaaatcctgcaacctgagtgtgctctgattgggagtctcaagctctatgagccaacaaggaaatctggggggttcagcactagatcaatgagatatgctccaaggcttgattgtgaaccttattacggaggccaacacattgatcagagtggtattgcctcagaggctgaggaaaggactaattgcttatcacatcacgggtcttttggtggatccagtctacctggtagtggcacgctatgttctcttgctctattggcagaaccagcttctttggcgcaagatgaggcgcggttcacggaaatcatggaagcggccctttggcgcaaatacctattcaaactgagaatcaaggaggaaacctttaatggtgagcagcacgtgaaatccaacattgttggtgttgaaaagttggatgcgttggatgtgagccatcatctcttgaaagagattgacaaccgtttgaatggcctttcatgctctgctcccgaggacgcttcgtccgacaactcaaatgttggtggtgccagtttgggagccggacagggcatgcagacccccagtcatgcctatgatggctataccactggtatgggtggttcaggtcctgtctgtcagtaatcagggacggtgatggcctgtgttttgtatgcaatcagcctgagcactgggctatgaagtatgaagtatgagctgtcctgtccgagctacttggccgggttggtccagtctgtcagcagggaggggtagctgaagtctgtgtttcaaatgcaatcagcctgggcactgggccgaagattgctttgtccaagccacttagtgcctcgcctcatgcaggaagttgctgaaaagaaacccatcagatcaagtagttctgtgaaa

SEQ ID NO: 36818 - protein, 310 aa, Panicum virgatum
  misc_feature: Ceres CLONE 1987120
  misc_feature (8)..(109): Pfam Name: Rep-A_N Pfam Description: Replication factor-A protein 1, N-terminal domain
MGGGLEVDLSHGAVAALWMSLPSRCRPVLQVADVRHVPDGSGLSPAPVQRYRLDLSDGVHSQPGTLAASLNHLARDGTLRRGSVVQVLDFYCDYRRRTIIVIQLQILQPECALIGSLKLYEPTRKSGGFSTRSMRYAPRLDCEPYYGGQHIDQSGIASEAEERTNCLSHHGSFGGSSLPGSGTLCSLALLAEPASLAQDEARFTEIMEAALWRKYLFKLRIKEETFNGEQHVKSNIVGVEKLDALDVSHHLLKEIDNRLNGLSCSAPEDASSDNSNVGGASLGAGQGMQTPSHAYDGYTTGMGGSGPVCQ

SEQ ID NO: 36819 - DNA, 1632 bp, Panicum virgatum
  misc_feature: Ceres CLONE 1987136
  misc_feature: Encodes the peptide sequence at SEQ ID NO. 36820
gttcaaacgccccggctcgacgcactcgttcgaatccccaatccaccaacccaagagcctgccggattcaaacgtccgattcaaacgaccctctgctgcctgcgcctgcgtttcgaccaccatcgcctcccctcgcccgcccgctcgcctcgctgccggcggcggcggcgatggaaaccctaatggtgaaccgcgtccacagcagcctgcgcctcttcatgcaccgcaacgccgtcttcctctgcgagcgcctctgcgcgcagttcccctccgagaccaatgtgcagttgttagcaacatgttacctccacaacaaccagccatatgctgcataccatattttgaaagggaagaagctgccagagtcccggtacctgtttgctatgtcatgctttcgtatgaacctcttgcatgaagcagaagatactctatgtccagtaaatgaaccaaacattgaggttcccaatggagctacaggacactacctccttggaataatttataggtgcacgggcagaatgtcagctgcagctgaacaatttacacaagcgttgactctggatcctcttttatgggcagcatacgaggagttgtgtatacttggtgttgctgaagatgcagatgaatgttttagtgaagcaactgctctacgtctccagcaggaacacacatccacatctgctctggaaaagtcaaactttgccaatgaaaatcgaattctaacttccagtcttccctcaagcctcggggatattatccctaagcaaatgaaacagcttcatgctaacaacacagcagaagttcctagttaccctcatgttagagcaactgcactgcatgtacagaacagcacaacctctaacgtagcacagtttgacaccccatcaccaacggcaacacagacttctagtattgtacctccaccactcttcaggaatgcccatgcttatcagaatacaataagtggtgatgctcctgctaaaccgaaagctaatggatcaaaccagccactcagaaggaaatacttggatcaagcaaggctaaagaaggttaggttctcttatcatttgatcgaaatcatgccactacttgtaactcttttcttgtctatttccttattttggaacttctagggaccttaacatctaaatatttaccaattatgacaccattcccctttctgattctaatctgaaaattataaagtaatcagagccagatgatattttctagtttctcgtactaatgctgcttgcaaatgcttcattttaaacttcaagttcctcaagttactgtgaacttccagtgatgttcctttgtatcaggttagtaggttacaatgtcacatccctttttgtcacgtggtattccacagtatcaggatcaaagttatgttttgcagtttgttttttgtcacatgatagtttttgtttgttaataaaaaaggtcatgagtttagttgcaagcagatcaataattcagtatatctgtgttcaatgttcaaaaaggcgctaggcagtgacccaccgcccagagcctaagcgagcttaggcgagcctaggcgtttcaaggcgatttgctaggcggtgctatatatgtagatatttcttgccatacacatcaactatctct

SEQ ID NO: 36820 - protein, 320 aa, Panicum virgatum
  misc_feature: Ceres CLONE 1987136
  misc_feature (101)..(134): Pfam Name: TPR_2 Pfam Description: Tetratricopeptide repeat
METLMVNRVHSSLRLFMHRNAVFLCERLCAQFPSETNVQLLATCYLHNNQPYAAYHILKGKKLPESRYLFAMSCFRMNLLHEAEDTLCPVNEPNIEVPNGATGHYLLGIIYRCTGRMSAAAEQFTQALTLDPLLWAAYEELCILGVAEDADECFSEATALRLQQEHTSTSALEKSNFANENRILTSSLPSSLGDIIPKQMKQLHANNTAEVPSYPHVRATALHVQNSTTSNVAQFDTPSPTATQTSSIVPPPLFRNAHAYQNTISGDAPAKPKANGSNQPLRRKYLDQARLKKVRFSYHLIEIMPLLVTLFLSISLFWNF

SEQ ID NO: 36821 - DNA, 713 bp, Panicum virgatum
  misc_feature: Ceres CLONE 1987139
  misc_feature: Encodes the peptide sequence at SEQ ID NO. 36822
cttctccaacctcgcaggcttcgcaaggcggccacacgccgagacctccaccaccacccgctcccgtcgcctcccgtcgcctcgcggcccgccgcctcctcggcctcgcctcctcctccgcgtcggaagccgccgcccgccgcctggctccggctccgatcgccgcctcgtcctacgccgccgccgctaggggctccgtccccagctccagacccttctccacggctcttaactaccacattgattcgccggagaacgagccggacatgaaatgggagttcacggaggcgaacatgaagaaggtcaaggagatactgtctcactacccaagcaactacaagcaatcaggtattattccgctgcttgatcttgcgcagcagcagcatggtggatgggtgccggttgcagcaatggatgctattgctaaaatcgttgaagttgcgccaatcagggtatatgaagttgctacgttttacactatgtttaatcggactaaggttggtaaataccaccttctagtgtgtgggactacaccttgcatgattcgtggctcacgtgaaattgaagagacattattggagcaccttggagttaaaagaaatgaggtgacaagtgatggtttattttctgttggagaaatggagtgcatgggttgctgtgtgaatgctcccatgattgctgtggctgactactcgaaaaggtcagagggttac

SEQ ID NO: 36822 - protein, 236 aa, Panicum virgatum
  misc_feature: Ceres CLONE 1987139
  misc_feature (91)..(232): Pfam Name: Complex1_24kDa Pfam Description: Respiratory-chain NADH dehydrogenase 24 Kd subunit
  misc_feature: SWISSPROT Homolog: EC 1.6.99.5 NADH dehydrogenase (quinone)
SPTSQASQGGHTPRPPPPPAPVASRRLAARRLLGLASSSASEAAARRLAPAPIAASSYAAAARGSVPSSRPFSTALNYHIDSPENEPDMKWEFTEANMKKVKEILSHYPSNYKQSGIIPLLDLAQQQHGGWVPVAAMDAIAKIVEVAPIRVYEVATFYTMFNRTKVGKYHLLVCGTTPCMIRGSREIEETLLEHLGVKRNEVTSDGLFSVGEMECMGCCVNAPMIAVADYSKRSEG

SEQ ID NO: 36823 - DNA, 618 bp, Panicum virgatum
  misc_feature: Ceres CLONE 1987147
  misc_feature: Encodes the peptide sequence at SEQ ID NO. 36824
cgaaagattttttttttcaggcaccctgccgttcgtgaggaggttcacgcccaaggagatcgaggcggccacgaagggcttcaccgcggtgctcgaggccgccgggcattgcggcggcggcggcggcggcggcgcggcgtaccgggcgcgcttcgccgggggcctcgtcgccaccgtcaggcgcgccggcccccgggacggccgccggcagcagggtagcgacggggacgggaaggccgccttctacctggagctgcagctgctggcgcgcctcaaccaccgccacgtcgtccggctccgcggcttcgccgagggccaccgcgccaggttcctggtcttcgaccacatggagaacaggagcctcaaggagtgccttcatgatcctctcaggacgccgttggactggcggaccaggctgcaggtcgccattgacgtcgcagcagcactggaatacctctactacttctgcgaccccccggtgttccatgtcaccgtcgactccggcaacgtgctcatggacgccaacttcgtcgccaagctatcaaacgtcggcgtggtcagcgacgacttgaagctcgcgacaaccgaatccttccaagaccaagttgagcagaggcg

SEQ ID NO: 36824 - protein, 205 aa, Panicum virgatum
  misc_feature: Ceres CLONE 1987147
  misc_feature: SWISSPROT Homolog: EC 2.7.11.1 Non-specific serine/threonine protein kinase
ERFFFSGTLPFVRRFTPKEIEAATKGFTAVLEAAGHCGGGGGGGAAYRARFAGGLVATVRRAGPRDGRRQQGSDGDGKAAFYLELQLLARLNHRHVVRLRGFAEGHRARFLVFDHMENRSLKECLHDPLRTPLDWRTRLQVAIDVAAALEYLYYFCDPPVFHVTVDSGNVLMDANFVAKLSNVGVVSDDLKLATTESFQDQVEQR

SEQ ID NO: 36825 - DNA, 1615 bp, Panicum virgatum
  misc_feature: Ceres CLONE 1987160
  misc_feature: Encodes the peptide sequence at SEQ ID NO. 36826
gaccactgtcctcattctagggttttaggctaattgggcagcggcgctccaaggtttttgcgccgacctgcttcgccacctatggcttagcaggtaggacctcactcgtgttccttctgctgcgccgccgccccatggccgacccaatagaggacgccgccgccgccgccgccgccgtatccgcggccagcaacaacgatgacgacgacgtcgaggacctttacgcggacctcgatgagcaggtcacggccgcgctcgccgccgcgggggagagcggcggctccaatgcgagggactccgacccggccaccgacggcgaggaggtgccggaggtggacgcgaacgaggcggtggatttgggggacgggaccgcgggctacagcagcagcgacgaggagagcgatgatggcctccacatcgtactcaacgaggacgctggcgagccgctgccgcctcctcctgtgggtcgaggtgaggagtgcctggctgaagagggggaggattcgggctgccgtgtgaagggttcacctgtaaacgatggcggctgggcaacggttggtgggctccagtgcaagggacttcttgagaaaatgacgttacctatcatggcggaagttgatcgaggtcgccagcatatgtttcaacgcgattctaatttattcttgacaagaaacagcacaattttcgacatagacattgaagcatttcaacacaagccttggagacaacaaggagtggatcttcgtgactacttcaattttaatctggatgaagaaggctggataaaatattggtgcagcatgaatcaattaaggttagggaccagatcacatgcaaatgaagcatcaggactggatcaagaatcgttgaaactaaaatctgtcaaagcaatgtcaaaggtagcaaattattctggatttgaaggaagaaatggcctcgccaagccaaaaggtagagcaatccatgttgaaggcagtgcacacgaacgagttccgacagcagacttgtggcgtccaatacaaagggattcagatgttgtgattcaagtaaacatgacactttcaccctcaaatcagtccacttcagatgacagctcaaaattaaatcacaagtgtgtgactactgaaagaatgtccattgaccatcctggtgcccgacatttgaagagttccagccttgtggtggacagggtggttgataaggaagtgcatggtggaggttcctcggagtgcaatggcagcaaactggatagaagagattcttcttgtgaaaggggccaatcttctagtcctgattattctgatacgctttctggagaatcaaaaggagatttctatttcaagagagccactagacattcagattccagggtcttccttgaaggcaccaaacttcaggatgagcatgtcaaatctgacttttcccgccattcaagtaagtcagacagagaaaacagtgaaagtcgcagtcatagttataccccttcacctactgatgatagaaatcataaggcaactaaacctttttggaggggtgaagctccttttgctgaacggggcaagtccagtgattcttttgttgtctgcaaaagtgatgacaacctccttaaatctgg

SEQ ID NO: 36826 - protein, 493 aa, Panicum virgatum
  misc_feature: Ceres CLONE 1987160
  misc_feature (184)..(244): Pfam Name: Fip1 Pfam Description: Fip1 motif
MADPIEDAAAAAAAVSAASNNDDDDVEDLYADLDEQVTAALAAAGESGGSNARDSDPATDGEEVPEVDANEAVDLGDGTAGYSSSDEESDDGLHIVLNEDAGEPLPPPPVGRGEECLAEEGEDSGCRVKGSPVNDGGWATVGGLQCKGLLEKMTLPIMAEVDRGRQHMFQRDSNLFLTRNSTIFDIDIEAFQHKPWRQQGVDLRDYFNFNLDEEGWIKYWCSMNQLRLGTRSHANEASGLDQESLKLKSVKAMSKVANYSGFEGRNGLAKPKGRAIHVEGSAHERVPTADLWRPIQRDSDVVIQVNMTLSPSNQSTSDDSSKLNHKCVTTERMSIDHPGARHLKSSSLVVDRVVDKEVHGGGSSECNGSKLDRRDSSCERGQSSSPDYSDTLSGESKGDFYFKRATRHSDSRVFLEGTKLQDEHVKSDFSRHSSKSDRENSESRSHSYTPSPTDDRNHKATKPFWRGEAPFAERGKSSDSFVVCKSDDNLLKS

SEQ ID NO: 36827 - DNA, 601 bp, Panicum virgatum
  misc_feature: Ceres CLONE 1987164
  misc_feature: Encodes the peptide sequence at SEQ ID NO. 36828
ttcgcacgccggattctccaaatcccccgtctccccagtcctcgccgagaccccaattccgccgcgaggttggggtttcctggttccagcgatgctaaagccgaagagcatgctccgcgacgccggcggcggcttcccctccaccaccttcgccccacttcttgcgcgcccgccgcttcagtccgagccctcgcctgcgaccgtcagctcaccggagataacggacgaggagatcggcgccgccaccgcgacctgctgccgcatctgcatggagtccgagtccaagcctggtgatgagctaatatctccctgtatgtgcaaggggacgcagcaatttgtgcaccgctcctgccttgaccattggaagtctgttaaggaaggaactgccttttcacactgcacaaaatgcaacgcgcgattccatctgcgggttgaatgtctggaggatgacatatgtgcgataatgaagttccggttgtttgttgccacagatgtcatacttgtattccttagtatacaagccgccattgctgccataggtggtatggcatatttgttggatagagatgggaacttcagagacacattctctgacgattga

SEQ ID NO: 36828 - protein, 169 aa, Panicum virgatum
  misc_feature: Ceres CLONE 1987164
  misc_feature (56)..(106): Pfam Name: zf-C3HC4 Pfam Description: Zinc finger, C3HC4 type (RING finger)
MLKPKSMLRDAGGGFPSTTFAPLLARPPLQSEPSPATVSSPEITDEEIGAATATCCRICMESESKPGDELISPCMCKGTQQFVHRSCLDHWKSVKEGTAFSHCTKCNARFHLRVECLEDDICAIMKFRLFVATDVILVFLSIQAAIAAIGGMAYLLDRDGNFRDTFSDD

SEQ ID NO: 36829 - DNA, 1015 bp, Panicum virgatum
  misc_feature: Ceres CLONE 1987165
  misc_feature: Encodes the peptide sequence at SEQ ID NO. 36830
ctctcctccccctttctctcctcccccgtacgaaaccctaggctccgccgcccaaaaccccgccgccgccgttcggcggcgccccatggccccagccttctccgtgcccgacgccgaggacctccccgcccgcagatccgacaacgccgacgtcgcaggcaacgtctgggacctcgccaccctccccgcgtcccccgccggcggcggccgcgagatatacatctaccgcaacacgttcaacctcgtcccgcgctccataggcggcggagacggcctcaggtcgctcaagttcttcggcaacgatgtcgaggtgctccccacggacgccagcggcgagctggatgggctcgagagcctgcaggtcaaggtgtcggcccccagggtctcaggggcgccgctccgccggatgcgggcgctcaaggagctcgagctctcaatggtgccgccaaggccgtcctcgtgctccatactggccgaggttgccgggctcaagtgccttaccaagctgaccatatgccacttctcgattaggtacctccctcctgagattggctccctcaggaagctccaagaacttgacctttctttcaacaaactgaagaacttacctaactgtataattgagttgagtgcgctgaagttcctcaaagtgaccaataataagttggtgaatgtaccatcaggaatctcctctttgagatgtcttgaaagcctcgacttatcaaacaacagattgacttctcttggatcggttaaacttgtttctatgcttacactgcagtatttaaaccttcagtttaataggctctcccattcttatgtaattccctcatggatatgctgtgacatgaggggaaatgttgagaatggcatgaagggtggtaagctgaagtactcaggtgtagcaagcacgaacagattagcagaatcaataatttcaagtcgttcttccgacgctgcgcttttatgcttgcaaccagaagcttccccaaatttaaaacaccatgccccacag

SEQ ID NO: 36830 - protein, 309 aa, Panicum virgatum
  misc_feature: Ceres CLONE 1987165
  misc_feature: SWISSPROT Homolog: EC 4.6.1.1 Adenylate cyclase
MAPAFSVPDAEDLPARRSDNADVAGNVWDLATLPASPAGGGREIYIYRNTFNLVPRSIGGGDGLRSLKFFGNDVEVLPTDASGELDGLESLQVKVSAPRVSGAPLRRMRALKELELSMVPPRPSSCSILAEVAGLKCLTKLTICHFSIRYLPPEIGSLRKLQELDLSFNKLKNLPNCIIELSALKFLKVTNNKLVNVPSGISSLRCLESLDLSNNRLTSLGSVKLVSMLTLQYLNLQFNRLSHSYVIPSWICCDMRGNVENGMKGGKLKYSGVASTNRLAESIISSRSSDAALLCLQPEASPNLKHHAP

SEQ ID NO: 36831 - DNA, 702 bp, Panicum virgatum
  misc_feature: Ceres CLONE 1987177
  misc_feature: Encodes the peptide sequence at SEQ ID NO. 36832
acccaccatcaccgagctctcttcctccctctctgctatctctctcggcacgcacgcgcgcgagctctccttcctcgtcgaggtgcattgatggcgaccgaagtggctgaggctccggtgccgctggctgaggcggcccccgacgccgcagcggaggcccccgccgcggccgcggccgccggcgacgcgaagccggccaaggccaagaagcccgccgcgccgcggaagcgcgcgaacccgacccacccaccctacgctgagatgatctcggaggcgatcacgtcgctcaaggagaggacggggtcgagccagtacgcgatcgccaagttcgtggaggacaagcagaaggccaagctgcctcccaacttccgcaagctgctgctcgtgcagctgaagaagctcgtcgccgccggcaagctaaccaaggtcaagaactcgtacaagctgccggcggggcgcgccccggccgccgacaagcccaagcccaaggctaagcctgctgccgccaagcccaagtcgaagccgaagcctgccgcgaagaagcccaaggccgccgccaagcccaaggccaaggcgcccgccaaggctaagcccgccgcgaagccgaagccgaagccggccgccaagcccgcggcccagctgaaggcagtcgctgcgaagccgaagccagccgcctagccggctgccaagccccatccagcc

SEQ ID NO: 36832 - protein, 195 aa, Panicum virgatum
  misc_feature: Ceres CLONE 1987177
  misc_feature (51)..(121): Pfam Name: Linker_histone Pfam Description: linker histone H1 and H5 family
  misc_feature: Functional homolog of the protein sequence given in SEQ ID NO 50919
  misc_feature: Useful for making plants with modulated nitrogen use efficiency
  misc_feature: Useful for making plants with modulated oxidative stress sensitivity
MATEVAEAPVPLAEAAPDAAAEAPAAAAAAGDAKPAKAKKPAAPRKRANPTHPPYAEMISEAITSLKERTGSSQYAIAKFVEDKQKAKLPPNFRKLLLVQLKKLVAAGKLTKVKNSYKLPAGRAPAADKPKPKAKPAAAKPKSKPKPAAKKPKAAAKPKAKAPAKAKPAAKPKPKPAAKPAAQLKAVAAKPKPAA

SEQ ID NO: 36833 - DNA, 650 bp, Panicum virgatum
  misc_feature: Ceres CLONE 1987193
  misc_feature: Encodes the peptide sequence at SEQ ID NO. 36834
tgaccgcaagaagcaaaccagatctctccgtccagccgaacccaatcggatccttccgtcgccgagatgggccgcaagttcttcgttggtggaaactggaaatgcaatggaaccactgatcaggtcgacaagattgtcaagaccttgaatgaaggacagattccatctacagatgttgttgaggttgttgtcagccctccttatgtgttcattcctgtggtcaagagccagctgcgccctgagatccaggttgctgctcagaactgctgggtgaagaagggtggtgcttacactggtgaagttagtgctgagatgcttgtcaaccttggtgttccgtgggtcattcttggacactctgaaaggagagctcttttgggagaatcaaatgagtttgtgggagacaaggttgcctatgcacttgctcagggcttgaaggtcattgcctgcgttggtgagacccttgagcagcgggaatctggatcaaccatggatgtggttgctgcacaaacaaaagcaattgcggagaggatcaaggactggagtaacgtggttattgcctacgaaccagtctgggccattggtaccggtaaagttgccactccagctcaggctcaggaagtgcatgcgtccctgagggattggctgaagac

SEQ ID NO: 36834 - protein, 194 aa, Panicum virgatum
  misc_feature: Ceres CLONE 1987193
  misc_feature (5)..(194): Pfam Name: TIM Pfam Description: Triosephosphate isomerase
  misc_feature: SWISSPROT Homolog: EC 5.3.1.1 Triose-phosphate isomerase
  misc_feature: Functional homolog of the protein sequence given in SEQ ID NO 50215
  misc_feature: Useful for making plants with modulated biomass
MGRKFFVGGNWKCNGTTDQVDKIVKTLNEGQIPSTDVVEVVVSPPYVFIPVVKSQLRPEIQVAAQNCWVKKGGAYTGEVSAEMLVNLGVPWVILGHSERRALLGESNEFVGDKVAYALAQGLKVIACVGETLEQRESGSTMDVVAAQTKAIAERIKDWSNVVIAYEPVWAIGTGKVATPAQAQEVHASLRDWLK

SEQ ID NO: 36835 - DNA, 424 bp, Panicum virgatum
  misc_feature: Ceres CLONE 1987199
  misc_feature: Encodes the peptide sequence at SEQ ID NO. 36836
gcttctctccggcggggaacgccggcgccggccgcgccttgagagcagctcagctcgatcccgctaggttagatatggctgccgggagtgccagtgccagggcgtcgctctccgtcacggcggcggcggcggcggcggcctcgcgcgtggggcggccgtgcggtggcgctcgcgcttgggtaccctcacaaccggcgcaacaagggtccctcctcacgctgaggccctgcaccgccgtggcgccgcatgccccactgtggcgggcggagaccggtggcgcgggcggcggggccggtgccagcgacgtcatgggcctcatcatccgggagcgcatcgtcttcctcggcaacgatatcgaggacttcctcgcggacgccgacttcggacatatcctcctcatcgacgacgtccacccggactccca

SEQ ID NO: 36836 - protein, 116 aa, Panicum virgatum
  misc_feature: Ceres CLONE 1987199
  misc_feature: SWISSPROT Homolog: EC 3.4.21.92 Endopeptidase Clp
MAAGSASARASLSVTAAAAAAASRVGRPCGGARAWVPSQPAQQGSLLTLRPCTAVAPHAPLWRAETGGAGGGAGASDVMGLIIRERIVFLGNDIEDFLADADFGHILLIDDVHPDS

SEQ ID NO: 36837 - DNA, 295 bp, Panicum virgatum
  misc_feature: Ceres CLONE 1987203
  misc_feature: Encodes the peptide sequence at SEQ ID NO. 36838
tcgagctgctctccacgccggccactgtctgtcctccgttgggctgcgcctcaagccaccgtcggtgacggggaggagatgatgctgagcgggcacggcggcgggaggcgcctggtcacggcgtcccagtggcaggagctggagcaccacgcgctcatctacaagtacatggcgtacggcgcgcccatgccgcacgacctcctccagccactccgtctcgccaccggcgtcgaaccgcccccctccctcgccttccccaccaagacctcgccctcccaggggtactgcggctgca

SEQ ID NO: 36838 - protein, 72 aa, Panicum virgatum
  misc_feature: Ceres CLONE 1987203
  misc_feature (11)..(47): Pfam Name: QLQ Pfam Description: QLQ
  misc_feature: The sequence is a functional homolog of SEQ ID NO 1781 in the 10/374,780 US patent application
MMLSGHGGGRRLVTASQWQELEHHALIYKYMAYGAPMPHDLLQPLRLATGVEPPPSLAFPTKTSPSQGYCGC

SEQ ID NO: 36839 - DNA, 761 bp, Panicum virgatum
  misc_feature: Ceres CLONE 1987219
  misc_feature: Encodes the peptide sequence at SEQ ID NO. 36840
aaattcccaccgcgtgccgtgcgcatcgatctagcgcctcttctccaaatccaaccccaccgtccttctgctcaaaaaaaaaaaaaaaaaaccccaccgtccttgctcacgaaggctactagaagagccctccctcctctccggcgccttctcctcggatccccaaccgactccgccgaccagccaggatcgatggaggcgaagatggggcgcttcttcgagtccgtgggcagcttcttcaccggcggcgacaacatcccctggtgcgaccgcgacatcatcgccggatgtgaaagagagcttgccgatgctgcaactgaagagcagaggaatgatagccttatgaggctttcttgggcccttgtgcactccaggcagatggacgatgtaaatcgtggaattagcatgcttgaagcttctttggataattctggcagccctctggagactagggaaaagctgtacttgttggctgttgggcattacaggaatggtgactactcaaaaagccggcaacttgcggaacgctgtttgcagattcaacctgattggaggcaggctatttctctgaagaaagcaatagaagataaaattgccaaagatggtcttattggaataggaattgcgacaactgctgtgggacttctgggtggtagaattgcagctgctgttgccagaaagaagtaagatgaataagaaccgtgtagagtcaggagtcaagactgctctccccttcggcccttccccttccccttccccgt

SEQ ID NO: 36840 - protein, 164 aa, Panicum virgatum
  misc_feature: Ceres CLONE 1987219
  misc_feature (87)..(120): Pfam Name: TPR_2 Pfam Description: Tetratricopeptide repeat
MEAKMGRFFESVGSFFTGGDNIPWCDRDIIAGCERELADAATEEQRNDSLMRLSWALVHSRQMDDVNRGISMLEASLDNSGSPLETREKLYLLAVGHYRNGDYSKSRQLAERCLQIQPDWRQAISLKKAIEDKIAKDGLIGIGIATTAVGLLGGRIAAAVARKK

SEQ ID NO: 36841 - DNA, 625 bp, Panicum virgatum
  misc_feature: Ceres CLONE 1987220
  misc_feature: Encodes the peptide sequence at SEQ ID NO. 36842
acccgtcattggcgcgaggggaggcggagggaacgacgggggcggaggagaaatcgtttaatccctcccccccgtctccgcctcgtctcctctcgccatcgcccaccgcccccaccccccggcgcaggcgcgagggcgacgttgccggctcgtcttcggcgacggagcggaacgattccaccagggccaggaactctgtcgttttcgtggcgtttggtgcctgtccgttgagcgagcggggccaggaacctttctgagaagaggtaatcgaagtccgtttggtccctcgcggcggggatggacgagaaggcgaagatggagagcaagctgtcctcggcggcggcgttcgtggagggcggcgtgcaggacgcctgcgaagacgcctgcagcatctgcctcgacgccttctgcgacagcaacccctccacggtcacgaattgcaagcacgactaccatctccagtgcattcttgaatggtgccagagaagctcccaatgtccaatgtgttggcagcctatcagcatgaaagatcctatgagtcaagagctgctggaggctgttgaacaagagaggaacatgcgagctaatcgttcacatagtacagctctttttcggcacccaatgc

SEQ ID NO: 36842 - protein, 109 aa, Panicum virgatum
  misc_feature: Ceres CLONE 1987220
  misc_feature (30)..(70): Pfam Name: zf-C3HC4 Pfam Description: Zinc finger, C3HC4 type (RING finger)
  misc_feature: SWISSPROT Homolog: EC 2.7.11.25 Mitogen-activated protein kinase kinase kinase
MDEKAKMESKLSSAAAFVEGGVQDACEDACSICLDAFCDSNPSTVTNCKHDYHLQCILEWCQRSSQCPMCWQPISMKDPMSQELLEAVEQERNMRANRSHSTALFRHPM

SEQ ID NO: 36843 - DNA, 1450 bp, Panicum virgatum
  misc_feature: Ceres CLONE 1987233
  misc_feature: Encodes the peptide sequence at SEQ ID NO. 36844
attgctagctagagtagagtagtagtactctccttcccctccctcttgtgcatgtccgctggatagatagatccatcgtccatcgtctctgcgcgcgcgcggcctgcctatagctagctaccaaaccaaacaataatgagctctcttactggtgtgccgctgacggcggtggccgtctcttccattctgctgctgctgctcctggccggctccgccgtgggctacaacgactccgagtccgactctttgatgcagtgggcaagcgccagggccacctggtacggccagcccaacggcgaagggccatacgacaacggtatgcatgcatatcatcatgtacttctttttgttttttgaaaggaacagatgtattaaacatcacccctgccaaattaaatcgccagatacaagttcttttacaaattcagggacctgactaatatacatctcagaatcagaagccaacatgctagctccatacgctgctaccttattacaggattacaaagcgatagagagagaaatgcattcgcataagatcttgaataatctgacgcactaataagcatccatacgcacttctcttctttcttcttttcgttccttaattggatgcatgcatgatatatagatgaattctatctatactagctagctagctagtagctaatacaatatataagagaaataattagttaaaattattgcattgcaggcggcgcttgcggtttcaagaatgtgaaccagtaccccttcctgtccatgacctcgtgcggcaaccagccgctgttccgcgacggcaagggctgcggctcctgctacaagatcaggtgctccaagcaccccgcctgctccggccgcgccgagacggtggtcatcaccgacatgaactactaccccgtcgcgccctaccacttcgacctcagcggcaccgccttcggcaagctcgccaagcccggccgcaacgacgacctccgccgcgccggcatcatcgacgtccagttcgccagggtaccctgcgagttcccgggcctcaaggtcggcttccacgtcgaggagggctccacccaggtctacctggccctgctcgtcgagtacgagaacggcgacggcgacgtggcgcagctggacctcagggaggccgcgggcggccggggcatcagccgccgctggacgcccatgcgccgctcctggggatccgtctggcgcctcgactccaaccaccgcctgcagccgcccttctccatccgcctgcgcagcgactcgggcaagacgctggtggcgccagacgtcatccccgtcaactggagtccaaacacattctacagatcattcgtccagtactcctagctagtcctaggtagctgcatgctaagctagttgatgatgatgatgattcgatgattcgattcagttcagttcaattcaattcaattcgtcatcgtcgatc

SEQ ID NO: 36844 - protein, 195 aa, Panicum virgatum
  misc_feature: Ceres CLONE 1987233
  misc_feature (2)..(81): Pfam Name: DPBB_1 Pfam Description: Rare lipoprotein A (RlpA)-like double-psi beta-barrel
  misc_feature (93)..(179): Pfam Name: Pollen_allerg_1 Pfam Description: Pollen allergen
  misc_feature: Functional homolog of the protein sequence given in SEQ ID NO 51070
  misc_feature: Useful for making plants with altered carbohydrate content
MTSCGNQPLFRDGKGCGSCYKIRCSKHPACSGRAETVVITDMNYYPVAPYHFDLSGTAFGKLAKPGRNDDLRRAGIIDVQFARVPCEFPGLKVGFHVEEGSTQVYLALLVEYENGDGDVAQLDLREAAGGRGISRRWTPMRRSWGSVWRLDSNHRLQPPFSIRLRSDSGKTLVAPDVIPVNWSPNTFYRSFVQYS

SEQ ID NO: 36845 - DNA, 658 bp, Panicum virgatum
  misc_feature: Ceres CLONE 1987234
  misc_feature: Encodes the peptide sequence at SEQ ID NO. 36846
actgcactgcaggctagttccaaaccaggactggacggtgagagcgtacgtggcgccacttttactgcgacgacgacatggctcctccagcttcccgcaagcaccaccaccgctcccggcctctccctcgccgcgtgccggcggtcttgttggtcctcacactgctggcggccgccgccacggtggcgagcgcgcagctgtcgtcggaggactactacgacgcgtcctgccccgccgccctcctcaccatcaggtccgccgtggcgacggcggtgctgctcgaccgccgcatgggggcctccctcctccggctccacttccacgactgcttcgtgcagggctgcgacgcgtcggtgctgctggacgacgacacgacggcgggcttcaccggcgagaagggggcggggccgaacgcggggtcgctgcgcggcttcgacgtcatcgacaacatcaagatgctgctggagttgctgtgcccgcagaccgtctcctgcgccgacatcctcgccgtcgccgcccgcgactccgttgaacagctgggaggcccatcctggacggttcccctgggcaggcgggacgcgaccacggcgagcgcgtccctggccaacagcgacctccctggacccacgcccacctcaacggcctcatcaacgctttc

SEQ ID NO: 36846 - protein, 193 aa, Panicum virgatum
  misc_feature: Ceres CLONE 1987234
  misc_feature (58)..(191): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50996
  misc_feature: Useful for making plants with altered carbohydrate content
  misc_feature: Functional homolog of the protein sequence given in SEQ ID NO 50229
  misc_feature: Useful for making plants with altered cell wall content and/or composition
  misc_feature: Functional homolog of the protein sequence given in SEQ ID NO 51034
  misc_feature: Useful for making plants with modulated nitrogen use efficiency
  misc_feature: Functional homolog of the protein sequence given in SEQ ID NO 51417
  misc_feature: Useful for making plants with modulated oxidative stress sensitivity
MAPPASRKHHHRSRPLPRRVPAVLLVLTLLAAAATVASAQLSSEDYYDASCPAALLTIRSAVATAVLLDRRMGASLLRLHFHDCFVQGCDASVLLDDDTTAGFTGEKGAGPNAGSLRGFDVIDNIKMLLELLCPQTVSCADILAVAARDSVEQLGGPSWTVPLGRRDATTASASLANSDLPGPTPTSTASSTL

SEQ ID NO: 36847 - DNA, 753 bp, Panicum virgatum
  misc_feature: Ceres CLONE 1987239
  misc_feature: Encodes the peptide sequence at SEQ ID NO. 36848
acaacacccttctctctccgccgcgccgccgccgccgcagccaaaacagcctcctcctccgactcgctcgctctccgtcgaggccatggcgtcctcctcctcctctttactcttcccttcgacctcttcatcctcctcgccgtcttcggcgcgggtggaggcggtggtgctcttcaacatctgcgacagctacgtgcgccgcccggaccaggcggaccgcgtcatcggcaccctcctaggctccctcctccccgacggcaccgtccacgtccgcaactcctatgtcgtcccccacaacgaatccgccgaccaggtcgccatcgacatcgagtaccaccataacatgtacgcctcgcaccagaaggtcaaccccaaggaagttatcgtcggatggttctcgactggctttggtgtttcaggggggagtacacttatccatgacttctattcaagggaagtgcaaaaccccatccatcttacagtcgacaccggcttcactaggggggaggcatccatcaaagcgtacatctcatccaacctgtccctaggagataggcacctcgctgcacaatttcaggaaatcccgctggatctaaggatgattgaggcagaaaaggctggatgtatgtcatttttctgattacgtattcgtcacatgctacatgagtctttttggtctactgggactgaactatgaagagctgaaacacttaatctagtaatatataaattgctttagagcaccatcaaact

SEQ ID NO: 36848 - protein, 184 aa, Panicum virgatum
  misc_feature: Ceres CLONE 1987239
  misc_feature (17)..(127): Pfam Name: Mov34 Pfam Description: Mov34/MPN/PAD-1 family
  misc_feature: Functional homolog of the protein sequence given in SEQ ID NO 51531
  misc_feature: Useful for making plants with altered alkaloid content
  misc_feature: Useful for making plants with altered terpenoid content
MASSSSSLLFPSTSSSSSPSSARVEAVVLFNICDSYVRRPDQADRVIGTLLGSLLPDGTVHVRNSYVVPHNESADQVAIDIEYHHNMYASHQKVNPKEVIVGWFSTGFGVSGGSTLIHDFYSREVQNPIHLTVDTGFTRGEASIKAYISSNLSLGDRHLAAQFQEIPLDLRMIEAEKAGCMSFF

SEQ ID NO: 36849 - DNA, 1066 bp, Panicum virgatum
  misc_feature: Ceres CLONE 1987246
  misc_feature: Encodes the peptide sequence at SEQ ID NO. 36850
gttccggccgcaggcagaagcgcacgcccccctcgccgcagttccacccccacccgaaccccgaggagcggcggcggcggattcggccatggtgcggtgcagcaacggcctcctgggcctcctgaacgcgggcgtgctggtcctggccgtcgtcgcgctgggcggcggcgcgtggctgagccaccgcgcctccaccgactgcgagcggttcctcgagcggcccgtcatcgcgctgggcgtgctcctcctcgcgctctccctcgcgggcctggcgggggcgctctgccgcgcgtcctgcctcctctggctctacctcctcgctctcttcctcctcatcgtgctcctcttcgcattcaccatcttcgccttcgtcgtcaccaaccgcggcgccgggtgggtcgtctccggcagggggtacaaggagtaccgcctcggggactactccacctggctgcagcggagggtcgagaacgccgggaattgggccaagatccggagctgcctccaggacggcaaggtctgccagaagcttggggacaggaaggagacggtcacccagttcgtcaacagcaacctctccccgatccagtctggatgctgcaagccaccgaccggctgcaacttcacctaccagagcgagactgtctggatcaaacccgctggcttcaacactaccactgacgatcctgactgcaccacatggtcgaacgtccagaccgtgctctgctatgactgtatggcgtgcaaggcgggcgtgctcgccaacctgaagaacgactggaaaaagatcgccaccgtcaacattgtcttcctgatcttcctcatcgtcgtctactctgtggggtgctgcgctttcaggaacaaccggcaggacaactcgtacccggcctggaagtaaggtgcgcgtggctatgtataggttgttagggtgtgtaattgtgtcgcggtgtggtcttatgtgtcaaccgtcagtagttgatgcttgctagtatgttgctctgagctctcgaacgtgaaatgatgtgtgaatgctgctaatcaagatatgtcgaaaatttgtctgtcc

SEQ ID NO: 36850 - protein, 269 aa, Panicum virgatum
  misc_feature: Ceres CLONE 1987246
  misc_feature (4)..(245): Pfam Name: Tetraspannin Pfam Description: Tetraspanin family
MVRCSNGLLGLLNAGVLVLAVVALGGGAWLSHRASTDCERFLERPVIALGVLLLALSLAGLAGALCRASCLLWLYLLALFLLIVLLFAFTIFAFVVTNRGAGWVVSGRGYKEYRLGDYSTWLQRRVENAGNWAKIRSCLQDGKVCQKLGDRKETVTQFVNSNLSPIQSGCCKPPTGCNFTYQSETVWIKPAGFNTTTDDPDCTTWSNVQTVLCYDCMACKAGVLANLKNDWKKIATVNIVFLIFLIVVYSVGCCAFRNNRQDNSYPAWK

SEQ ID NO: 36851 - DNA, 660 bp, Panicum virgatum
  misc_feature: Ceres CLONE 1987248
  misc_feature: Encodes the peptide sequence at SEQ ID NO. 36852
atctcagcccaatcggcagcagcagccaagttttccaaccaaaactctgcgatagatcacctgctagctccttcagctgatcgagtgtcatggcctgcactcaggaggtgatgttcgacttgaacctgatcgagaacagcgccctggaggacggcctggccggctggtcgccggtgggctcgtgcccggcgctgtccgcgcacgaggaggagccggccaaggtgccgacggagacgatcaacgacgtcggcgaggactaccgccccagcggccggtacatcctcgcgtcggggcgcgccgacgaggcggacggcatgcggcaggcgatcaagggcgcgctcaagccccgggtcacgtaccgcgtcgccgggtggatcagcctcggcggcgccgccgccgccgacgccgagggggccggccacgcggtgcgcgtcaacctccgcttggacgacgacgagtgcgtcgtggagggcggcgcggtgtgcgccgaggttgggaagtgggcggagatcaagggcgcgttccggctcaagaggagcccgcgcgccgccgcggtgtacgtgcagggcgcgcccgcgggcgtggacgtgaaggtgatggacctccaggtcttcgccaccgaccgcaaggcacggttcaggaggctcaggaggaagactg

SEQ ID NO: 36852 - protein, 190 aa, Panicum virgatum
  misc_feature: Ceres CLONE 1987248
  misc_feature (11)..(177): Pfam Name: CBM_4_9 Pfam Description: Carbohydrate binding domain
  misc_feature: Functional homolog of the protein sequence given in SEQ ID NO 51099
  misc_feature: Useful for making plants with altered carbohydrate content
MACTQEVMFDLNLIENSALEDGLAGWSPVGSCPALSAHEEEPAKVPTETINDVGEDYRPSGRYILASGRADEADGMRQAIKGALKPRVTYRVAGWISLGGAAAADAEGAGHAVRVNLRLDDDECVVEGGAVCAEVGKWAEIKGAFRLKRSPRAAAVYVQGAPAGVDVKVMDLQVFATDRKARFRRLRRKT

SEQ ID NO: 36853 - DNA, 476 bp, Panicum virgatum
  misc_feature: Ceres CLONE 1987251
  misc_feature: Encodes the peptide sequence at SEQ ID NO. 36854
ctatccgagttccgcagagaaaggcgtcttcctactcgcctctctccgagcttcaaagcttctcctcccatttcccaccgccggcgccggccacccttccgacgacaccatgagggagtgcatctcgatccacatccgccagggcggtatccaggtcggaaacgcgtgctgggagctgtactgcctcgagcatggcattcaacctgatggtcaaatgcccagtgacaagacagttggaggacgtgatgatgcattcaacaccttcttcactgagactggcgctgggaagcctgtcccccgtgctgtgtttgttgatcttgagcccactgtcattgatgaggcgaggactggtacttaccgcccgcttttccaacccgagcagctcatcagtggcacggaggatgctgccaccgactttgcccgtggtcactccaccacttggcaagagattgttgacctatgccttgaccgcatca

SEQ ID NO: 36854 - protein, 122 aa, Panicum virgatum
  misc_feature: Ceres CLONE 1987251
  misc_feature: Functional homolog of the protein sequence given in SEQ ID NO 50141
  misc_feature: Useful for making plants with altered cell wall content and/or composition
MRECISIHIRQGGIQVGNACWELYCLEHGIQPDGQMPSDKTVGGRDDAFNTFFTETGAGKPVPRAVFVDLEPTVIDEARTGTYRPLFQPEQLISGTEDAATDFARGHSTTWQEIVDLCLDRI

SEQ ID NO: 36855 - DNA, 1419 bp, Panicum virgatum
  misc_feature: Ceres CLONE 1987252
  misc_feature: Encodes the peptide sequence at SEQ ID NO. 36856
aggccgcagtcgccatccgtccccgccgcgggccgagcgacccggcgctgctgcgatctctccccgtccgcgccgtctatcgctcgcgcggccgggccggcggccgccgcgatgggcagcgaggacgtgctcgtcgagatccacccctgcgagctccgcttcctctttgagttgaagaagcagagttcatgttgtgtccatcttgtgaacaagtcagatcaatatgttgcattcaaggttaaaacaacttctccaaaaagatattgtgttcgaccaaatgtaggagttattcttcctttggcatcgtgtgattttacagttactatgcaagcggtaaagaatgctccaccagatctgcaaataaaagacaagttccttgtgcagaccacagttgttccgtttggtacagctgatgaagacatcgttcctgcttttttctccaaagaaaccgaccgatatattgaggagaagaagttgaaagttgtccttgtcagcatggcacagcctcaagtagagcaacccacaaatggactttcccatgccaaggaaacagttgggattcctgtgacagaggaaatactggataatgtgaatgaagcgcctgttgttgtgaatgaagtttttcatcccctgaatgaatctgctcccaatttgcaagaaacatctgctacctctgtagaatctcagtttgcttcaacagaaacaagtgcggacttgaaatcgccaccattggaatatactcctgctccaagtgaagttccatcactaagtgatatagaatctaccaatactgataatattcatatatctcatgtaaccgaagatgtccacactttacaaatgaaacttaacaatcttggagttaaacttgaagaggcagaaactttgatcttaaatttgatggaagagaccagaggtaccatccaagagcgggataaattacggaaagagatggtattcttgaaaagggcgggggcttcacagggtcagtccagcactggttttcccctgcttttcgtcgtctatatggcagttgttggcatgtcgctcggttaccttctgcacctatgaacggagtatcagagatgaagcgcctgggccaggcatcgctgatctttcttggagcggccgagtttcagaggttgctagggtacttaatcagagagaaactaccgtcgcgtcatgaccgtcagattagttggtggatttccatatacacctcagggtgacagttactggaccgtatagaaatagaacagcgttattttactctgtatagaactcatagtgttctccgatccgttctgaaatagcacatgaacgctgctcaagagtcaagatgatggtatagacacccgttggttcttgttttcttgtaaaaatttttgaaagagaaagaaaactaccagaagtttgtgg

SEQ ID NO: 36856 - protein, 319 aa, Panicum virgatum
  misc_feature: Ceres CLONE 1987252
  misc_feature (7)..(114): Pfam Name: Motile_Sperm Pfam Description: MSP (Major sperm protein) domain
MGSEDVLVEIHPCELRFLFELKKQSSCCVHLVNKSDQYVAFKVKTTSPKRYCVRPNVGVILPLASCDFTVTMQAVKNAPPDLQIKDKFLVQTTVVPFGTADEDIVPAFFSKETDRYIEEKKLKVVLVSMAQPQVEQPTNGLSHAKETVGIPVTEEILDNVNEAPVVVNEVFHPLNESAPNLQETSATSVESQFASTETSADLKSPPLEYTPAPSEVPSLSDIESTNTDNIHISHVTEDVHTLQMKLNNLGVKLEEAETLILNLMEETRGTIQERDKLRKEMVFLKRAGASQGQSSTGFPLLFVVYMAVVGMSLGYLLHL

SEQ ID NO: 36857 - DNA, 468 bp, Panicum virgatum
  misc_feature: Ceres CLONE 1987259
  misc_feature: Encodes the peptide sequence at SEQ ID NO. 36858
aaatcaaatccccaaacacacacccaaaccccgggccgggcaactgctctgctcctcctccgcgccgcggggggcagggagggaggtcgagcgccgacgaggacccccagcaccgccgcccctatggccatggagttccgctccagggtcccgccgcgccgggcggcggccgggggcgagggggagcgggagcgggtgctgctggattgggtaggcatgctactcgccttcagacaaggtatgatggttctcgccactctcgtggtgactgccgcgatgacatacctcctttggacaactacgtggacaatcactactttggagagattggcatcggctcgccgccacagaacttcactgtgatattcgacactggatcctccaacttgtgcattccctcctcaaaatgctatttctcgatagcatgcgacttacacaacggatacaagtcagtctagtccaagactt

SEQ ID NO: 36858 - protein, 151 aa, Panicum virgatum
  misc_feature: Ceres CLONE 1987259
  misc_feature: SWISSPROT Homolog: EC 3.4.23.40 Phytepsin
IKSPNTHPNPGPGNCSAPPPRRGGQGGRSSADEDPQHRRPYGHGVPLQGPAAPGGGRGRGGAGAGAAGLGRHATRLQTRYDGSRHSRGDCRDDIPPLDNYVDNHYFGEIGIGSPPQNFTVIFDTGSSNLCIPSSKCYFSIACDLHNGYKSV

SEQ ID NO: 36859 - DNA, 680 bp, Panicum virgatum
  misc_feature: Ceres CLONE 1987260
  misc_feature: Encodes the peptide sequence at SEQ ID NO. 36860
accgagtgacacacagagaaacagcagatttgcgttgtctcccgcgcagccgagtggttcagtgctagctagctagctggctgttgttgggacctgggcgcccctggaccgggaaggacgccactccctctcttccacacgaccacacctctgttcgcttccatttgggtttcaggccaagagaggctaagttcatagcttaagggtgctgaattcaagggactgcgccgagatggagcacatcgcgaggttcttcttcggagtttccgggaatgtcattgcgctcttcctcttcctgtcgcctgtcgtcaccttctggaggatcatcaagaagcgctcgacggaggacttctccggcgtgccctacaacatgacgctgctcaactgcctcctatcggcttggtacgggctgccgttcgtgtccccgaacaacatcctggtgacgacgatcaacgggacggggtcgctgatcgaggccatctacgtggtgatcttcctcatcttcgcggagcggcggatccggctgcggatgctgggcctgctgggcgtcgtcacctccatcttcgccgcggtggtgctcatctcgctgctggccctccacggcaacgcccgcaagatcttctgcggcctggccgccaccatcttctccatctgcatgtacgcctcgccgctctccatca

SEQ ID NO: 36860 - protein, 149 aa, Panicum virgatum
  misc_feature: Ceres CLONE 1987260
  misc_feature (7)..(96): Pfam Name: MtN3_slv Pfam Description: MtN3/saliva family
MEHIARFFFGVSGNVIALFLFLSPVVTFWRIIKKRSTEDFSGVPYNMTLLNCLLSAWYGLPFVSPNNILVTTINGTGSLIEAIYVVIFLIFAERRIRLRMLGLLGVVTSIFAAVVLISLLALHGNARKIFCGLAATIFSICMYASPLSI

SEQ ID NO: 36861 - DNA, 657 bp, Panicum virgatum
  misc_feature: Ceres CLONE 1987262
  misc_feature: Encodes the peptide sequence at SEQ ID NO. 36862
gaagtcgccggcaatcgtttccgaccttgggtctcgcggggttccccgaggcgagggcttcgattcgacccgggaatcgcccaaatccgcttggatttgacctcggctcggcccccccacgggacgaaatttctaggggtttagccgcacgagatcctccagagtttttgagcattttgccgtcaaatttcgtgggggatttgcgcgtatgggggatcatgtcgcggtggatgttggggagctcgtggcgtcccgagccggcgaggcagcggggttggtgcccggcggcaaggaggaagccgaggcgctgattgggatggtggagtgccgcatttgccaggaggaggacctggccaagaacctcgagagcccctgcgcttgcaacggtagcctcaagtatgcccacagggaatgtgtgcaacgttggtgctatgagaaaggagacataacctgtgaaatctgccatcagtcgtacaagcctggctacactgctccaccccaggtgcatcatgatgaaactaccatagagataagtggtggagattggactatctctggcaaccgtttggatctacatgatcctagaatcttggcaatggctgctgctcaacaccgtttgcttgaagatgagtatgatgaatatactgcaacaaacaa

SEQ ID NO: 36862 - protein, 149 aa, Panicum virgatum
  misc_feature: Ceres CLONE 1987262
  misc_feature (40)..(85): Pfam Name: zf-C3HC4 Pfam Description: Zinc finger, C3HC4 type (RING finger)
  misc_feature: Functional homolog of the protein sequence given in SEQ ID NO 51157
  misc_feature: Useful for making plants with altered lignin content
MGDHVAVDVGELVASRAGEAAGLVPGGKEEAEALIGMVECRICQEEDLAKNLESPCACNGSLKYAHRECVQRWCYEKGDITCEICHQSYKPGYTAPPQVHHDETTIEISGGDWTISGNRLDLHDPRILAMAAAQHRLLEDEYDEYTATN

SEQ ID NO: 36863 - DNA, 533 bp, Panicum virgatum
  misc_feature: Ceres CLONE 1987282
  misc_feature: Encodes the peptide sequence at SEQ ID NO. 36864
  misc_feature (116)..(116): n is a, c, t, g, unknown, or other
aacttcgcaaggcatggaggcggcggccgcggctgtggcggccgctgcgccggaagagggtcggggggaggaggaggaggaggaggcagagtgggcatggagctggggcgctggcncggacgggcagctggggaacggcggcttcgacgaccaccatctcccgcagccgctgcttctccccacccgatgccgcggccgtgtctccctcgtcgccggcggcggcgcccatgccatcgccctcacaagtgatggtgaattatttacttggggtagaggtacacatggtcaattgggtcatggaaacttggacagtatcccccatcccaaatttgttaagttccttgaaaatcatcaagttacatgtgtctctgcgggatggaaccattctggacttgctacagattctggaaaactcttcatgtgcggagatggctcgtttcgacagcttggcactggcgataaccactctaggaactttccgtttcaagtggcatactttactgcaaagcatattgagaaacttgctctaggga

SEQ ID NO: 36864 - protein, 173 aa, Panicum virgatum
  misc_feature: Ceres CLONE 1987282
  misc_feature: SWISSPROT Homolog: EC 2.7.11.1 Non-specific serine/threonine protein kinase
  misc_feature (35)..(35): Xaa is any aa, unknown, or other
MEAAAAAVAAAAPEEGRGEEEEEEAEWAWSWGAGXDGQLGNGGFDDHHLPQPLLLPTRCRGRVSLVAGGGAHAIALTSDGELFTWGRGTHGQLGHGNLDSIPHPKFVKFLENHQVTCVSAGWNHSGLATDSGKLFMCGDGSFRQLGTGDNHSRNFPFQVAYFTAKHIEKLALG

SEQ ID NO: 36865 - DNA, 683 bp, Panicum virgatum
  misc_feature: Ceres CLONE 1987286
  misc_feature: Encodes the peptide sequence at SEQ ID NO. 36866
agcggcaccacctccgaagcagcaggagccgtccccgcccccatcaccgaggagagagagagagaggccagccgcagaagcgacgaccgccccacatggccaccaccgcgcccggcggtgggcccctccccgccgccgacgccatggaggtcgacccgccgcgcgcctccgccgacgagaagcacatcgccactgttatggggggaaatgatgcagttacgggacatataatctcgaccacaattgggggaaagaacggtgagccaaaaaggaccattagctatatggctgagcgagttgttggaactggatcatttggggttgtcttccaggcaaaatgcattgagactggtgaaactgttgccattaagaaggttttacaggacaaaagatacaagaatagggagttgcagataatgcgatcgattgaccattgcaatgtcatttccctgaagcactgtttcttctctaccacaagtagagatgaacttttccttaacttagtcatggagtttgttccagagtcactttatcgtgttctgaaacactacaaagacatgaagcagaggatgcccctcatatatgttaaaatgtacatgtaccagatattccggggtttagcttatattcatagtgtaccaggagtttgtcaccgagatattaagcctcagaatattttgggt

SEQ ID NO: 36866 - protein, 195 aa, Panicum virgatum
  misc_feature: Ceres CLONE 1987286
  misc_feature (63)..(195): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50365
  misc_feature: Useful for making plants with modulated biomass
  misc_feature: Functional homolog of the protein sequence given in SEQ ID NO 50366
  misc_feature: Useful for making plants with modulated water use efficiency
MATTAPGGGPLPAADAMEVDPPRASADEKHIATVMGGNDAVTGHIISTTIGGKNGEPKRTISYMAERVVGTGSFGVVFQAKCIETGETVAIKKVLQDKRYKNRELQIMRSIDHCNVISLKHCFFSTTSRDELFLNLVMEFVPESLYRVLKHYKDMKQRMPLIYVKMYMYQIFRGLAYIHSVPGVCHRDIKPQNIL

SEQ ID NO: 36867 - DNA, 676 bp, Panicum virgatum
  misc_feature: Ceres CLONE 1987286-R
  misc_feature: Encodes the peptide sequence at SEQ ID NO. 36868
ctggtgaaagtgctgtggaccagctcgttgagattatcaaggttttgggtactccaacacgggaggaaatccggtgtatgaatcccaattacacagaattcaagtttcctcagataaaagcgtgtccatggcacaagatcttccacaagagaatgcctccagaagcaatagaccttgtttcccgccttctccagtattcaccaaatctgcggtgtaccgctcttgaggtgtgtgctcattcgttctttgacgagttacgagaaccacatgcaaggctcccaaatggacgcccattccctccactgttcaactttaagcaggaactagcaaatgcaccaccggagcttatcagcaagctgttaccagagcatgctcgaaggcaatcaggatttaattctttatttggggctggaccataggaaggatgtaaggaaacgtagctgctggtactgccaaaaggcaatctgcatttcccgcatttgagttttagaacctgaccatcttgttgaaaagttgagccagccttacaaaaaatctaatattgaaacccaagggggctattgtgctcatgttctgccaggaacggcacatattgctggaggggatggttggtgtattgttaagcatggagcatggagggtaacttatttagcttatgttttttttcacgtttcgg

SEQ ID NO: 36868 - protein, 138 aa, Panicum virgatum
  misc_feature: Ceres CLONE 1987286-R
  misc_feature: SWISSPROT Homolog: EC 2.7.11.1 Non-specific serine/threonine protein kinase
  misc_feature: Functional homolog of the protein sequence given in SEQ ID NO 50365
  misc_feature: Useful for making plants with modulated biomass
  misc_feature: Functional homolog of the protein sequence given in SEQ ID NO 50366
  misc_feature: Useful for making plants with modulated water use efficiency
GESAVDQLVEIIKVLGTPTREEIRCMNPNYTEFKFPQIKACPWHKIFHKRMPPEAIDLVSRLLQYSPNLRCTALEVCAHSFFDELREPHARLPNGRPFPPLFNFKQELANAPPELISKLLPEHARRQSGFNSLFGAGP

SEQ ID NO: 36869 - DNA, 722 bp, Panicum virgatum
  misc_feature: Ceres CLONE 1987355
  misc_feature: Encodes the peptide sequence at SEQ ID NO. 36870
acccaccgctcccgtctctccgccgctgccttggcagaagaagaaaccctcatccgcaaacccaatccgggcccggagcagtttcgccgcctccaaccgattccgtcgcgtccctacgaaatccgacccgactcgcaggaaggagcgtgatggccaagaccagctcgttcaagctcgagcacgccctcgagaagaggcaatctgaggctgaccggatcagagagaagtaccctgacagaattcctgtgattgttgagaaggctgagagaagtgatattcctgacatcgacaagaaaaagtacctcgtccctgctgatcttacagttggacagttcgtctacgttgttaggaagagaatcaagctcagtgctgagaaggctatcttcatctttgtgaagaacactcttccaccaacaggtctgtgaaaacaaatacagcaataacatttgcggaactctgatttttcttcacagtcgttggccatatgatctgcattctcacttcattttgcttctctgtttccagctgctctgatgtcttctatctatgaagagaacaaggacgaggacgggttcctctatatgacttacagtggcgagaacaccttcgggctgctctagatggcgccacagctcaccctcaccggggtcggccaccctggcttccctactaatgtctcctgtaaataagacctgccaagcaactgtgtatatccctggttt

SEQ ID NO: 36870 - protein, 91 aa, Panicum virgatum
  misc_feature: Ceres CLONE 1987355
  misc_feature (15)..(90): Pfam Name: MAP1_LC3 Pfam Description: Microtubule associated protein 1A/1B, light chain 3
  misc_feature: Functional homolog of the protein sequence given in SEQ ID NO 50573
  misc_feature: Useful for making plants with modulated nitrogen use efficiency
MAKTSSFKLEHALEKRQSEADRIREKYPDRIPVIVEKAERSDIPDIDKKKYLVPADLTVGQFVYVVRKRIKLSAEKAIFIFVKNTLPPTGL

SEQ ID NO: 36871 - DNA, 610 bp, Panicum virgatum
  misc_feature: Ceres CLONE 1987367
  misc_feature: Encodes the peptide sequence at SEQ ID NO. 36872
aaaaaacaaggggacaggaaaggtctcgcctttgctcgacggcggcggcggcggcggcggcggcgatgtctcttcctccggctccggcggaaggcggcggcggtggaggttccgccggcgacgactggttcctcgactgcggcatcctcgacgacctcccggcagcggcctgcggggccttcccgtgggacgcgtccccgtcgtcctccaaccccagtgtggaagttggcagctacgtaaacactggtgatgtcttcaaggagcctggcagtaataaacgtttaaggtcaggatcttctggtaggccaacatctaaagcttgtagggaaaaaatgagaagggacaagctcaatgacaggtttcttgaattgggctgtaccttggaaccagggaaaccagtaaaagctgacaaagctgctatcctaagtgatgctactcgcatggttattcagcttcgctctgaagcacagcagctcaaggacaccaatggtagtcttgaagaaaagattaaggagctaaaggcagagaaggatgagcttcgtgatgagaagcagaagctgaaactagagaaggagagtttaaaacaccagatgaagcttatgacctccac

SEQ ID NO: 36872 - protein, 181 aa, Panicum virgatum
  misc_feature: Ceres CLONE 1987367
  misc_feature (80)..(131): Pfam Name: HLH Pfam Description: Helix-loop-helix DNA-binding domain
  misc_feature: The sequence is a functional homolog of SEQ ID NO 1203 in the 11/479,226 US patent application
  misc_feature: The sequence is a functional homolog of SEQ ID NO 2422 in the 10/374,780 US patent application
  misc_feature: The sequence is a functional homolog of SEQ ID NO 542 in the 10/412,699 US patent application
  misc_feature: The sequence is a functional homolog of SEQ ID NO 814 in the 10/225,066 US patent application
  misc_feature: Functional homolog of the protein sequence given in SEQ ID NO 51532
  misc_feature: Useful for making plants with altered lignin content
MSLPPAPAEGGGGGGSAGDDWFLDCGILDDLPAAACGAFPWDASPSSSNPSVEVGSYVNTGDVFKEPGSNKRLRSGSSGRPTSKACREKMRRDKLNDRFLELGCTLEPGKPVKADKAAILSDATRMVIQLRSEAQQLKDTNGSLEEKIKELKAEKDELRDEKQKLKLEKESLKHQMKLMTS

SEQ ID NO: 36873 - DNA, 691 bp, Panicum virgatum
  misc_feature: Ceres CLONE 1987393
  misc_feature: Encodes the peptide sequence at SEQ ID NO. 36874
  misc_feature (594)..(594): n is a, c, t, g, unknown, or other
agcagcatccggtcctccatttcttggcttccagaagcatcaagcaagcatctagtagcagctcagcatcgtccatggggtcccgctacgagatggaggtgacggtgggttccgccgccaacctcaagaacgtcaactggcgcaacggcgacctccatccctacgccgtgctctgggtcgacgacggccccaagtgctccacccgcgtcgacctcgacaacggcgaggaccccgtctgggacgagaagctcctgctccccgtccctccgtccgtggcccgcctcgaggacgccgtcctctgcgtcgacgtcgtccacgccgacgccgccgagggcgtcaagccgctcgtcggctccgcgcgcctcccgctccgcgacgtcctcgacgacgccggcatcgggggcaaggtctcgcgcagcctcaggctcaagcgcccctcgggcaggccgcagggccgcctggaggtccgcgtctccgttcgcgaggccgcgccgcgatactacggctacgagtcgtcgtacccggcgccggcctacggcgccggagtaggatcgcgcgacccgtactacgcggcccctccgggtcccggctacngcggccagcagccgtacgccgcgccgccggcgggctacccggcctacggcggttacggagccgccgccgccgctcctccagcgccacgggtggctta

SEQ ID NO: 36874 - protein, 205 aa, Panicum virgatum
  misc_feature: Ceres CLONE 1987393
  misc_feature (7)..(96): Pfam Name: C2 Pfam Description: C2 domain
  misc_feature (174)..(174): Xaa is any aa, unknown, or other
MGSRYEMEVTVGSAANLKNVNWRNGDLHPYAVLWVDDGPKCSTRVDLDNGEDPVWDEKLLLPVPPSVARLEDAVLCVDVVHADAAEGVKPLVGSARLPLRDVLDDAGIGGKVSRSLRLKRPSGRPQGRLEVRVSVREAAPRYYGYESSYPAPAYGAGVGSRDPYYAAPPGPGYXGQQPYAAPPAGYPAYGGYGAAAAAPPAPRVA

SEQ ID NO: 36875 - DNA, 592 bp, Panicum virgatum
  misc_feature: Ceres CLONE 1987394
  misc_feature: Encodes the peptide sequence at SEQ ID NO. 36876
cagcaaacacaccacctcatctcatctcattctcagctagctgctgcagagagagacgtgttagcgacgacgcggatcggaggcagctgcaaccggagcaggaggatttcaaaagttgggagatggaaaccgtcgtgggcgacctcatggccaccgagctcaggctcggcctcccgggcaccgtcgacgagatgaaggccgcggcgccgtcggcgccgtcgacgcctaggggcaagaagcgcaccaccaccgacgccgtggaggacgccgccgccgaagaggccggcaagcgggatgtcgaggcagcacctcctgcagccaaggcccccgtcgtaggttggccgccggtgaggtcgtaccggaagagctgcttccaggcgagcagcaagcagatcagcaaggcgaccaaggaggaggcggcgcccagcagcaacgccgccgcgccatccgcggccgcgaacaccaccaccaccgccggcgccttcgtcaaagtgagcatggacggcgcgccctacctgaggaaggtggacctgaggatgtacaagggctacagggagctccgggaggccctggaggccatgttcgtctcctc

SEQ ID NO: 36876 - protein, 156 aa, Panicum virgatum
  misc_feature: Ceres CLONE 1987394
  misc_feature (7)..(156): Pfam Name: AUX_IAA Pfam Description: AUX/IAA family
METVVGDLMATELRLGLPGTVDEMKAAAPSAPSTPRGKKRTTTDAVEDAAAEEAGKRDVEAAPPAAKAPVVGWPPVRSYRKSCFQASSKQISKATKEEAAPSSNAAAPSAAANTTTTAGAFVKVSMDGAPYLRKVDLRMYKGYRELREALEAMFVS

SEQ ID NO: 36877 - DNA, 1398 bp, Panicum virgatum
  misc_feature: Ceres CLONE 1987395
  misc_feature: Encodes the peptide sequence at SEQ ID NO. 36878
gtcatctccgcgtccacccctgcgttcttcttctccacccggagagccgaacaagccattcagctgacgccgagaggggagaccagcccagaggcccaaagccagaagggcgtccgttggtctagtggtccggagatgtcgaaccccgacgtggaggcgggaggcccggcgcgggcggcgccggcgacgacggggatcaagccgccgccggggcggtacagcatggccggcaacggcaacggcagcgcgccgtacgtggcgccgtcgccgttctactacgacaacgcggcggcgcacgagcggcaccactggtcgtggctggtgccgctggtggtgatcgccaacgtggccatgttcgtcgtggtcatgttcgccaacaactgcccgcgcggcggcggggactgcgtcggtcggggcttcctccgccgcttctccttccagccgctcaaggagaaccccctcctcggcccttccgccgccacgctgcagaagtacggcgccctcgactggtacaaggtcgtgcacgggaaccaggcgtggcggctggagtcgtgcacctggctgcacgccggcctcatccacctgctcgccaacatgatcagcctcatcttcatcggcgtccgcctcgagcagcagttcggattctggaaggtcgggctggtgtacctcgtctcgggcttcggcgggagcgtgctctcggtgctcttcatcaggaagggcgtctccgtcggtgcctccggcgcgctcttcggcctcctcggagcgatgctgtcggagctcatcaccaactggaccatctacaccaacaaatttgcagcgttggcgaacctgatcatcatcgccgccatcaacctggcggtgggcatactcccccacgtcgacaacttcgcccacatcggcggcttcgccaccggcttcctcctcgggttagtgctgctgatccagccgcagttcgggtggctggagcagcccttcggtgccaagtccaagtccaagtacaaggcgtatcagatcatcctcctgcttcttgcacttgtcttgctggctgcagggtttgctgttggattggtcatggtgttcaggggagagaacggcaacgatcactgcagctggtgccactacctcacctgcgtgccgacgtcaagctggaagtgtgacaattgacctgaacagagattagtgacgcgttagcacctcgcgtcttacagatgaagtgagaacatgcgtccccaccattggagacatgctcctcaccttgcatgacattgtcaatatattgctttcaagtttggtttttaaatgctgccttgtgtagaatttcaagcttgtccctttcccattctttgcacatgagatcatcagtaatatttcttgtatatcttaagaactctgtaaatc

SEQ ID NO: 36878 - protein, 342 aa, Panicum virgatum
  misc_feature: Ceres CLONE 1987395
  misc_feature (128)..(272): Pfam Name: Rhomboid Pfam Description: Rhomboid family
  misc_feature: SWISSPROT Homolog: EC 3.4.21.105 Rhomboid protease
  misc_feature: Functional homolog of the protein sequence given in SEQ ID NO 50231
  misc_feature: Useful for making plants with altered cell wall content and/or composition
MSNPDVEAGGPARAAPATTGIKPPPGRYSMAGNGNGSAPYVAPSPFYYDNAAAHERHHWSWLVPLVVIANVAMFVVVMFANNCPRGGGDCVGRGFLRRFSFQPLKENPLLGPSAATLQKYGALDWYKVVHGNQAWRLESCTWLHAGLIHLLANMISLIFIGVRLEQQFGFWKVGLVYLVSGFGGSVLSVLFIRKGVSVGASGALFGLLGAMLSELITNWTIYTNKFAALANLIIIAAINLAVGILPHVDNFAHIGGFATGFLLGLVLLIQPQFGWLEQPFGAKSKSKYKAYQIILLLLALVLLAAGFAVGLVMVFRGENGNDHCSWCHYLTCVPTSSWKCDN

SEQ ID NO: 36879 - DNA, 1256 bp, Panicum virgatum
  misc_feature: Ceres CLONE 1987406
  misc_feature: Encodes the peptide sequence at SEQ ID NO. 36880
acccacccgtagcagagctgttcgactcgccgagtacacaagacgcgactccacgccaagcgcgagccaaaccctacccccagccgcgaccccgatcccccaccacaccggcgatgagctcctcctccaacggcgggaagaagcccgcggccggcggcggccgcgggggggccaccatacgcacgctcgccgacatcaaccgcgggcccgcaggcttcccaggcgccgggggcagcggcagcgactccgacgagccccaggagtactacaccggcggcgagaagagtgggatgcttgttcaagatccgactagaaggaatgacgtggatgcaatctttgaacaagcgaggcagacgggtgctatccaagcaccaccaacccctttccttgatagccagtcatccagctcgaggagctttacagggactggccgactgctttcaggggagacagcaccatctgctgcgcctgcggctgcgtctgcatctcaggaaccagttcacatactccacgtcatacacttatggaacaatggtttcagtgtagatgacggtccactgagagcctatgacgatcctgcaaatgcagaattcattgagagccttaagatgtcccggtgcccccaggaactggagcctgctgacagaagcacaccagttcatgtgaatattatgaaaagacttgaagattaccgggaaccgataaggcctcgttcagctttccagggtgttggaagaacccttggaggttcttctacagatgaaagttcagcacctgctcctgcttcagcggcctctgctgcttcgaggtccaccagcttcgttgtagatgactcccagccatttacatccatacagctgaggctggctgatggcactcgcatggtcgcccggttcaacatgcaccacactgtgggcgacatcagatccttcattgatgcatcccggcctggagctgcgaggccgtatcagctgcagactggcttcccacccaagcagctgaccgacccaacccagactgttgagcaagctggtctggcgaactctgttatcatgcagaagatctaatgcttcagcgagctgggaacccagatgcataatgcgtcttttgaaacttggtatcgtcagagtggttggtaactggcctattgccgtgtcagcctctttgacaacctatcgtgagtttataagttgtcagtgaacatgtatacattcctatttacagcaactactgaagtgccacattgactttttccg

SEQ ID NO: 36880 - protein, 317 aa, Panicum virgatum
  misc_feature: Ceres CLONE 1987406
  misc_feature (135)..(208): Pfam Name: SEP Pfam Description: SEP domain
  misc_feature (239)..(317): Pfam Name: UBX Pfam Description: UBX domain
MSSSSNGGKKPAAGGGRGGATIRTLADINRGPAGFPGAGGSGSDSDEPQEYYTGGEKSGMLVQDPTRRNDVDAIFEQARQTGAIQAPPTPFLDSQSSSSRSFTGTGRLLSGETAPSAAPAAASASQEPVHILHVIHLWNNGFSVDDGPLRAYDDPANAEFIESLKMSRCPQELEPADRSTPVHVNIMKRLEDYREPIRPRSAFQGVGRTLGGSSTDESSAPAPASAASAASRSTSFVVDDSQPFTSIQLRLADGTRMVARFNMHHTVGDIRSFIDASRPGAARPYQLQTGFPPKQLTDPTQTVEQAGLANSVIMQKI

SEQ ID NO: 36881 - DNA, 668 bp, Panicum virgatum
  misc_feature: Ceres CLONE 1987407
  misc_feature: Encodes the peptide sequence at SEQ ID NO. 36882
atgcatcgcatagaacgagctcttacacagtctaaggctctaagcagtcatggcgaagcgctgctgcctacgcctcgccacgctcctggcggcgctgctcccgccggccgccgcctgcctcgacttcggcttctacgacaggacgtgcccctccgccgaggccatcgtgcagcagaccgtcgccgccgcgttcaggaacgactccggcgtcgctccggcgctgatccgcatgcacttccacgactgcttcgtcagaggctgcgacggctcggttctgatcgactcgacgacgaatccgaacaacacggcggagaaggacgcggggcccaacaacccgagcctccggttcttcgacgtgatcgaccgcgccaaggcggccctggaggcgcagtgccccggcgtcgtctcctgcgccgacatcctcgccttcgcggcccgggacagcgtcgcgctcgccggcggcctcggctaccagctgccggccggccgccgcgacggccggatatcccgcgacacggacgcgctcaacgacctgcccccgcccttcttcaacgccacccagctggccgacagcttcgcctccaagaacctcaccgtcgaggacctggtcgtcctctccggcgcccactccctcggcgtctctcactgcagcagcttcgccggcgtcc

SEQ ID NO: 36882 - protein, 206 aa, Panicum virgatum
  misc_feature: Ceres CLONE 1987407
  misc_feature (40)..(206): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50376
  misc_feature: Useful for making plants with altered carbohydrate content
  misc_feature: Functional homolog of the protein sequence given in SEQ ID NO 50564
  misc_feature: Useful for making plants with altered cell wall content and/or composition
  misc_feature: Useful for making plants with modulated phosphate use efficiency
MAKRCCLRLATLLAALLPPAAACLDFGFYDRTCPSAEAIVQQTVAAAFRNDSGVAPALIRMHFHDCFVRGCDGSVLIDSTTNPNNTAEKDAGPNNPSLRFFDVIDRAKAALEAQCPGVVSCADILAFAARDSVALAGGLGYQLPAGRRDGRISRDTDALNDLPPPFFNATQLADSFASKNLTVEDLVVLSGAHSLGVSHCSSFAGV

SEQ ID NO: 36883 - DNA, 1234 bp, Panicum virgatum
  misc_feature: Ceres CLONE 1987409
  misc_feature: Encodes the peptide sequence at SEQ ID NO. 36884
aagtaacagccaactctctctcctccagagtccggactacggacgggagccccgacatcgacgcatcccctgcttctctccgagtccatccatccccggccgccccctcccttgccgcgaaaccctagccccgccccgccccgcccgtatgtcggctgtttgatcggcccagcagtccgacccacctctgcccttggccccccatctgatgttcctctcccgcatcgtcctgcgcgacctggactccatcgactccccggcctccatggcgtcctcgaagaaggtggtgacccgcgacgagtgggagcggaagctccgcgacgtcaagatccgcaaggaggacatgaaccgcctcgtcatgaacttcctcgtcaccgagggcttcgttgacgccgccgacaagttccgcatcgagtccggcacccagccggagattgacctagcgaccatcacggaccggatggaggttaagaaagcagtacaatcggggaatgttcaggaggccatcgagaaaatcaacgatcttaatcccacgattctggacacgaatccccaactatactttcatcttcagcaacagaaactaatagagttgattcgcgcgggaaaaataagtgaagctttggagtttgctcaggaagagctcgcaccaagaggcgaagaaaatcaaacatttcttgaggaaatagagaaaaccgtagcactactcgtttttgaagatgtcaaaaattgcccttatggcgaactgttggacgtttctcaacgtttgaagactgcaagtgaagttaatgctgctattcttacaagtcaaagtcacgagaaagatccgaaacttccaagcctgttaaagatgttgctttggactcaaaatcaactagatgaaaaggcggcatatccacgaatcaatgacttgaccactgcagagctgcaagatccatcgatatgaatatgctgccgaggatgtaacggaggtaggcaccacgcctgcttggtgcctccacacgttattccctggatctgtcaataggtcatcgcctgcagcgattgagggcacttctttcttcagtgtttgagctcaatgcaagcagttggccagaaaacttcacctgtgctgtacctgtacatgatgtagaagacattttttcgtcgccttccagtcagtggaaaattattgaatttgatttttcaaacttgttacttgcaaacacatgtgttcaattgaattttaggccgg

SEQ ID NO: 36884 - protein, 226 aa, Panicum virgatum
  misc_feature: Ceres CLONE 1987409
  misc_feature (25)..(51): Pfam Name: LisH Pfam Description: LisH
MASSKKVVTRDEWERKLRDVKIRKEDMNRLVMNFLVTEGFVDAADKFRIESGTQPEIDLATITDRMEVKKAVQSGNVQEAIEKINDLNPTILDTNPQLYFHLQQQKLIELIRAGKISEALEFAQEELAPRGEENQTFLEEIEKTVALLVFEDVKNCPYGELLDVSQRLKTASEVNAAILTSQSHEKDPKLPSLLKMLLWTQNQLDEKAAYPRINDLTTAELQDPSI

SEQ ID NO: 36885 - DNA, 656 bp, Panicum virgatum
  misc_feature: Ceres CLONE 1987421
  misc_feature: Encodes the peptide sequence at SEQ ID NO. 36886
ggccattaaccagctccatcagctctgctgcctggaggtgtgctagtatctgttcaacgagcaagcgtgtggccatggcgatgttcaccagagccttgcaattggctctcagggagaagaggagcaggatcattgggccaggatcgccgtcagtcttcctcgcaaattccttctcatcctcggctccgagctcccagagtccgcagaggtgatgtacacagtagtgctctgttttcctacatcggagatggatgcatggaggtgaagtgtcatgtggaattattggtggcctgtaggctggccgggaaagtcgccgtcatcaccggtggcgcgagcggcatcggcaaggcgaccgccgccgagttcgtcaggaacggcgccaaggtggtgatcgccgacatccaggacgacctgggccacgccgtggccgcggagctcggcggcccgggcgcggcatgctacacccgctgcgacgtggccgacgaggcgcaggtcgcggcggccgtggacctcgcggtcgcccgccacgggcacctcgacgtcatgttcaaccacgccggcatcgggggcgccacggggacgccgccgccgctgggcgccgtggacctcgccgacttcgaccgcgtgatggcgggtcacgcccggggcgtgctggc

SEQ ID NO: 36886 - protein, 133 aa, Panicum virgatum
  misc_feature: Ceres CLONE 1987421
  misc_feature (18)..(133): Pfam Name: adh_short Pfam Description: short chain dehydrogenase
  misc_feature: SWISSPROT Homolog: EC 1.1.1.14 L-iditol 2-dehydrogenase
  misc_feature: Functional homolog of the protein sequence given in SEQ ID NO 50917
  misc_feature: Useful for making plants with modulated biomass
MEVKCHVELLVACRLAGKVAVITGGASGIGKATAAEFVRNGAKVVIADIQDDLGHAVAAELGGPGAACYTRCDVADEAQVAAAVDLAVARHGHLDVMFNHAGIGGATGTPPPLGAVDLADFDRVMAGHARGVL

SEQ ID NO: 36887 - DNA, 1054 bp, Panicum virgatum
  misc_feature: Ceres CLONE 1987431
  misc_feature: Encodes the peptide sequence at SEQ ID NO. 36888
gcgtgagctccaatggcgggtgctcgtggcgggaagtttagtagggctaagaggaggcggacgcgtgcggggtgcggcgtgcatggaggccaagtcgggggaagcgagtgctgggcctgcgcctatggcggcagcggcaccggcagcggcggcaccagtagtaacggcggcaccggaggcgacggtgagcttccagccgccggcgccgtcagcggcggtggagaagggtagctcgagcggcgtgctggtgtcgcctcctgctacggggccgccgggggcggcgggagcgggcggcgcgctggcgctgcgcccggtggcgatgaaggtgccgaagaagcgcgggaggccgcgcaagtacgggccggacgggagcctgatccggccgctcaacgccacgccgatctcggcgtcggcgcccatggcggcggccgtggcggcggggcagtacacgcccgcctcggcggtcggcgccgccatgaagcgcgggagggggcggcccctcgacttcgccgccgcagcgggcaagcagcaccagctccaccaccaccagtcgccgttcggcttccacttcgactcgatcggtggcatggtagcttgctctgctggtgcaaatttcaccccacatataattactgtcgccgctggtgaggatgtgacaatgaaggttatatcgttttcgcaacaaggaccacgggctatctgtattctctccgcaaacggcgtgatatcaaatgttactctccgtcagcctgattcgtctggtggcacattgacctatgagggacgcttcgagttgctgtccttgtctggctcctttatgccaactgaaaatagcggaacacgaagtcgatctggtgggatgagcgtgtctcttgccagcccagatggtcgtgtcgtgggcggtggagttgccggcctcctggtggcagcaagtcctgtccagattgtcgtggggagcttcctgccaagctatcagatggagcaaaagaacaagaagccgcgggtggacccggcagcctccctcccccagacacctcctgccattccaaatctc

SEQ ID NO: 36888 - protein, 323 aa, Panicum virgatum
  misc_feature: Ceres CLONE 1987431
  misc_feature: The sequence is a functional homolog of SEQ ID NO 374 in the 10/374,780 US patent application
  misc_feature: The sequence is a functional homolog of SEQ ID NO 604 in the 10/225,066 US patent application
MEAKSGEASAGPAPMAAAAPAAAAPVVTAAPEATVSFQPPAPSAAVEKGSSSGVLVSPPATGPPGAAGAGGALALRPVAMKVPKKRGRPRKYGPDGSLIRPLNATPISASAPMAAAVAAGQYTPASAVGAAMKRGRGRPLDFAAAAGKQHQLHHHQSPFGFHFDSIGGMVACSAGANFTPHIITVAAGEDVTMKVISFSQQGPRAICILSANGVISNVTLRQPDSSGGTLTYEGRFELLSLSGSFMPTENSGTRSRSGGMSVSLASPDGRVVGGGVAGLLVAASPVQIVVGSFLPSYQMEQKNKKPRVDPAASLPQTPPAIPN

SEQ ID NO: 36889 - DNA, 131 bp, Panicum virgatum
  misc_feature: Ceres CLONE 1987431-R
cccagccaacacccgaggcggcccggacgccggcgggcgaccagaagacgacagccccaggacccggaaccggaaacccagcaaggagccacaccgacagggggagcggagcacggaagcggcacccgccg

SEQ ID NO: 36890 - DNA, 1177 bp, Panicum virgatum
  misc_feature: Ceres CLONE 1987446
  misc_feature: Encodes the peptide sequence at SEQ ID NO. 36891
agatcgctggctggctagctactggtagagaaggcgaagcgaagcgaagccgaagcaacgtcggtcggagaggagaggagaggagagagtggctagctagagagagaaacgcctctcgcgcgcgtacgtcacgtgagagcccgagagagggaggcagggagctctccgtccgatccgaggtgctgccttcttgtacaggcgcggcttcttccggtggacgacgaccgacgacgacgaaggcggggctatagctgaggagaattgggcggcgcgcgggcagctggcgtccatggcgaggcggcgcggcgattgacgggcgacgattatgggcatccaagggaacagggcggcgacgcaggagcacgacttcctctcgctgtacaccgccgccgcagctagtaaggacgctcctctccagctccatcagctccacgactccaagccacatcctccctctcgaggtggtaatttcttcctgaagacgcacgacttcctgcagcctctggagaagccgggagcgccgccggagctgcccgccgccgcctccggcgccgaaagcaggcatcgccacccgcaggtgcccgccgccgccgccacctccaagcagcacgcgctgcccctgcccggcggcgtcggcacgttccgcatctgccccgcacccgtctcggtcgcgccgccggcgaccgccgccgtcgtcaaggcggagccgccgctcgtgctctggggccagcccgcggcggcgctccaccagccgaccgcgcgagggcaccagcagcagtgggcgctccccttcgccggcgccgggcagcccaggccgcccccgccgccgcaggataggaaggggcgcggcggaagagccgcggtcatggagtccggttccagatccagcggcggcgcggggttcgacgacgacgacggcctcgccgcgcgccgcgaggtctcctcctcgctccaagagttgacagtaagggtggacaggaagggtggaagctgcagcgatggtggtacagatcagcggccaaacacaccacggtcaaaacactcagccacagagcagcgccgacgcagcaaaatcaatgataggtttcagatacttagggagctgttgccacacaatgatcaaaagagagataaagcaacatttctcttggagggtattgaatacatacggtttttg

SEQ ID NO: 36891 - protein, 283 aa, Panicum virgatum
  misc_feature: Ceres CLONE 1987446
  misc_feature (235)..(283): Pfam Name: HLH Pfam Description: Helix-loop-helix DNA-binding domain
MGIQGNRAATQEHDFLSLYTAAAASKDAPLQLHQLHDSKPHPPSRGGNFFLKTHDFLQPLEKPGAPPELPAAASGAESRHRHPQVPAAAATSKQHALPLPGGVGTFRICPAPVSVAPPATAAVVKAEPPLVLWGQPAAALHQPTARGHQQQWALPFAGAGQPRPPPPPQDRKGRGGRAAVMESGSRSSGGAGFDDDDGLAARREVSSSLQELTVRVDRKGGSCSDGGTDQRPNTPRSKHSATEQRRRSKINDRFQILRELLPHNDQKRDKATFLLEGIEYIRF

SEQ ID NO: 36892 - DNA, 694 bp, Panicum virgatum
  misc_feature: Ceres CLONE 1987446-R
agctcgatgataatcacaacatggtgacatctgctgcatcaggggcacagaatcagactgaaaatgatcacatggctagcgtgtgctacagatcagctgaaactccggcaattattacaaataatgctttatctcagtcccaaccccaatggacagatccgtcccctgtggatgattgtgcagtgaacagtcaaatggttaacaaccagcagttggcaatcgatgaaggaacaatcagtgtatccagtcaatattcccaagagttacttaattcgttgactcatgcccttcaaagctcaggtgtggatttgtcccaagccagcatctctgtgcagatcaacctgggcaagcgagcagtcaagagacctgctgctggtttaccctccaaggaaccaacggacccagcatctagcgacgaaataggtcagcagctggcaatgttgggtggcggcgctgaagacctctctcatgcagcaaagcggcataaaccgggcaacagctgatgatggtccccgcctcgctcccggacccgattgatcattctttccttcccagccaaccagccaacgggaggctcttttggattggttgtacatttgtgctagctgtgaaaggctccgtgatgaacgaggcccccgctgcattctttcatttgatcgctcccgccgtcctctttagtccattgttcacttag

SEQ ID NO: 36893 - DNA, 725 bp, Panicum virgatum
  misc_feature: Ceres CLONE 1987448
  misc_feature: Encodes the peptide sequence at SEQ ID NO. 36894
  misc_feature (653)..(653): n is a, c, t, g, unknown, or other
caagttatacgtacaattcattgatgacctcattcgtcaagaaaggttatttgaaacaggtgtgggcaattcttcatgagaggggtgggcagctctgccctaatgatgtagcgacatataatctgatcattcaaggtcttggccagatggggaaaacagaggttgccagcacaattattgaccgtttgtcaaagaaaggtgtttacatggacattgtcatgtataacactctgatcaatcagttgggaaaggttgggaaggttgaagaagcaggctccttgtttgatcagataatcagaagcggcatgaagccagatgttgtcacttttaatactttgatcaatataaatgcaaaagctggtagactaaaggaagctgacaagtatttaaggaggatgatcacagaaggcattgcaccaaaccacgccacagaaacaatattgattttccttgataaggaaattgaaaagaaaaggcagcacaaatgaactaggaaaacaatacaaacgaaaacagcatcatcaactctattacttgtattaaccattccaaggcatgtccttgtttatccaaactgaaaagctgcagtgaaatcattattactgtaaagctgaatattcagcaataagcaattagagtgatgatcactttcngtaagctcacagacatttctgcttttatcatataggaagatgctctgtgtattgttggtttagagatgttgc

SEQ ID NO: 36894 - protein, 161 aa, Panicum virgatum
  misc_feature: Ceres CLONE 1987448
  misc_feature (72)..(106): Pfam Name: PPR Pfam Description: PPR repeat
  misc_feature (107)..(141): Pfam Name: PPR Pfam Description: PPR repeat
  misc_feature (37)..(71): Pfam Name: PPR Pfam Description: PPR repeat
SYTYNSLMTSFVKKGYLKQVWAILHERGGQLCPNDVATYNLIIQGLGQMGKTEVASTIIDRLSKKGVYMDIVMYNTLINQLGKVGKVEEAGSLFDQIIRSGMKPDVVTFNTLININAKAGRLKEADKYLRRMITEGIAPNHATETILIFLDKEIEKKRQHK

SEQ ID NO: 36895 - DNA, 656 bp, Panicum virgatum
  misc_feature: Ceres CLONE 1987462
  misc_feature: Encodes the peptide sequence at SEQ ID NO. 36896
aaatagatgaccattccaaagctcccagttcgtcatcttgacaggccaccgaaacaaaattctctctataggcgggagagagagagagagagagcggtcgcagccgccggccatggcggaggcggcgggagcccaagccccggcgcatggccccgaggaggcgcccctcgacgcgggcgccatcaggaggaaaactgccctgatgttagcactgtgcagattcctacgtgataaatacagtcttgctgcggtcacaaacgacattttcacaaaagaagatggggaattcttagtcaagcatggagcactcccagaagagcgcatacgtgcagtggaaactggagggtgccctcatgcagctatacgtgaagacatcagtataaatcttggtcctctagaggagctatcgaacttgtacaaagctgatctggctgtaatggaacgagatgcgcttcgcatgcgggaaggagggccttttgtgtttgcacaggtgaaacacggagtgggtgtggaggatatcgtgaatcatattctgcaagcgtgggaaattgcaaccgggaataaacgccgataaaagatctcatgacatagctttatatttggcgtgcagctgatgcactttatcattcagcatgcataaaccatccattggtttt

SEQ ID NO: 36896 - protein, 153 aa, Panicum virgatum
  misc_feature: Ceres CLONE 1987462
  misc_feature (27)..(124): Pfam Name: cobW Pfam Description: CobW/HypB/UreG, nucleotide-binding domain
MAEAAGAQAPAHGPEEAPLDAGAIRRKTALMLALCRFLRDKYSLAAVTNDIFTKEDGEFLVKHGALPEERIRAVETGGCPHAAIREDISINLGPLEELSNLYKADLAVMERDALRMREGGPFVFAQVKHGVGVEDIVNHILQAWEIATGNKRR

SEQ ID NO: 36897 - DNA, 1230 bp, Panicum virgatum
  misc_feature: Ceres CLONE 1987464
  misc_feature: Encodes the peptide sequence at SEQ ID NO. 36898
agagccgtcgacgagccatggtgtcatggtgaggcttggcgccggcgaatagtttccggtgcggaagaaggcaactacagctcaggcaagcgctggcgtccacaagacgaacaagggctccggatcctcccatccaccgccgccgccgctgccgccgtgacggatgcggccggagggagctgcggcggccggggacgtgacggtggaggaaaccgacgccctcgactgcggcgtgtgcttcctcccgctgaagcccccaatcttccagtgcaacatggggcatgtcgtctgttcagcatgccgtgacaagctcaaggccaccggcaagtgttatgtgtgtgggatcaacactggaggctacagccggtgccacgccatggagcgccttgtggagtccatccacttcccgtgcccgaatgccatccatggctgcaccgccagaactacctattatgaccagcatttccactgccagacgtgcccgcacaggccgtgccactgccccagcgagacatgtggctttgttggctcaacggcggcgctcctggaccacttcaacagggcacacggctggccatgcaccaccaaggtcaaggctgccaccatgaactacaaggatgacgatgattacgaattcaagatccaactccatgatggtttcaattttatcctcgctgactgtgccactgctgacagcaagcaagggacaggcctgtatctgttcctgctgaatgtggtgaggcaacagcttggatgcaccatcactgtcctctgcatccatcctcagcatgatgaaaccagccatggttgtggactgtcacccttaaaggaaatacaatgcgagctcagttactcacgtcatgtgtacatcaagagccgccatggtagtgataagttaatcaaacattaccaggaatccatgttcgaagtagaatgcacagatctctcaaatggactgcccaaccctgatgagtgctttcagtttgtggtgccaaagtctgttcttgcaggaggcaacacgatcgaggttggtggccgaattgtcatcagttggtccatgcatgtagcataaatcctattcagtgttggtaatcaattaggagttgtttggctctgtcactaatcacctctagtttcgttcctgattgtgcatgtatgcatgtaagacctgatcgtaggtcaagttacatggcagtgacaaagcgtagcatgttttggttggctctctcc

SEQ ID NO: 36898 - protein, 302 aa, Panicum virgatum
  misc_feature: Ceres CLONE 1987464
  misc_feature (67)..(235): Pfam Name: Sina Pfam Description: Seven in absentia protein family
MRPEGAAAAGDVTVEETDALDCGVCFLPLKPPIFQCNMGHVVCSACRDKLKATGKCYVCGINTGGYSRCHAMERLVESIHFPCPNAIHGCTARTTYYDQHFHCQTCPHRPCHCPSETCGFVGSTAALLDHFNRAHGWPCTTKVKAATMNYKDDDDYEFKIQLHDGFNFILADCATADSKQGTGLYLFLLNVVRQQLGCTITVLCIHPQHDETSHGCGLSPLKEIQCELSYSRHVYIKSRHGSDKLIKHYQESMFEVECTDLSNGLPNPDECFQFVVPKSVLAGGNTIEVGGRIVISWSMHVA

SEQ ID NO: 36899 - DNA, 1669 bp, Panicum virgatum
  misc_feature: Ceres CLONE 1987474
  misc_feature: Encodes the peptide sequence at SEQ ID NO. 36900
ggggggcgctcgtcttgctaaacacgaagaagcgccgctctcccccagcttcccccaaaccccaaccatggcagccgccgtcgaccccgccgccgaccaaaaccctaagcctagggacgccgatccccacgtgcccgccgccgaagtggagcccgagttcgcggctgcacaggctcgacgtcttcgatgccgtcaagatcacgctcgacgcggggccgcccgagctgcccggcaccaccaacgtcgtcatcgaggtcgtcgaggccgccaatcccctcaccggtaacgccggcgtctactcgaagcccgaggcaagatcttggtcgttggaagggtcacttaagttgaagaatttgttcggctatggtgacatcttggatgcatcaggttcctatggttgggaccaaactacagaggttggagttggagtctacctaccaaggtttaaatcagtaccaacaccattgatggcccgggcatctttgtcatcacaagattggctgaagttttcatcatacaaggagcgtctacttggcctttcatttggtttgatttcaaccatgaaccatgacttgtcttacaaccttacatggcgtgccttaactgatccgtcgcatgcttcatcaaaggcgataaggaggcagttagggcataatcttctttctgcactgaagtacacatacaagatcgatcagagggattcacttctcaggccaacaaaaggatacgcatttcagtcaacttctcaagttggtggtctatgggataacaaggggttgaaattttttcggcaggagtttgatgtccgtggcgctgtgcctttgggattttataatgctgctctaaatgttggcgtaggagcgggtgtcattttaccacttggacgggggttcatgaattcgtcttcacctgtgcctgataggtttttccttggaggtcattcttctccagtttgcagcttgagtgggctgtcatccctgctgggttttagaacaagaggagttggccccacagaagcacggaggcttgtacccagtgaatcagacagtgactctgctgtcgctccaggaagggattacttgggaggtgatctggctgtgtctgcctttgctgacctttcttttgatctgcctctcaagttattcagagacgctggaatccacggtcatgcgtttctcactgctgggaaccttgcgaagttgtcggagggtgagtacaagaatttctcagtttctgaatttcagcgcacattcaggagctctgctggtgttggcattattttgcccactaaactattccgggtggaggtgaactattgttacattctaaagcaagctgagcatgacagtggaaagaccggaatccagttcagcttctcgtcacccatgtagaaacctgccgtgaaatgttttgcagccgaaatagcttctctttcccctgttagacttgtgttcgtccattgttcttgtcttactgaagcgattgcaaaacgattgtagtcgcatatcatcggcttttcttttgacgctcgtagtttggcgtgaggagcttgagcctagatttgctcattcttttttgtatctgtgaagttacttccctattctgacacgaaggatttgcccttcacaactcagatactgcagtggtggataaaataaaattttgggcc

SEQ ID NO: 36900 - protein, 462 aa, Panicum virgatum
  misc_feature: Ceres CLONE 1987474
  misc_feature (117)..(462): Pfam Name: Bac_surface_Ag Pfam Description: Surface antigen
GALVLLNTKKRRSPPASPKPQPWQPPSTPPPTKTLSLGTPIPTCPPPKWSPSSRLHRLDVFDAVKITLDAGPPELPGTTNVVIEVVEAANPLTGNAGVYSKPEARSWSLEGSLKLKNLFGYGDILDASGSYGWDQTTEVGVGVYLPRFKSVPTPLMARASLSSQDWLKFSSYKERLLGLSFGLISTMNHDLSYNLTWRALTDPSHASSKAIRRQLGHNLLSALKYTYKIDQRDSLLRPTKGYAFQSTSQVGGLWDNKGLKFFRQEFDVRGAVPLGFYNAALNVGVGAGVILPLGRGFMNSSSPVPDRFFLGGHSSPVCSLSGLSSLLGFRTRGVGPTEARRLVPSESDSDSAVAPGRDYLGGDLAVSAFADLSFDLPLKLFRDAGIHGHAFLTAGNLAKLSEGEYKNFSVSEFQRTFRSSAGVGIILPTKLFRVEVNYCYILKQAEHDSGKTGIQFSFSSPM

SEQ ID NO: 36901 - DNA, 1323 bp, Panicum virgatum
  misc_feature: Ceres CLONE 1987477
  misc_feature: Encodes the peptide sequence at SEQ ID NO. 36902
aatcactccatagattaccaactcgcatgcccactctcgccatcccttcatctctcctgctcacccgccgcctcctcgccgccaggaccaggacgttctccacctcctcctccgccggctactccaccaccatcgtcaagatggcgcggtcggcgctggacgaggtcaccgataccggcgccttcgaccggtcgccgtccaccttccggagctccgtgtccagcgacgcctccgccaggttccccgccgtgccggggcggtaccacctctatgtctcctacgcgtgcccctgggcgtcccggtgcctcgccttcctcaagctcaagggcctggaccacgtcatcggcgtctcggccgtgaagcccatctttgagaggaccaaggagactgacgaccatctcgggtgggtgttccccaccactgccgacgaggaacccggcgccgagccggaccccttcaacagtgctaagagtatcagggagctctacgagattgccagcccgaactacgccgggaagccaagcgtccccgtcctctgggataagcagctcaagacggtggtgaacaacgagagctccgagatcatccggatgttcaacaccgagttcaatgacatcgctaggaacccagggctggacctctatccagttcaactccgggcatccattgacgagatcaatgagctggtctacgacgccataaacaatggcgtgtacaagtgtggctttgccaagaagcaggggccatatgacgaggctgtgacaagattatatgaggctcttgacaaatgcgaggagattctgggcaagcaacggtatatatgtggcaaccagctgacggaggctgatattcgcctatttgtgacccttatacgatttgatgaggtttacactgttcacttcaaatgcaacaagaagctcctgagggaatacccaaacctgttcaactacaccaaggacatctaccagatccctggcatcaacagcacggtgaacatggaccacatcaagaagcactactacggaagccacccatctataaacccctacgggattatcccggcgggccccaacatcgactacaatgccccccatgacagggagaggtttggctcgtgagggatcttgtactgtgctgtgttgtgcttgagaatcttttgcttggttgtgtcaaaggctgaattgttaataacgtctctctctctctctctccctccctctctctctcttcggaacgttttggtttcttgtttaagcgtgagtcggaacttgtaataccggtagattcatgttaataaatcaactggaaggctttctttttttt

SEQ ID NO: 36902 - protein, 325 aa, Panicum virgatum
  misc_feature: Ceres CLONE 1987477
  misc_feature (183)..(278): Pfam Name: GST_C Pfam Description: Glutathione S-transferase, C-terminal domain
  misc_feature: SWISSPROT Homolog: EC 2.5.1.18 Glutathione transferase
MARSALDEVTDTGAFDRSPSTFRSSVSSDASARFPAVPGRYHLYVSYACPWASRCLAFLKLKGLDHVIGVSAVKPIFERTKETDDHLGWVFPTTADEEPGAEPDPFNSAKSIRELYEIASPNYAGKPSVPVLWDKQLKTVVNNESSEIIRMFNTEFNDIARNPGLDLYPVQLRASIDEINELVYDAINNGVYKCGFAKKQGPYDEAVTRLYEALDKCEEILGKQRYICGNQLTEADIRLFVTLIRFDEVYTVHFKCNKKLLREYPNLFNYTKDIYQIPGINSTVNMDHIKKHYYGSHPSINPYGIIPAGPNIDYNAPHDRERFGS

SEQ ID NO: 36903 - DNA, 1125 bp, Panicum virgatum
  misc_feature: Ceres CLONE 1987492
  misc_feature: Encodes the peptide sequence at SEQ ID NO. 36904
accggcaccgataagctctcttcttcagccttggcactcgagttcttgtgccatcaacagaccacacaaacaattacaccttagccatcagcttcatcaatcacttggaatactagctatccgccttccggttctgcttcatccttctccaaaatctcatggctccgtctatctcccttggcaagatttcgctcccgaggcagcagcagcgccgcctcctccaacctctcaactctccaaagcacaagcgcgtcgccgccacaccaccagctgggttgctccaagagttgttcggggatgctcaggcagctcagcctccgaagccaagacgcccgtctgacgagactctggccgtccatgctggggagaagctcgggaagggcgcgggcgaggacgccatggactcgatcgcgacaccaattgtgagcggcacaacgcactggttcaagagctccgaggacctcatcgcgttcaaggaaggccggcgccacagccacgagtacggccggtacagcaacccgacggtgaaggtcctggaggacaagatcagcgcgctggagagagccgaggcgacgctagtcacgtcgtcaggcatgaacgccatcgtggcaacgctgctcgcgctcgttccgccgggcggccatgtagtaacgaccactgactgctacagcgaggcgcgcgccttcatcggcgataggctctccaagatgggcatcaggtccacatttatcgacctcgacgacatggagtcgctaaaggccgtcgttgaccagaatgatgtgactctcttctacgccgactccccaacaaacccactgctcaagtgtgtggacatcaggctggttgcggagctgtgccaccagaagggtgccttggtgtgcatcgacagcacgctcgcgtcgcccatcaaccagaagcccctcaccctcggcgccgacatcgtcctgcactccgctacaaagtacatggccggtcaccatgatgtcattgccggatgcgttagcagctcggaggcactcatctccaaaatacgggcatggcactacgaccttggcggcgctatcagtccggtacgtgtgcatctcaacatgaggatcattgaatataatcccgttgattttcctc

SEQ ID NO: 36904 - protein, 322 aa, Panicum virgatum
  misc_feature: Ceres CLONE 1987492
  misc_feature (62)..(315): Pfam Name: Cys_Met_Meta_PP Pfam Description: Cys/Met metabolism PLP-dependent enzyme
  misc_feature: SWISSPROT Homolog: EC 2.5.1.48 Cystathionine gamma-synthase
MAPSISLGKISLPRQQQRRLLQPLNSPKHKRVAATPPAGLLQELFGDAQAAQPPKPRRPSDETLAVHAGEKLGKGAGEDAMDSIATPIVSGTTHWFKSSEDLIAFKEGRRHSHEYGRYSNPTVKVLEDKISALERAEATLVTSSGMNAIVATLLALVPPGGHVVTTTDCYSEARAFIGDRLSKMGIRSTFIDLDDMESLKAVVDQNDVTLFYADSPTNPLLKCVDIRLVAELCHQKGALVCIDSTLASPINQKPLTLGADIVLHSATKYMAGHHDVIAGCVSSSEALISKIRAWHYDLGGAISPVRVHLNMRIIEYNPVDFP

SEQ ID NO: 36905 - DNA, 1261 bp, Panicum virgatum
  misc_feature: Ceres CLONE 1987493
  misc_feature: Encodes the peptide sequence at SEQ ID NO. 36906
aatacaaacaaccaaacagcgcccacgagttaggggattccggattcgccgccgcccggccgcgttttggttccccttcctcgccggctcgccgccggtcaccgccgccatgggaatcaagggcttgacgaagctgctggcggagcacgcttcgagggccgcggtgcagcggagggtggaggactaccgcggccgcgtcatcgccgtcgacgccagcctcagcatctaccagttcctcattgtggttggaaggaaagggtcagagcttctgaccaatgagtctagtgaagtcacgagtcatctgcagggtatgttgaaccggacagtaagaatgctagaagcagggataaagcctgtttttgtttttgatggcgagccacctgaaatgaagaaaaaggagcttgcaaaaaggtccttaaagaggaatgatgctacaaaagatcttaatagagctattgagattggggatgaggatttagttgaaaaatttagcaaaagaactgtcaaggtcacaaaaaagcacaatgatgattgtaagaggctgttaagattgatgggtgtccctgtagttgaggcaccasgtgwkkctgaagcacagtgtgcagctctttgtgaaaatcaccaggtctatgctgtagcttcagaggacatggactctctgacttttggtgctcgaaggtttcttcgtcacttaactgaccttggttataagaaatctcctgtgacagaatttgaagtgtcaaaggttttggaggaacttggactctcaatggatcagttcattgacttgtgtatccttagtggatgtgattactgcgagaatattaaaggtattgggggacaaagagccctgaaactcattcgacagcatggttgcattgaagaagttgtgcaaaatcttaaacagacgagattcaatgttccagaagactggccttaccaggaagttcggacattgtttaaagaacctaatgtttgtacagaaattccagatttcatgtggacctcgcctgactcacagggccttatggatttcttgtcaactgaaaacagtttcagtcctgatagggtagcaaaggcggtagaaaagattactgttgcaagggataaatattccccaagaagattgaagcttttgacaccagtttctagcttaccgggatcttatactgagaaggaacccacatgcatactaggctctccaggacaaggtctgaagatcaggtctgccccacaagtgtgcaatagttcaagttctggc

SEQ ID NO: 36906 - protein, 383 aa, Panicum virgatum
  misc_feature: Ceres CLONE 1987493
  misc_feature (1)..(108): Pfam Name: XPG_N Pfam Description: XPG N-terminal domain
  misc_feature (147)..(238): Pfam Name: XPG_I Pfam Description: XPG I-region
  misc_feature: SWISSPROT Homolog: EC 2.7.7.7 DNA-directed DNA polymerase
  misc_feature (158)..(158): Xaa is any aa, unknown, or other
  misc_feature (159)..(159): Xaa is any aa, unknown, or other
  misc_feature (160)..(160): Xaa is any aa, unknown, or other
MGIKGLTKLLAEHASRAAVQRRVEDYRGRVIAVDASLSIYQFLIVVGRKGSELLTNESSEVTSHLQGMLNRTVRMLEAGIKPVFVFDGEPPEMKKKELAKRSLKRNDATKDLNRAIEIGDEDLVEKFSKRTVKVTKKHNDDCKRLLRLMGVPVVEAPXXXEAQCAALCENHQVYAVASEDMDSLTFGARRFLRHLTDLGYKKSPVTEFEVSKVLEELGLSMDQFIDLCILSGCDYCENIKGIGGQRALKLIRQHGCIEEVVQNLKQTRFNVPEDWPYQEVRTLFKEPNVCTEIPDFMWTSPDSQGLMDFLSTENSFSPDRVAKAVEKITVARDKYSPRRLKLLTPVSSLPGSYTEKEPTCILGSPGQGLKIRSAPQVCNSSSS

SEQ ID NO: 36907 - DNA, 626 bp, Panicum virgatum
  misc_feature: Ceres CLONE 1987509
  misc_feature: Encodes the peptide sequence at SEQ ID NO. 36908
ctgcaacgacctctcctccgtcctcactcccactctcgacctctctacaatggcgagaaggtgcaggagcagcggcggcggcaacgtgccgggcttggcggccatggcggcggcttcatggctcctggtggcggtggcgctcgccggcatcgccgacgcccagctgcaggtggggttctactccaggtcctgcccgggcgccgagtccaccgtcgcggacgtcgtccggcaggccggctccgccgaccccaccatcctgccggcgctcctccgcctccagttccacgactgcttcgtccggggctgcgacggctccgtcctcatcaagggcggcggtggcggcagcgccgaggtggacaacagcaagcaccagggcctccgcgggctcgagatcatcgagggcgccaagacgcagctcgaggcccagtgccccggcgtcgtctcctgcgccgacatcgtcgtcctcgccgcccgcgacgccgtcgcattcaccggcgggccgtccttcgacgtgccgacggggcggcgcgacgggaaggtgtcgaacctgcgggacgcggacgcgctgccggacgtgcgcgacggcatcggcgcgctccgctccaagttccgcgccaacgggctgg

SEQ ID NO: 36908 - protein, 192 aa, Panicum virgatum
  misc_feature: Ceres CLONE 1987509
  misc_feature (55)..(191): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50956
  misc_feature: Useful for making plants with altered cell wall content and/or composition
  misc_feature: Functional homolog of the protein sequence given in SEQ ID NO 50563
  misc_feature: Useful for making plants with altered carbohydrate content
MARRCRSSGGGNVPGLAAMAAASWLLVAVALAGIADAQLQVGFYSRSCPGAESTVADVVRQAGSADPTILPALLRLQFHDCFVRGCDGSVLIKGGGGGSAEVDNSKHQGLRGLEIIEGAKTQLEAQCPGVVSCADIVVLAARDAVAFTGGPSFDVPTGRRDGKVSNLRDADALPDVRDGIGALRSKFRANGL

SEQ ID NO: 36909 - DNA, 677 bp, Panicum virgatum
  misc_feature: Ceres CLONE 1987531
  misc_feature: Encodes the peptide sequence at SEQ ID NO. 36910
atggtaagtcctctccctttctcacctcctcaaatcatggacctccccacctatctgctcctcctaacctctgatctatctcgaactccccggctcttccatttactcaccgatttcgcgattttatttattttttgaaatgttttgctgatttttcccgtgcacgagttggctgcagccgcagggagaccacatagagctgcaccagaagcgccatgggcggcgtctggactacgaggagcgcaagcgcaagcgcgaggcgcgcgaggtgcacaagcgctcgaaggatgcacggaagttgcttggtgctaaggggaagaggtttgccaagaagcaatatgctgagaaagcgcagatgaagaagaccctgaaaatgcatgatgaatcaacttcgcggcagaaggctgatgatgatgtccaagagggtgctcttcctccgtatctgcttgatcgtgatcagacacagcgtgccaaggttcttagcaacacgatcaagcaaaaaaggaaggaaaaggcaggaaaatgggatgttcccttgccaaaggtcagaccagtagctgaagaagagatgtttaaggttctgcgaactggcaagcgaaaaaccaagcagtggaagagaatggttactaaagccacctttgttggacctggatttacaaggaagcccccaaagtatg

SEQ ID NO: 36910 - protein, 107 aa, Panicum virgatum
  misc_feature: Ceres CLONE 1987531
  misc_feature (1)..(107): Pfam Name: Ribosomal_S8e Pfam Description: Ribosomal protein S8e
MKKTLKMHDESTSRQKADDDVQEGALPPYLLDRDQTQRAKVLSNTIKQKRKEKAGKWDVPLPKVRPVAEEEMFKVLRTGKRKTKQWKRMVTKATFVGPGFTRKPPKY

SEQ ID NO: 36911 - DNA, 681 bp, Panicum virgatum
  misc_feature: Ceres CLONE 1987534
  misc_feature: Encodes the peptide sequence at SEQ ID NO. 36912
catatacatctagaaagccgtatgctttggaagaagcttgtacagtttgggaaggggttttttgagaaaaaagaagaatctacttcaaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggagtatggaaaattgcatttttggaatttgcaataatgcgatgggcgaacgacgggaattgaacccgcgcatggtggattcacaatccactgccttgatccacttggctacatccgccccttatccagctaaaggattttctcttttttt

SEQ ID NO: 36912 - protein, 172 aa, Panicum virgatum
  misc_feature: Ceres CLONE 1987534
  misc_feature (30)..(150): Pfam Name: Ribosomal_L2_C Pfam Description: Ribosomal Proteins L2, C-terminal domain
HIHLESRMLWKKLVQFGKGFFEKKEESTSTDMPLGTAIHNIEITRGRGGQLARAAGAVAKLIAKEGKLATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 36913 - DNA, 747 bp, Panicum virgatum
  misc_feature: Ceres CLONE 1987554
  misc_feature: Encodes the peptide sequence at SEQ ID NO. 36914
ccttaaaaccctaatcaagctcaatcgacagcgccaaccccatcacccacccccacgcctcggcctctcgcgcgccgccacaatgcaggccgccgccgccgtccgccacccgcacctcctcgcgccgtgcgccggccgcccccgccgccggcccagcactgtccgcatggcgctgcgcgaggacgggccctccgtggccatcgtgggcgccacgggcgcggtcggccaggagttcctccgcgtcatcacggaccgggacttcccctaccgcagcctccgcctcctggccagcgagcgctccgcggggaagcgcctcgccttcgaggaccgcgagtacaccgtccaggacctcgccgcgccgggggccttcgacggcgtcgacatcgcgctcttcagcgccgccgggggcgtcagccgcaagtacgggcccgcggccatcgccagcggcgccgtcgtcgtggacaacagctccgcgttccggatggaccccgaggtgccgctcgttatccccgaggtcaacccggaggccatggccaacgtccggctggggcagggcgcgattgtggcgaatccgaattgctcgaccatcatctgcctcatggcggccaccccgctccatcaccacgccaaggtgttaaggatggttgtcagcacttaccaagctgcaagtggtgctggtgctgcagcaatgggagaacttaaactgcagactaaggaggtcttggaaggggaaggcacccacattgc

SEQ ID NO: 36914 - protein, 221 aa, Panicum virgatum
  misc_feature: Ceres CLONE 1987554
  misc_feature (37)..(153): Pfam Name: Semialdhyde_dh Pfam Description: Semialdehyde dehydrogenase, NAD binding domain
  misc_feature: SWISSPROT Homolog: EC 1.2.1.11 Aspartate-semialdehyde dehydrogenase
MQAAAAVRHPHLLAPCAGRPRRRPSTVRMALREDGPSVAIVGATGAVGQEFLRVITDRDFPYRSLRLLASERSAGKRLAFEDREYTVQDLAAPGAFDGVDIALFSAAGGVSRKYGPAAIASGAVVVDNSSAFRMDPEVPLVIPEVNPEAMANVRLGQGAIVANPNCSTIICLMAATPLHHHAKVLRMVVSTYQAASGAGAAAMGELKLQTKEVLEGEGTHI

SEQ ID NO: 36915 - DNA, 690 bp, Panicum virgatum
  misc_feature: Ceres CLONE 1987557
  misc_feature: Encodes the peptide sequence at SEQ ID NO. 36916
accagggcggctgccactctcgatcctcgcctcctcctcctctcccaccaaccgcagcagccgcgccaccaaccagagcagtctcgagacagagaatggccgccgcgccgtcgtacctcgcgtccccacgcctcccccgcctcgcggcggcggcggccactcctgctgccccgcagcagctccgcctcggctgctcccgccgccgcgcgcagcgggtcgtcgccatggctggatccggcaagttcttcgtggggggcaactggaagtgcaatggaacaaaggactccattagcaagcttgtctctgaattgaatgctgctatactcgaaagcgatgtagatgttgtggtggcacctccattcatttatattgaccaggtcaagagttcactaactgatcgcattgaggtatctgctcagaatgtttggatcggaaaaggaggtgcctacactggagagatcagtgcagaccaattggtggacatcggctgcaaatgggttattcttgggcactctgagcgtagacatattattggtgaaaatgacgagtttatcgtgaagaaggctgcatatgcattgagccaaaatgttaagcttattgcatgcataggagagctgttggaagagaggggagcgggaaaaacttttgatgtttgttttgagcagatgaaggcttatgccgataatgtca

SEQ ID NO: 36916 - protein, 198 aa, Panicum virgatum
  misc_feature: Ceres CLONE 1987557
  misc_feature (50)..(198): Pfam Name: TIM Pfam Description: Triosephosphate isomerase
  misc_feature: SWISSPROT Homolog: EC 5.3.1.1 Triose-phosphate isomerase
  misc_feature: Functional homolog of the protein sequence given in SEQ ID NO 50215
  misc_feature: Useful for making plants with modulated biomass
MAAAPSYLASPRLPRLAAAAATPAAPQQLRLGCSRRRAQRVVAMAGSGKFFVGGNWKCNGTKDSISKLVSELNAAILESDVDVVVAPPFIYIDQVKSSLTDRIEVSAQNVWIGKGGAYTGEISADQLVDIGCKWVILGHSERRHIIGENDEFIVKKAAYALSQNVKLIACIGELLEERGAGKTFDVCFEQMKAYADNV

SEQ ID NO: 36917 - DNA, 563 bp, Panicum virgatum
  misc_feature: Ceres CLONE 1987558
  misc_feature: Encodes the peptide sequence at SEQ ID NO. 36918
actgcatctctccttcaggttcagccatagcagcactacgtgcaggcgcggcagcgaggaagcaggcactggaaggaacgccatgaaggagttctcgtacgaggaggtggcggcggccacgggcggattcgcggccaagaacctcgtggggaagggcagccacggcagcgtatacaaggccaggctgcggggaggcggcagcaggacggccaccgtcgccgtcaagcggccgtcgcacgcgcagggggaggccaagctcgcgaacgagatcgccgtgctttccgccgcgccgcgccacccgggcgtcgtcgccttcgtcggggtcgtcgtggcccggccggcgccggcggctgcggatgcgggggtgaagagggcggtggcggcgcctccgactccgccgccgctactcgtcatggagtatgtgcccaacgggtcgctccacgacctgctgcaccgggcgccgcggccgccgccgtggccgcggcgcgtcgagatcgcgctcgacgtggcgcgcgccgtgcaagcgctgcaacgccgcggcgccgcgcgtcatcctccaccgc

SEQ ID NO: 36918 - protein, 160 aa, Panicum virgatum
  misc_feature: Ceres CLONE 1987558
  misc_feature (16)..(160): Pfam Name: Pkinase_Tyr Pfam Description: Protein tyrosine kinase
  misc_feature: SWISSPROT Homolog: EC 2.7.11.1 Non-specific serine/threonine protein kinase
MKEFSYEEVAAATGGFAAKNLVGKGSHGSVYKARLRGGGSRTATVAVKRPSHAQGEAKLANEIAVLSAAPRHPGVVAFVGVVVARPAPAAADAGVKRAVAAPPTPPPLLVMEYVPNGSLHDLLHRAPRPPPWPRRVEIALDVARAVQALQRRGAARHPPP

SEQ ID NO: 36919 - DNA, 1160 bp, Panicum virgatum
  misc_feature: Ceres CLONE 1987561
  misc_feature: Encodes the peptide sequence at SEQ ID NO. 36920
atctccctggcacgccccccgctgggcgtgcgcccgactagcccaaccgaccgcgcggcaccgaccaccccggcacggagccaaagggagacccaacaagaaagcggtgggagctgagaaaacaggggaaaaaaacccccaaacccgcatccgcacccgcgtccgcgtgctcagctccgcccttcccatccggcacccgctccctgtcctctcctgcaccgcccgttcccgccgccgccgccggcacaagtgagggaccaggcaggcagcccgcccccgtgccgccgaagccgcggagcagcgcgcgattccgggggccgaccgtccgtcccaggcggcgatggcgtaccgggcggaggacgactacgactacctcttcaaggtggtgctcatcggggactccggcgtcggcaagtccaacctgctctcccgcttcacgcgcaacgagttcagcctcgagtccaagtccaccatcggggtcgagttcgccacccgcagcatccacgtcgaggacaaggtcgtcaaggcccagatctgggacaccgccggccaggaaaggtaccgagctatcacaagtgcatactaccgtggagcagtaggggcactagttgtctatgacgtgacacgccatgtcacctttgagaacgtggagaggtggatgagggagctcaaggaccacacggacgccaacatcgtgatcatgctcgtcgggaacaaggcggacctgcgccaccttagggctgtctcgacggaggatgcaaaggccttcgccgagagagagaatgccttcttcatggagacgtcagccctggaggcgatgaatgtggaggatgccttcaccgaggtgctcacacagatctaccgcgtggtaagcaagaaggctcttgacatcggcgatgaccctgcggcgcctcccaagggccagaccatcaatgttggcggcaaggatgatgtgtcggcggtgaagaagtctgcttgttgttcgtcttagcttgaaaggatagaacatgtacttgggttggtcaatacattttgcagtagcgggcacaggaagttatggcagtgatggtcctcaatctgtattcttgtgttaacaggtgcctcgtgttcatttgccattttatacattaattcattcaggactttcagattgctggtat

SEQ ID NO: 36920 - protein, 216 aa, Panicum virgatum
  misc_feature: Ceres CLONE 1987561
  misc_feature (14)..(175): Pfam Name: Ras Pfam Description: Ras family
  misc_feature (14)..(128): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50162
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
MAYRAEDDYDYLFKVVLIGDSGVGKSNLLSRFTRNEFSLESKSTIGVEFATRSIHVEDKVVKAQIWDTAGQERYRAITSAYYRGAVGALVVYDVTRHVTFENVERWMRELKDHTDANIVIMLVGNKADLRHLRAVSTEDAKAFAERENAFFMETSALEAMNVEDAFTEVLTQIYRVVSKKALDIGDDPAAPPKGQTINVGGKDDVSAVKKSACCSS

SEQ ID NO: 36921 - DNA, 587 bp, Panicum virgatum
  misc_feature: Ceres CLONE 1987584
  misc_feature: Encodes the peptide sequence at SEQ ID NO. 36922
attcgccgtgcgcctgctgcctcctcccgctgctccgctagcacctccgccgcgaggcccacgcgcgcgatggcgaccatcaccacgcacctccgctccgcgctcctcgcccctggcggcgggcgccgctcgcgccgccgcgcgccctcctccgtgcgcgtgcgctgcgacgcctccccgccgtcctcctcctcctccgcggccccggccgcctcgctcgacccggacttcgacaagaaggccttccgccacaacctcacccgcagcgacaactacaaccgcaagggcttcggccacaagaaggagacgctcgagctcatgagccaggagtacaccagtgatgtgatcaagacgctcaaggagaatgggaaccagcacacctggggccccgtcaccgtgaagctggcggaggcatacggcttctgctggggcgtcgagcgcgccgtgcagatcgcctacgaggcgcgcaagcacttccccgaggagcgcatctggctcaccaacgaaatcatccacaaccccaccgtcaacaagaggttggatgagatgggcgtagaaatcattcctggtgacgcgagcatcaagga

SEQ ID NO: 36922 - protein, 172 aa, Panicum virgatum
  misc_feature: Ceres CLONE 1987584
  misc_feature: SWISSPROT Homolog: EC 1.17.1.2 4-hydroxy-3-methylbut-2-enyl diphosphate reductase
  misc_feature: Functional homolog of the protein sequence given in SEQ ID NO 50777
  misc_feature: Useful for making plants with modulated nitrogen use efficiency
MATITTHLRSALLAPGGGRRSRRRAPSSVRVRCDASPPSSSSSAAPAASLDPDFDKKAFRHNLTRSDNYNRKGFGHKKETLELMSQEYTSDVIKTLKENGNQHTWGPVTVKLAEAYGFCWGVERAVQIAYEARKHFPEERIWLTNEIIHNPTVNKRLDEMGVEIIPGDASIK

SEQ ID NO: 36923 - DNA, 630 bp, Panicum virgatum
  misc_feature: Ceres CLONE 1987594
  misc_feature: Encodes the peptide sequence at SEQ ID NO. 36924
aacgccagtcaccatctccaccgtaccggaaggcgaaggcccggcgtggatccagcgatggcggcgagacctcccacaacggaggtggagctgctgagcaccaacaagatgttcggcggccataacctccgctaccgccaccagagcgccaccctcggctgccccatgaccttcaccgtctacctgcccccgtccccggcgtccaatgtccccgtgctgtactggctctcgggcctcacctgcactgacgagaacttcattattaaggccggcgctcagcgcgcggccgccgcccacggcatcgccctcgtcgcgcccgacacctctccacgcggattaaatattgaaggagagtcagacagctatgattttggtgtcggtgctgggttttatttgaacgccacaaatgaaaaatggaaaaactggcgcatgtatgactatgttgtgaaagatcttccaaaagttttgagtgatcactttgaacagctcaacatttcacaagcatccatttctgggcactctatgggaggccatggtgcactgataatttacttgaaaaacactgataaatacaagtcagtatcagcgtttgctccaattgtcaatccgataaactgcccgtggggtcag

SEQ ID NO: 36924 - protein, 190 aa, Panicum virgatum
  misc_feature: Ceres CLONE 1987594
  misc_feature (22)..(189): Pfam Name: Esterase Pfam Description: Putative esterase
  misc_feature: SWISSPROT Homolog: EC 3.1.2.12 S-formylglutathione hydrolase
  misc_feature: Functional homolog of the protein sequence given in SEQ ID NO 50203
  misc_feature: Useful for making plants with altered cell wall content and/or composition
  misc_feature: Useful for making plants with modulated biomass
MAARPPTTEVELLSTNKMFGGHNLRYRHQSATLGCPMTFTVYLPPSPASNVPVLYWLSGLTCTDENFIIKAGAQRAAAAHGIALVAPDTSPRGLNIEGESDSYDFGVGAGFYLNATNEKWKNWRMYDYVVKDLPKVLSDHFEQLNISQASISGHSMGGHGALIIYLKNTDKYKSVSAFAPIVNPINCPWG

SEQ ID NO: 36925 - DNA, 730 bp, Panicum virgatum
  misc_feature: Ceres CLONE 1987596
  misc_feature: Encodes the peptide sequence at SEQ ID NO. 36926
aacggcgacgcggacgcaccgtcacagggctgcgcaatccctttctccctcttcttcttatcccaaaggcaagagccgcgtctccgagagtccagagggtgaggaggaggagagaggagggcgcgtcctgctgtggtccttgttcgttgctccccctccgctttccgtgatgtcgtcaccgagcaagcgccgcgagatggacctaatgaagctgtgaggatcttggagctctaattcgtctttcgatttccccttgatgggttccgtttgtttgtttgtttgttgtgatctggcctttcttgggggggcgttcttggcttctcggcgccgcaggatgatgagcgactacaaggtggagatggtgaacgacgggatgcaggaattcttcgtcgaattcaaggggccgaccgaaagtatctatcaaggtggtgtttggaaggttagggtggaattgcctgatgcgtacccttacaaatccccttccattggcttcatcaacaagatttatcacccgaatgttgatgaaatgtctggttccgtctgtttggatgtcataaaccagacatggagcccaatgtttgatctggtaaatgtttttgaagtgttccttccacagcttttactgtatccgaatccttctgatccattaaatggggaggctgctgcattgatgatgcgtgaccgccctgcgtatgaacaaaaagtgaaagaatactctgaaaagtatgca

SEQ ID NO: 36926 - protein, 157 aa, Panicum virgatum
  misc_feature: Ceres CLONE 1987596
  misc_feature (26)..(154): Pfam Name: UQ_con Pfam Description: Ubiquitin-conjugating enzyme
  misc_feature: SWISSPROT Homolog: EC 6.3.2.19 Ubiquitin--protein ligase
MGSVCLFVCCDLAFLGGAFLASRRRRMMSDYKVEMVNDGMQEFFVEFKGPTESIYQGGVWKVRVELPDAYPYKSPSIGFINKIYHPNVDEMSGSVCLDVINQTWSPMFDLVNVFEVFLPQLLLYPNPSDPLNGEAAALMMRDRPAYEQKVKEYSEKY

SEQ ID NO: 36927 - DNA, 694 bp, Panicum virgatum
  misc_feature: Ceres CLONE 1987629
  misc_feature: Encodes the peptide sequence at SEQ ID NO. 36928
aacccaccaactaacctcatcccgaccccgagccgccgccggaggaatcgcccgccatggcgccgccgcccgccaccgccaccgccgcggcggccgccgccgtccggacgcacctgctcctccgccgcggcggggtcctcctcctcccctcgccgccgtgcgccgccacgcttcccttcgcctcgcggcgcctccgcctcccgccgccgcggttctcgctctcgcccgtcccgaagagcctctccgccgcctcccacgtccccgtacggtctctattcaccggcatcgtcgaggaggtcggccgcgtgcgccgcctcggcccgccgctcgcgccgtccggcggcggcggcggcggcggcggcggcgaggctcccggcctggacctggaggtcgagacgaagagcctcctcgccgggacgcagctcggggacagcgtcgcggtcgacggcacctgcctcaccgtggcggcgatcgacccggccgcgtccacgctcaccttcggcgtcgcgccggagacgctccggcggacgtcgctgggcgagcgcgccccgggcgacggcgtcaacctcgagcgcgcgctcacgccgtcgtcccggatgggcgggcacttcgtgcagggccacgtcgacgggaccggcgagatcgccgcgttccggcccgacggggactcgctctgggtcaccgtgcgcgcgcc

SEQ ID NO: 36928 - protein, 212 aa, Panicum virgatum
  misc_feature: Ceres CLONE 1987629
  misc_feature (75)..(174): Pfam Name: Lum_binding Pfam Description: Lumazine binding domain
  misc_feature: SWISSPROT Homolog: EC 2.5.1.9 Riboflavin synthase
MAPPPATATAAAAAAVRTHLLLRRGGVLLLPSPPCAATLPFASRRLRLPPPRFSLSPVPKSLSAASHVPVRSLFTGIVEEVGRVRRLGPPLAPSGGGGGGGGGEAPGLDLEVETKSLLAGTQLGDSVAVDGTCLTVAAIDPAASTLTFGVAPETLRRTSLGERAPGDGVNLERALTPSSRMGGHFVQGHVDGTGEIAAFRPDGDSLWVTVRA

SEQ ID NO: 36929 - DNA, 145 bp, Panicum virgatum
  misc_feature: Ceres CLONE 1987653
  misc_feature: Encodes the peptide sequence at SEQ ID NO. 36930
atttcacacctcccccaccaagacggccgagatgtggagctccgactccgaccccgacctcggcgccgccgccgcctcgtcgtcctcctcctcgtccgccacctccgcctccccgccgccggcctccctcccgcgccgcccgcgc

SEQ ID NO: 36930 - protein, 37 aa, Panicum virgatum
  misc_feature: Ceres CLONE 1987653
  misc_feature: The sequence is a functional homolog of SEQ ID NO 1036 in the 10/374,780 US patent application
  misc_feature: The sequence is a functional homolog of SEQ ID NO 846 in the 10/666,642 US patent application
MWSSDSDPDLGAAAASSSSSSSATSASPPPASLPRRP

SEQ ID NO: 36931 - DNA, 1317 bp, Panicum virgatum
  misc_feature: Ceres CLONE 1987659
  misc_feature: Encodes the peptide sequence at SEQ ID NO. 36932
  misc_feature (1197)..(1197): n is a, c, t, g, unknown, or other
tgacggtacagggggacgggaggggagaggactagggggcaagtgaggagtcgccaggaagcaaccgcgaggaaggaggcagcagcagctgcagcaacgagcaccggcagcactgcagcagcgcggagagagagaaaaaattcctgttggctccgtgagctttgggtgctcgcgtgcccgagcttcgcctccgatcgccgcgctacgggggtgcgccggatggagccgtacgcggctgcgaaggagggaggcaggggcggcgacgccagcaccggcttggaagagccgatgcggaggctggggctcggcggggacggggaggcgggggacgcgaagctgccggagcggccgggcgaggcggactgcgcctactacctccgcaccggcgcctgcggctacggggagcgctgccgctacaaccacccccgcgaccgcgatcgggccaccccggttaatggagttggaaggaccgcaggtgcggttgagtaccctgagcgaccgggacagccactgtgtgagttatgtgtgggaactccggttacaattctcttgcttcctcagtactatgcaaagaatgggacctgtaaatttggttccaattgcaagtttgatcatcccagggaaggtggttttgcacctgtggcattaaacagcagtgggttccctcttcgtcagggtgaaaaggaatgttcctattacatgaaaactgggcattgcaagtttggaggtacatgtaaattccatcacccagaacttggtattctctcagagacacctaccatctatccaccagtgcaaccatcacctgtttcctccccgcatccatatccacatcttgccaattggcaaatggggaggcctcctgttgtgccagggtcatttttaccaggctcgtatccaccaatgatgcttccacctacacttatgccaatgcagggatggaacccttatatctcacctatgaaccaagttgcaccagctgggggtcagcaaactgttcaaacagggccaccttatggtttgtcacaccaggggcctacctctgcagtcacttatggtagtcattatgcgcaattgtattcctcggctgggacttcaagcaccaacatacaagaatatgccttaccagagcggcctgggcagcctgaatgtgagcattacatgaagacaggagcctgtaaatttggagcagcctgncaataccatcatcctcaatacttcagtggtccgaaatctaattgtgcgctgagccctctgggtcttccacttcggcctggttctcagccttgtacttactatgcacagcatggcttttgc

SEQ ID NO: 36932 - protein, 365 aa, Panicum virgatum
  misc_feature: Ceres CLONE 1987659
  misc_feature (44)..(70): Pfam Name: zf-CCCH Pfam Description: Zinc finger C-x8-C-x5-C-x3-H type (and similar)
  misc_feature (152)..(178): Pfam Name: zf-CCCH Pfam Description: Zinc finger C-x8-C-x5-C-x3-H type (and similar)
  misc_feature (306)..(332): Pfam Name: zf-CCCH Pfam Description: Zinc finger C-x8-C-x5-C-x3-H type (and similar)
  misc_feature (114)..(134): Pfam Name: zf-CCCH Pfam Description: Zinc finger C-x8-C-x5-C-x3-H type (and similar)
  misc_feature (326)..(326): Xaa is any aa, unknown, or other
MEPYAAAKEGGRGGDASTGLEEPMRRLGLGGDGEAGDAKLPERPGEADCAYYLRTGACGYGERCRYNHPRDRDRATPVNGVGRTAGAVEYPERPGQPLCELCVGTPVTILLLPQYYAKNGTCKFGSNCKFDHPREGGFAPVALNSSGFPLRQGEKECSYYMKTGHCKFGGTCKFHHPELGILSETPTIYPPVQPSPVSSPHPYPHLANWQMGRPPVVPGSFLPGSYPPMMLPPTLMPMQGWNPYISPMNQVAPAGGQQTVQTGPPYGLSHQGPTSAVTYGSHYAQLYSSAGTSSTNIQEYALPERPGQPECEHYMKTGACKFGAAXQYHHPQYFSGPKSNCALSPLGLPLRPGSQPCTYYAQHGF

SEQ ID NO: 36933 - DNA, 741 bp, Panicum virgatum
  misc_feature: Ceres CLONE 1987659-R
catcacttactgaatgtgccagtcactccatatactctcagtttccctgttactcctatggctccatatttgtcatcttctgatctgcagccacagtacactctaaccaaggagcactctgctaatccacctgcagtgcctggaactacttatggacctgttgggacaatatcaaaggtttatgccccacacacacttatccgacccctgaatgccgcagctgctggcatgcaagcgtcctaaggagacagcatggagagctccagtcccctttatgtcttgaagatgtatctttcagcaagcttctctgcactttccgccataggtgaaatgaggtctcggattctttttgctccaattcgactccccatcgattgtgaataaaggctgcagctgacataggaataaatgcaaagataggaattggcaagctcattcccttgccatttttctgtccgtctctgaaacgagagaagggagagacttctgattgtagttcagagctccgttattatctcgtacataattaaccgagcaggccagtaactgttggaggggacgtataatctggaagctaatgagttccgcagccctttcccaaatcttcttttgtttatcccatcatctatatatatatatgtatatcccccagaacagtaactatgacttctgcaatatgtatatgcgaactgggaacactggagacattataacgagacactcagaaccattaacagagtc

SEQ ID NO: 36934 - DNA, 679 bp, Panicum virgatum
  misc_feature: Ceres CLONE 1987669
  misc_feature: Encodes the peptide sequence at SEQ ID NO. 36935
gatcgcgagccgtgctgtcccagcctcacaggtagcctcaagcctctcctcccctcctcttcagcttgttctccgcggcggcggcggcggcggcgtggagcggagccggagggagaagatggtggcggcgatcagggtgcccaagaccaagcgcgccaggcgggagctcctcaagcacgcgcccaagctcgttgagaccggcaaaaagacgctggtcctccatggtaccaagactagtgctgtgttgaactctgtgttgtcagatatttaccacctgaagcgtgataatgctgtgaagttcaccaagaagaatgacagcattagaccttttgaaagtggtggagaatcttctttggagtttttctccctcaagacagactgcagccttatagtgtatggttctcattccaaaaagagacccaacaatctgattttgggaaggacgtatgaccaccacatatatgaccttgttgaagtaggagttgagaactacaaatcgatggaatcttatgtttatgataagaagctggcaccgaaacttggatcaaagcctttctttgccttcataggagaacattttgagagctcggaagacctgaagcatttgaaagaagtgctgcttgatcttttcagaggagaggttgtagagaatctaaaccttgcgggtgtagatcggatc

SEQ ID NO: 36935 - protein, 186 aa, Panicum virgatum
  misc_feature: Ceres CLONE 1987669
  misc_feature (32)..(184): Pfam Name: Brix Pfam Description: Brix domain
  misc_feature: Functional homolog of the protein sequence given in SEQ ID NO 51048
  misc_feature: Useful for making plants with modulated biomass
MVAAIRVPKTKRARRELLKHAPKLVETGKKTLVLHGTKTSAVLNSVLSDIYHLKRDNAVKFTKKNDSIRPFESGGESSLEFFSLKTDCSLIVYGSHSKKRPNNLILGRTYDHHIYDLVEVGVENYKSMESYVYDKKLAPKLGSKPFFAFIGEHFESSEDLKHLKEVLLDLFRGEVVENLNLAGVDR

SEQ ID NO: 36936 - DNA, 655 bp, Panicum virgatum
  misc_feature: Ceres CLONE 1987686
  misc_feature: Encodes the peptide sequence at SEQ ID NO. 36937
aaaaaaaaaaaaaaatctccgctgcgccgccatagcataaatcctccgccctctctccctccgtaaacccctctctctctctcttcctcggccggcctgctcctgcgatccgtgctgcagatcgccagatcagtcgacatggcgctcgtattgcattctggacctggtaacaagaatgccttcaaggcacttattgctgcagaatacagtggggttaagattgagttgacaaagaattttgagatgggtgtcaccaacaagacccctgagtttcttaagatgaacccccttgggaaggtgcctgttctggagactcctgaaggtgctgtttttgagagcaatgctattgcacgctatgttgctcgcttgaatgatggcaaccctctttttgggtcttctcgtattgaacaagcccatgttgagcagtggatggactttgctgcaacagaagttgatcctggtgttgcatggtacttgtacccaaggcttggttacattccttattctcagacgacagaggaaacagctattgcctcattgaagagagcgcttggttctctgaacacccaccttgcctcaaagacattccttgtagggcattctgtcactctagctgacattgtattgacatgcaacctctaccatggatttgcac

SEQ ID NO: 36937 - protein, 172 aa, Panicum virgatum
  misc_feature: Ceres CLONE 1987686
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
MALVLHSGPGNKNAFKALIAAEYSGVKIELTKNFEMGVTNKTPEFLKMNPLGKVPVLETPEGAVFESNAIARYVARLNDGNPLFGSSRIEQAHVEQWMDFAATEVDPGVAWYLYPRLGYIPYSQTTEETAIASLKRALGSLNTHLASKTFLVGHSVTLADIVLTCNLYHGFA

SEQ ID NO: 36938 - DNA, 694 bp, Panicum virgatum
  misc_feature: Ceres CLONE 1987694
  misc_feature: Encodes the peptide sequence at SEQ ID NO. 36939
aacacacgacacgacgcgacgccaagcgcaagccaaaccctacccccagccgcgaccccgacccccccacctcaccggcgatgagctcctcctccaacggcgggaagaagccggcgaccggcggcggccgcgggggtcccaccatccgcacgctcgccgacatcaaccgcgggcccgcaggcttccccggccccgggggcagcggcagcgactccgacgagccccaggagtactacaccggcggcgagaagagtgggatgcttgttcaagatccgactaaaaggaatgatgtagacgcaatctttgaacaagccaggcagacgggtgctatccaagcaccaccccctttccttgataatcagtcctccagctcgaggagctttacagggaccggccgactgctttcaggggagacagcaccatctgctgcgcctgcggatgcgtctgcatctcaggaaccagttcacatactccacgtcatacacttgtgggacaatggtttcagtgtagatgacggtccactgagagcctatgatgatcctgaaaatgcagaattcattgagagccttaagatgtcccgatgcccccaggaactggagcctgctgacagaagcacaccagttcatgtgaatgttatgaaaagactttgagattacccgggtaagttctccacccttcattcatctatgggctt

SEQ ID NO: 36939 - protein, 189 aa, Panicum virgatum
  misc_feature: Ceres CLONE 1987694
  misc_feature (134)..(188): Pfam Name: SEP Pfam Description: SEP domain
MSSSSNGGKKPATGGGRGGPTIRTLADINRGPAGFPGPGGSGSDSDEPQEYYTGGEKSGMLVQDPTKRNDVDAIFEQARQTGAIQAPPPFLDNQSSSSRSFTGTGRLLSGETAPSAAPADASASQEPVHILHVIHLWDNGFSVDDGPLRAYDDPENAEFIESLKMSRCPQELEPADRSTPVHVNVMKRL

SEQ ID NO: 36940 - DNA, 1195 bp, Panicum virgatum
  misc_feature: Ceres CLONE 1987699
  misc_feature: Encodes the peptide sequence at SEQ ID NO. 36941
aggtcgcgtgcattcttgagtgctgagctgttggggatcgccccgcgccgccgagcgcaagcaacacactacccgtcggcggccgtcggagtccaccaggtggtggatccttccccgacccccgccgcggcagccgcttcacctgaagaaggcacggcggtgctggtcgccgcttcccctggggaacgagctcctgcggagtttggtcaggatatgggaggtgggagctgcagcgtctgcaaggaggcgccgtcaaagtacaactgcccctcctgccgcacgccctactgctctgtcacatgctttaaaaagcacaaagaggaatcatgccaaaagacattggttcaggaagaaattagcaagtcaccactgcaggaggaagctacacagagctctgggttggtggaagatggaacaaagtgtcccaatgacaaggatcaacatcccactttatcaccaaacaccacatgccctgcaaaatctccaaatacagtatgccctataaaagcccttgaagttgaggacccaagctggcttgttgacaacaatagactaaggtctttagtggaggtgaaagatatccgagatgctctaagggatcctgaactgcagaaaatgatacttaaaattgacgggtcttcagaaccagaaaaggaattggagaaagtggtggaaggtcaagcttttcgccagttcaccgataagattctcgacattttcagtccacaagaatgatcgcctatcctgtttggtggaactctgatgctggagaaaatagaggcatccaggcaaacaagggaaaacggagcacctcatctctgttttccatttccaggatggggttccctggtctatggaatttatgcttactgcaaaatatctgagttaccaaagaaatttcctagttggtagcatcctacatttcggttcagcgacctgtccaagctctatgttagtgtagtatagacagcgactctatactgactctggagaggatgctgggaagaaaaatagtgggtggatgcttccactgaccaccgtatctccttcatgctctttgacagatgcgagctaagttgagcgatcaatgcctgcgagaattcttgccgtaatctttgctttcgaccttttgttttctgagaatcttgttttcaccctggcatcgttttatggaggagccattgctctagggttt

SEQ ID NO: 36941 - protein, 173 aa, Panicum virgatum
  misc_feature: Ceres CLONE 1987699
  misc_feature (2)..(32): Pfam Name: zf-HIT Pfam Description: HIT zinc finger
MGGGSCSVCKEAPSKYNCPSCRTPYCSVTCFKKHKEESCQKTLVQEEISKSPLQEEATQSSGLVEDGTKCPNDKDQHPTLSPNTTCPAKSPNTVCPIKALEVEDPSWLVDNNRLRSLVEVKDIRDALRDPELQKMILKIDGSSEPEKELEKVVEGQAFRQFTDKILDIFSPQE

SEQ ID NO: 36942 - DNA, 611 bp, Panicum virgatum
  misc_feature: Ceres CLONE 1987704
  misc_feature: Encodes the peptide sequence at SEQ ID NO. 36943
attgttgccatcacctgccgctaactggccgggcgcctgcccgcagcagtagtcgtcaagaaactgatcgctcagctcgctcgtcccggccaagggcacaacggtcgggccggcgcctgaggcaggatcgaagacgtcgccgtctcggtccacccgccgatcgatatggggcgcgaggcggcggcggcggcgaggcccaagctgcggaggggcctctggtcgccggaggaggacgagaagctctacaaccacatcatccggtacggcgtcggctgctggagctcagtcccaaagctcgcaggcttggagagatgcggcaagagctgcagactgagatggatcaactacctgaggcctgatctcaagaggggcagcttctctcagcaggaggaggacctcatcatcagcctccacaagatcctaggcaacaggtggtcccagatcgcgtcacagctgcccggccggacggacaacgagatcaagaacttctggaactcgtgcatcaagaagaagctccggcagcggggcatcgacccggccacccacaagccgctcgaggacgacgccgccgccgccgccgccgccgccgccgccaacagcggggaggcgcc

SEQ ID NO: 36943 - protein, 148 aa, Panicum virgatum
  misc_feature: Ceres CLONE 1987704
  misc_feature (15)..(62): Pfam Name: Myb_DNA-binding Pfam Description: Myb-like DNA-binding domain
  misc_feature (68)..(113): Pfam Name: Myb_DNA-binding Pfam Description: Myb-like DNA-binding domain
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: Functional homolog of the protein sequence given in SEQ ID NO 50235
  misc_feature: Useful for biocontainment applications
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1002 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: Functional homolog of the protein sequence given in SEQ ID NO 50609
  misc_feature: Useful for making plants with altered lignin content
  misc_feature: Functional homolog of the protein sequence given in SEQ ID NO 50232
  misc_feature: Useful for making plants with altered alkaloid content
  misc_feature: Useful for making plants with modulated nitrogen use efficiency
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1010 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 1073 in the 10/374,780 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: Functional homolog of the protein sequence given in SEQ ID NO 50610
  misc_feature: Useful for making plants with altered cell wall content and/or composition
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 442 in the 10/412,699 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 1004 in the 11/435,388 US patent application
  misc_feature: Functional homolog of the protein sequence given in SEQ ID NO 50236
  misc_feature: Useful for making plants with modulated biomass
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 836 in the 10/412,699 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1917 in the 10/374,780 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 824 in the 10/412,699 US patent application
  misc_feature: The sequence is a functional homolog of SEQ ID NO 58 in the 10/666,642 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 296 in the 11/479,226 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: Functional homolog of the protein sequence given in SEQ ID NO 50479
  misc_feature: Useful for making plants with altered terpenoid content
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 271 in the 11/479,226 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 1681 in the 10/374,780 US patent application
  misc_feature: The sequence is a functional homolog of SEQ ID NO 569 in the 10/374,780 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 822 in the 10/412,699 US patent application
  misc_feature: The sequence is a functional homolog of SEQ ID NO 446 in the 10/412,699 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 1572 in the 10/374,780 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: Functional homolog of the protein sequence given in SEQ ID NO 50480
  misc_feature: Useful for making plants with modulated low light sensitivity
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 794 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: Functional homolog of the protein sequence given in SEQ ID NO 50239
  misc_feature: Useful for making plants with modulated flowering time
  misc_feature: The sequence is a functional homolog of SEQ ID NO 36 in US patent 7193132
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 1566 in the 10/374,780 US patent application
  misc_feature: The sequence is a functional homolog of SEQ ID NO 790 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: Functional homolog of the protein sequence given in SEQ ID NO 50241
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 1565 in the 10/374,780 US patent application
  misc_feature: The sequence is a functional homolog of SEQ ID NO 186 in the 10/412,699 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: Functional homolog of the protein sequence given in SEQ ID NO 50240
  misc_feature: Useful for making plants with modulated drought sensitivity
  misc_feature: The sequence is a functional homolog of SEQ ID NO 2178 in the 10/374,780 US patent application
  misc_feature: The sequence is a functional homolog of SEQ ID NO 1692 in the 11/479,226 US patent application
  misc_feature: The sequence is a functional homolog of SEQ ID NO 1564 in the 10/374,780 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 1563 in the 10/374,780 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 126 in the 10/412,699 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 2898 in the 10/374,780 US patent application
  misc_feature: The sequence is a functional homolog of SEQ ID NO 494 in the 10/225,066 US patent application
MGREAAAAARPKLRRGLWSPEEDEKLYNHIIRYGVGCWSSVPKLAGLERCGKSCRLRWINYLRPDLKRGSFSQQEEDLIISLHKILGNRWSQIASQLPGRTDNEIKNFWNSCIKKKLRQRGIDPATHKPLEDDAAAAAAAAAANSGEA

SEQ ID NO: 36944 - DNA, 1304 bp, Panicum virgatum
  misc_feature: Ceres CLONE 1987708
  misc_feature: Encodes the peptide sequence at SEQ ID NO. 36945
atttacattctctctcttctaccccgctccccacgaatccaagatcgacccccctcctcccgtcctccgccttcctccctccttccctcgctgacactgtttgacccctgccgcctgccgccaatcgtgtcatccagctaataaggttcagaggtgataagagtagtgaggaccggacagtgtcactgtggcagtgtggtaccgtgcgtgcgtgagacggggagaatggaggccccctcctcctcatccgctcgccccaactgccgccgcctcctcgccgccgccgccgccctcctcctcctcgcctcctcgcacctcctcgcggcgcgcgccgacgacccctacaggttctacacctggaacgtcaccttcggcgacatctacccgctcggcgtcaagcaggaggggatactgatcaacggccagttcccggggccgcagatcgacgccgtcaccaacgacaacatcatcgtcaatgtcttcaacaacctgcccgtccccttcctcctctcatggcaaggaattcagcagaggaggagctcatggcaagacggtgtgtatggtacaaactgcccaatccctccgggtggcaatttcacttacaacatgcaattcaaggaccaaattgggagctactactacttcccttcccttttattccacaaggcagccggtggttatggtggcatcagggttcttagcagaccaaggatcccggttccatttgacccccctgccggtgatttcaccatattggctggtgactggttcaaactcaatcacactgacttgaaaggcattttagacagtggaaatgacctgccattccctgatgggcttcttattaatggacaaggctcgaatggcaatagatttacagtggaccaagggagaacataccgttttcgggtatcgaatgtgggcattgcaacatcagtgaatattaggattcaaggccattccatgctcctggttgaggtggagggatctcacaccatgcagaccacattcacatccattgatatccatctaggccaatcctactcgttccttgttactgctgatcagccaccggcagactactccataattgtgtcgacacgttttaccacccctgtgctcaccaccactgccatcctccactacagcaatgcaaatggggctgcaacagtactgcctcccctagcccctacaaccgagatcgatttttctctcaatcaggctagatcaattcggtggaatctgacagcgagtggaccaaggccaaaccctcaaggttcttaccactacggtcttgtcaacac

SEQ ID NO: 36945 - protein, 359 aa, Panicum virgatum
  misc_feature: Ceres CLONE 1987708
  misc_feature (172)..(310): Pfam Name: Cu-oxidase Pfam Description: Multicopper oxidase
  misc_feature (46)..(162): Pfam Name: Cu-oxidase_3 Pfam Description: Multicopper oxidase
  misc_feature: SWISSPROT Homolog: EC 1.10.3.2 Laccase
MEAPSSSSARPNCRRLLAAAAALLLLASSHLLAARADDPYRFYTWNVTFGDIYPLGVKQEGILINGQFPGPQIDAVTNDNIIVNVFNNLPVPFLLSWQGIQQRRSSWQDGVYGTNCPIPPGGNFTYNMQFKDQIGSYYYFPSLLFHKAAGGYGGIRVLSRPRIPVPFDPPAGDFTILAGDWFKLNHTDLKGILDSGNDLPFPDGLLINGQGSNGNRFTVDQGRTYRFRVSNVGIATSVNIRIQGHSMLLVEVEGSHTMQTTFTSIDIHLGQSYSFLVTADQPPADYSIIVSTRFTTPVLTTTAILHYSNANGAATVLPPLAPTTEIDFSLNQARSIRWNLTASGPRPNPQGSYHYGLVN

SEQ ID NO: 36946 - DNA, 735 bp, Panicum virgatum
  misc_feature: Ceres CLONE 1987708-R
  misc_feature: Encodes the peptide sequence at SEQ ID NO. 36947
ccgatttctccaacatttcgggagtgttcacgctgggcagcatgcccgacaaccctaccggtggcggcgcctacctccagacatctgtcatggcagccaacatgcgggaatatgttgagatcatctttcagaacgccgagaactttgtgcagtcatggcacattgacggttatgcgttctgggtcgtcgggatggatggagggcaatggacaccggccagtcgtcagggttacaaccttagagatgccattgctcggtacaccttgcaggtgtaccctcagtcatggaccgccatctacatgccgctggacaacgtggggatgtggaacgtgaggtcggagagctgggcccggcagtacctcggccagcagttctacctccgggtgtactcgccggcgaactcgtggcgggacgagaacccgatcccaaagaacgcgctgctctgcggccgggcttctggccgccgaaccaggcctctctgaatctgaagctctgaactgaagggcccagtttcttgtcacgaaacggtgaccgaaacttccgagggtcagttgagggttgcgatgcatcgggatgctcagattgctgagcagagttccactgtggcgttgttccacttccacccatattattttttcttagcaattgtagttaaagcattttgcggtgaatttattgtactggaagcattctcgcttccttactgatatttactaatccacgatatttattcat

SEQ ID NO: 36947 - protein, 159 aa, Panicum virgatum
  misc_feature: Ceres CLONE 1987708-R
  misc_feature (2)..(134): Pfam Name: Cu-oxidase_2 Pfam Description: Multicopper oxidase
  misc_feature: SWISSPROT Homolog: EC 1.10.3.3 L-ascorbate oxidase
DFSNISGVFTLGSMPDNPTGGGAYLQTSVMAANMREYVEIIFQNAENFVQSWHIDGYAFWVVGMDGGQWTPASRQGYNLRDAIARYTLQVYPQSWTAIYMPLDNVGMWNVRSESWARQYLGQQFYLRVYSPANSWRDENPIPKNALLCGRASGRRTRPL

SEQ ID NO: 36948 - DNA, 1019 bp, Panicum virgatum
  misc_feature: Ceres CLONE 1987715
  misc_feature: Encodes the peptide sequence at SEQ ID NO. 36949
gtccagtccagattctgcacccccaccactccgacgcgccattggccaccaccaccaccatccgcatccgccgccaaatttccccacctcgctgacgcagcagcaatggcgactccaccatcagcgatcctccgctgcctcctcctcctcctcgtcgccttcccctctcacccgcgggccacggccgccgcggggcctgcgccgctgtcctcctccccgttcgacgccgcgttggcgaagctccaggcgcggatcggctacgccttccgggcgccggacctcctccgccgggccatgacccacgcctcctactccagcgagaacggccgggctctcgccgtcctgggcctcgccgccgcccagtccgccgcggcgctcggcaccctcgccgccgacaacgacgccgcggcctccgccgtgtcgcgccgcgcaagcgaggcggcctccgaggccgcgtgcgccgctgcggggaagcacgtcgggatcccggccatcgtgcgcgtcgctagccggaccagcgcgtccgcggcacccgtcgtctgcggcgcgcttcgggcgctcatcggcgccgtcgccgtcgacgccaatagcacggacgccgccctggaggtcttctggaagctgcacgtgctcactgctactaccaccgccgacatgtgaggccgggattatcatccagagcagctagattatcatcatgtaccttctagtaatctacgagtattgctggactagtgtggatttgcaccttccgaaccatcagtgttctactagcacgtctctcctgtgtttagggacccttagtttagtgactgctcatcaactcttctgatgttcaactgtcacttactactagtctctacagtatatctactggtagcatgctatgctccatccaggaatgtccatttggatttctggctgcaataaaatgtgatgggtcgtggaacatgaactcccttcgagacagtatgaaacattactgctccaaataggctgtgcaaatattctgtcgccac

SEQ ID NO: 36949 - protein, 184 aa, Panicum virgatum
  misc_feature: Ceres CLONE 1987715
  misc_feature: SWISSPROT Homolog: EC 3.1.26.3 Ribonuclease III
MATPPSAILRCLLLLLVAFPSHPRATAAAGPAPLSSSPFDAALAKLQARIGYAFRAPDLLRRAMTHASYSSENGRALAVLGLAAAQSAAALGTLAADNDAAASAVSRRASEAASEAACAAAGKHVGIPAIVRVASRTSASAAPVVCGALRALIGAVAVDANSTDAALEVFWKLHVLTATTTADM

SEQ ID NO: 36950 - DNA, 702 bp, Panicum virgatum
  misc_feature: Ceres CLONE 1987734
  misc_feature: Encodes the peptide sequence at SEQ ID NO. 36951
aagccaagccaccacctcacaagtcacgcgcgcctatccctccccgcgctcgcgcacgtgaggcgagcaggcggccggccagcgccagcgcccgcgcccgccccccatcctctccacctccgccatggcgttcgcgctcaaggccgcctccaccgcgaccgccgggtcggcgtcgctcgccgccgcggggcccaggaggggcgccgcgccggccgcggggagggtctcgttccggggcgcggcgcccgccgggcccgcggtcgccgtcagggcggcggcggctgccgccgtggcgcaggacaggcgcagcatctcggggaaattcgccgagctcagggagcaggggaagactgccctcatccccttcatcgttgctggtgaccctgacttggccaccacagcgaaggcactcaagatccttgacgcgtgtggttcggacgtgattgaattgggcgtgccttactcagatccattggctgatggccctgttattcaggcctccgcaacacgtgcgctagcaaaaggcaccacgtttgatgatgtaatctccatggttaaggaggtgacacctgagctgtcctgccctgtatcacttttcacatattataacccgattctgaagcgtggaatcccaaacttcatgactattgttaaggaagctggtttacgcggccttgtggtacctgatgttcctttggaaaa

SEQ ID NO: 36951 - protein, 192 aa, Panicum virgatum
  misc_feature: Ceres CLONE 1987734
  misc_feature (67)..(192): Pfam Name: Trp_syntA Pfam Description: Tryptophan synthase alpha chain
  misc_feature: SWISSPROT Homolog: EC 4.2.1.20 Tryptophan synthase
MAFALKAASTATAGSASLAAAGPRRGAAPAAGRVSFRGAAPAGPAVAVRAAAAAAVAQDRRSISGKFAELREQGKTALIPFIVAGDPDLATTAKALKILDACGSDVIELGVPYSDPLADGPVIQASATRALAKGTTFDDVISMVKEVTPELSCPVSLFTYYNPILKRGIPNFMTIVKEAGLRGLVVPDVPLE

SEQ ID NO: 36952 - DNA, 575 bp, Panicum virgatum
  misc_feature: Ceres CLONE 1987759
  misc_feature: Encodes the peptide sequence at SEQ ID NO. 36953
accgccgcgaccagaaggcagcagcaaccgcagcgcgcaggagccgagcaaaccgccgcacaccaacgcctcccgcaatggcgcgcgccggcgctctctgcctcgcgctgctctgcctcctggccgcgcactccgccgtggcgcagaagtccgccacccccgccccggccaccgcgccggccgccgccaccaccccgccggccccggccaagaagacgcccgcgcctgccgcagctccgcccaccacctcccctgccaccccggccccggccgccgcgccgcccaccaccccggccacccccgcgcccgccgcggccccgcccactaccaccacgcctgcccccgccgtggcgccgcccaagtcctccgccaaggcggccacccccgccccggctcccaaggccaaggccaccccgcctgccaccccaccggtggccgagctgccccctgctgccacgccccccgcccccgccgcggacacccccgccgccgcgcccaccaagcctgccgaggtccccgcccccgccccgtccaagaagaagaagaagaagtcatcctcctcctccaagagcaag

SEQ ID NO: 36953 - protein, 165 aa, Panicum virgatum
  misc_feature: Ceres CLONE 1987759
  misc_feature: Functional homolog of the protein sequence given in SEQ ID NO 50275
  misc_feature: Useful for making plants with altered carbohydrate content
MARAGALCLALLCLLAAHSAVAQKSATPAPATAPAAATTPPAPAKKTPAPAAAPPTTSPATPAPAAAPPTTPATPAPAAAPPTTTTPAPAVAPPKSSAKAATPAPAPKAKATPPATPPVAELPPAATPPAPAADTPAAAPTKPAEVPAPAPSKKKKKKSSSSSKS

SEQ ID NO: 36954 - DNA, 647 bp, Panicum virgatum
  misc_feature: Ceres CLONE 1987770
  misc_feature: Encodes the peptide sequence at SEQ ID NO. 36955
actaccagtcctccaccaccaccactaccctcgcttcccccgcaaaccctagccgagggaggcggtggccggcgatggacggcgacggaggcggcgctgcggccgtgcaccaccacacgcgctcccccgaggacgtcttccgcgacttccgcgcgcgccgcgccggcatcgtcaaggcgctcaccacggatgtggagaagttctaccagatgtgcgacccagagaaagagaacttgtgcctttatgggttgccaaatgagacttgggaggtcactctgccagctgaggaagtacctcctgaacttccagaaccagcactggggataaactttgcccgtgatggaatgatcgaaaaagattggttgtctctggtagcagttcatagtgatgcgtggctactgtctgttgcattctactttggggctcgctttggattcgataaagatgccaggagaaggctcttcaccatgattaataacctgcccactgtttatgaagttgtgactggggttgctaaaaagcaatcaaaagcccccaacggcagcagcaaaagcagcaagtctaactctaaaccatcaaaacagaccaactctaacagcaagcctgcgaagccggctcacccaaaagaggaggaggacagtggcccg

SEQ ID NO: 36955 - protein, 190 aa, Panicum virgatum
  misc_feature: Ceres CLONE 1987770
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: Functional homolog of the protein sequence given in SEQ ID NO 50174
  misc_feature: Useful for making plants with altered alkaloid content
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: The sequence is a functional homolog of SEQ ID NO 1981 in the 11/479,226 US patent application
  misc_feature: Functional homolog of the protein sequence given in SEQ ID NO 50175
  misc_feature: Useful for making plants with altered lignin content
  misc_feature: Useful for making plants with modulated flowering time
MDGDGGGAAAVHHHTRSPEDVFRDFRARRAGIVKALTTDVEKFYQMCDPEKENLCLYGLPNETWEVTLPAEEVPPELPEPALGINFARDGMIEKDWLSLVAVHSDAWLLSVAFYFGARFGFDKDARRRLFTMINNLPTVYEVVTGVAKKQSKAPNGSSKSSKSNSKPSKQTNSNSKPAKPAHPKEEEDSG

SEQ ID NO: 36956 - DNA, 708 bp, Panicum virgatum
  misc_feature: Ceres CLONE 1987775
  misc_feature: Encodes the peptide sequence at SEQ ID NO. 36957
ataaagggcggccacataaacccctcctccccacctcaccctatccgccgcttctagacagttcccctcgcggcatctcccatccggccatcccccatctcgtcgatctcgcagcactccttcgccatgggcaagattaagatcggaatcaacggtttcggaaggatcggcaggctcgtggcccgggtcgccctccagagcgaggatgtcgagctcgtcgccgtcaacgaccccttcatcaccaccgactacatgacctacatgttcaagtacgacaccgtgcacggccactggaagcacagtgacatcactctcaaggactccaaaacccttctcttcggtgagaagccggtcaccgtctttggcatcaggaaccccgaggagattccatggggtgaggctggtgctgactatgtcgtggagtccaccggtgtcttcactgacaaggagaaggctgcggctcacttgaagggtggtgccaagaaggttattatctctgctccaagcaaagatgcccctatgtttgttgttggtgtcaatgaggacaagtacacctcagatattaacattgtctccaatgctagctgcaccacaaattgccttgctcccctcgctaaggtcatcaatgacaactttggtatcattgagggtctgatgacgactgttcatgccattactgccacccagaagactgttgatggggcatca

SEQ ID NO: 36957 - protein, 193 aa, Panicum virgatum
  misc_feature: Ceres CLONE 1987775
  misc_feature (4)..(154): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDSKTLLFGEKPVTVFGIRNPEEIPWGEAGADYVVESTGVFTDKEKAAAHLKGGAKKVIISAPSKDAPMFVVGVNEDKYTSDINIVSNASCTTNCLAPLAKVINDNFGIIEGLMTTVHAITATQKTVDGA

SEQ ID NO: 36958 - DNA, 749 bp, Panicum virgatum
  misc_feature: Ceres CLONE 1987785
  misc_feature: Encodes the peptide sequence at SEQ ID NO. 36959
atcgcataaatcctccgccctctccccctccgtaaacccctctctctctcttcctcggccggcctgctcctgcgatccgtgctgcagatcgccagatcggtcgacatggcgctcgtattgcattctggacctggtaacaagaatgccttcaaggcacttattgctgcagaatacagtggggttaagattgagttgacaaagaattttgagatgggtgtcaccaacaagacccctgagtttcttaagatgaacccccttgggaaggtgcctgttctggagactcctgaaggtgctgtttttgagagccatgctattgcacgctatgttgctcgcttgaatgatggcaaccctctttttggctcttctcgtattgaacaagcccatgttgagcagtggatggactttgctgcaacagaagttgatcctggtgttgcatggtacttgtacccaaggcttggttacattccttattctcagacgacagaggaaacagctattgcctcattgaagagagcgcttggttctctgaacacccaccttgcctcaaagacattccttgttgggcattctgtcactctagctgacattgtattgacatgcaacctctaccatggatttgcacggatcttgaccaagagcttcacatcctagttccctcatgtcgagaggtatttctgggacatggttaaccagcctaacttcaagaagtcatgggcgatgtcaagcaggcagagtcagtgcctcctgtt

SEQ ID NO: 36959 - protein, 181 aa, Panicum virgatum
  misc_feature: Ceres CLONE 1987785
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
MALVLHSGPGNKNAFKALIAAEYSGVKIELTKNFEMGVTNKTPEFLKMNPLGKVPVLETPEGAVFESHAIARYVARLNDGNPLFGSSRIEQAHVEQWMDFAATEVDPGVAWYLYPRLGYIPYSQTTEETAIASLKRALGSLNTHLASKTFLVGHSVTLADIVLTCNLYHGFARILTKSFTS

SEQ ID NO: 36960 - DNA, 773 bp, Panicum virgatum
  misc_feature: Ceres CLONE 1987797-R
  misc_feature: Encodes the peptide sequence at SEQ ID NO. 36961
ggtggcggcaaggccacggccgcctccgtgtcggtgaccgctgcggtggccgcgaaggaggccgagctggcgaggtccgacagcttcgacgactacgagcaatgcagagtttgtcagcagaagacagaagaacctctggtagatcttggatgcagatgtcgtggagatcttgctaaagcacatcgcacatgcattaatgtttggtttcgtactagaggatcaaacaaatgtgagatatgccagcaagtggctgtcaatatcccccctccagaaacgcaagcaagtacaagttattgggtttggagggttgattcgacttatggaaggggacgaggaggacgtgaaaggggatggtttagcccactttgggtcgcgtttgcaattctgattggtggtctcttattggacgtgctgatatctgtttcccttggtgtttccgcacttcctgtcaacataataattggtgtgcttatcgttctcggcttgggcaccgcccttcgcctagctctggagtgctgtcaggaatggggctcgaggaggaatgtgagcaacatgccaaggatggagaacataccgcctactgggtaccatcctgcagtcgtataattctgaggtttgtaaatagcgtagaaacatctaagctcgtgctggcttttggattcacctcgtgattaacttaatctcacacgattgctgctcgtcaaagtcgagctcagattcaaagcttgttgatcacgatcggggtcatgctccaatgtaaataaccagttccc

SEQ ID NO: 36961 - protein, 201 aa, Panicum virgatum
  misc_feature: Ceres CLONE 1987797-R
  misc_feature (35)..(80): Pfam Name: zf-C3HC4 Pfam Description: Zinc finger, C3HC4 type (RING finger)
  misc_feature: Functional homolog of the protein sequence given in SEQ ID NO 51533
  misc_feature: Useful for making plants with altered alkaloid content
GGGKATAASVSVTAAVAAKEAELARSDSFDDYEQCRVCQQKTEEPLVDLGCRCRGDLAKAHRTCINVWFRTRGSNKCEICQQVAVNIPPPETQASTSYWVWRVDSTYGRGRGGRERGWFSPLWVAFAILIGGLLLDVLISVSLGVSALPVNIIIGVLIVLGLGTALRLALECCQEWGSRRNVSNMPRMENIPPTGYHPAVV

SEQ ID NO: 36962 - DNA, 432 bp, Panicum virgatum
  misc_feature: Ceres CLONE 1987797
atctcatccgtccccatctgagctccccgtcggcgtaggtccccaccgcctgacctcccctcgccgtcgcgagaccgagcagccagtagccgcaggagtaggtgctccgtgtcccgccttccaatacccgaaagggacgccacctcccctcttcgcacggcacgcgaggtgttcgacggagagccgagccgcacaggaggaggaggtgggagccggcggcccgcccatgtcgagcggcgcggacggatcggcgcccggcccggccctcgacccgacgccgggcccggagctgaaccgtgagccgcccgtgctgcaggctccggagccggcaccgcagcaggagatggcggcgttgcagatggaggcgccggcgccagcgccacagcaggaggccgcggcgctgcaaatccagacgccggggccggcaccgcc

SEQ ID NO: 36963 - DNA, 648 bp, Panicum virgatum
  misc_feature: Ceres CLONE 1987804
  misc_feature: Encodes the peptide sequence at SEQ ID NO. 36964
atccgtctctgctttctcctcgaagcaggtccatcttcaagaaacgttccatgcgagctcgtaatttagcagagctcgcaattgccatcgatttgcaatgtcggacgcgggcgaggtgtccagcccggcgtcgtccggggcctcgtcctcgccgccgcagtcgccagctgaggcagagccccggcgcagccgccggggaggcgagaagcgagcgcgggacggcggcgggaaccacccgtcgttccgcggcgtgcggatgcgggcgtgggggaagtgggtgtcggagatccgggagccgcgcaagaagtcgcgcatctggctcggcacgttccccacgcccgagatggcggcgcgcgcgcacgacgccgccgcgctcgtcgtgaagggccccgccgccgtgctcaacttcccggagatggccacggcgctcccgcgcccggcctccgccgcaccgcgcgacgtccaggcggcggcggcgcgcgccgctaccatggaaccgcctccggtgccgggcgccaccgccgcggccgttgccgcattgcccacctcggcgccggcgcccccggtggcggggcagcaggcggacgacgagctcgaggcgatcgtccagctcccgccgctcgacgaggacgcccggtgagctcgtga

SEQ ID NO: 36964 - protein, 180 aa, Panicum virgatum
  misc_feature: Ceres CLONE 1987804
  misc_feature (47)..(98): Pfam Name: AP2 Pfam Description: AP2 domain
  misc_feature: Functional homolog of the protein sequence given in SEQ ID NO 51286
  misc_feature: Useful for biocontainment applications
  misc_feature: Useful for making plants with modulated flowering time
  misc_feature: The sequence is a functional homolog of SEQ ID NO 2848 in the 10/374,780 US patent application
  misc_feature: The sequence is a functional homolog of SEQ ID NO 456 in the 10/225,066 US patent application
  misc_feature: The sequence is a functional homolog of SEQ ID NO 610 in the 11/435,388 US patent application
  misc_feature: The sequence is a functional homolog of SEQ ID NO 628 in the 11/479,226 US patent application
  misc_feature: The sequence is a functional homolog of SEQ ID NO 159 in the 11/479,226 US patent application
  misc_feature: The sequence is a functional homolog of SEQ ID NO 2218 in the 10/374,780 US patent application
  misc_feature: The sequence is a functional homolog of SEQ ID NO 36 in the 10/412,699 US patent application
  misc_feature: The sequence is a functional homolog of SEQ ID NO 466 in the 11/435,388 US patent application
  misc_feature: The sequence is a functional homolog of SEQ ID NO 492 in the 10/225,066 US patent application
  misc_feature: The sequence is a functional homolog of SEQ ID NO 2602 in the 10/374,780 US patent application
  misc_feature: The sequence is a functional homolog of SEQ ID NO 656 in the 11/435,388 US patent application
  misc_feature: The sequence is a functional homolog of SEQ ID NO 68 in the 10/225,066 US patent application
  misc_feature: The sequence is a functional homolog of SEQ ID NO 1318 in the 11/479,226 US patent application
  misc_feature: The sequence is a functional homolog of SEQ ID NO 164 in the 10/225,068 US patent application
  misc_feature: The sequence is a functional homolog of SEQ ID NO 1816 in the 10/412,699 US patent application
  misc_feature: The sequence is a functional homolog of SEQ ID NO 188 in the 10/374,780 US patent application
  misc_feature: The sequence is a functional homolog of SEQ ID NO 28 in the 10/225,068 US patent application
  misc_feature: The sequence is a functional homolog of SEQ ID NO 740 in the 10/225,066 US patent application
  misc_feature: Functional homolog of the protein sequence given in SEQ ID NO 50529
  misc_feature: Useful for making plants with altered terpenoid content
MSDAGEVSSPASSGASSSPPQSPAEAEPRRSRRGGEKRARDGGGNHPSFRGVRMRAWGKWVSEIREPRKKSRIWLGTFPTPEMAARAHDAAALVVKGPAAVLNFPEMATALPRPASAAPRDVQAAAARAATMEPPPVPGATAAAVAALPTSAPAPPVAGQQADDELEAIVQLPPLDEDAR

SEQ ID NO: 36965 - DNA, 521 bp, Panicum virgatum
  misc_feature: Ceres CLONE 1987807
  misc_feature: Encodes the peptide sequence at SEQ ID NO. 36966
caagcaccgcagcagcaacctccactgccgcaaggccaccgcaacgaagaaagcggcggcaaaaggatactcgggaaagcggcaaggaacatcggcggtcactctggtcttggctcgccggccgccatggggaggtcgccgagctgcgagaaggcgcacaccaacaagggcgcgtggaccaaggaggaggacgaccggctcgtggcgtacatcaaggcgcacggtgaggggtgctggcgctcgctgaccgaggccgccggcctgctccgctgcggcaagagctgccgcctccggtggatcaactacctccggcccgacctcaagcgcgggaacttcaccgaggaggaggacgagctcatcatcaagctccacagcctcctcggcaacaaatggtccctgatcgccgggaggctgcctgggaggacggacaacgagatctataactactggatcacgcacatccggaggaaactactgatccgggggatcgaccaggagtcccaccggtcgatcaacgagca

SEQ ID NO: 36966 - protein, 131 aa, Panicum virgatum
  misc_feature: Ceres CLONE 1987807
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 1004 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: Functional homolog of the protein sequence given in SEQ ID NO 50232
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1073 in the 10/374,780 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1002 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 1010 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 296 in the 11/479,226 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 824 in the 10/412,699 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 569 in the 10/374,780 US patent application
  misc_feature: Functional homolog of the protein sequence given in SEQ ID NO 50235
  misc_feature: Useful for biocontainment applications
  misc_feature: The sequence is a functional homolog of SEQ ID NO 442 in the 10/412,699 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 58 in the 10/666,642 US patent application
  misc_feature: Functional homolog of the protein sequence given in SEQ ID NO 50234
  misc_feature: Useful for making plants with altered cell wall content and/or composition
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 271 in the 11/479,226 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1681 in the 10/374,780 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 822 in the 10/412,699 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 836 in the 10/412,699 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 726 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: Functional homolog of the protein sequence given in SEQ ID NO 50236
  misc_feature: Useful for making plants with modulated biomass
  misc_feature: The sequence is a functional homolog of SEQ ID NO 794 in the 11/435,388 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 1917 in the 10/374,780 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: Functional homolog of the protein sequence given in SEQ ID NO 50237
  misc_feature: Useful for making plants with modulated low light sensitivity
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 446 in the 10/412,699 US patent application
  misc_feature: The sequence is a functional homolog of SEQ ID NO 796 in the 11/435,388 US patent application
  misc_feature: The sequence is a functional homolog of SEQ ID NO 743 in the 10/666,642 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 790 in the 11/435,388 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: Functional homolog of the protein sequence given in SEQ ID NO 50479
  misc_feature: Useful for making plants with altered terpenoid content
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 1572 in the 10/374,780 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 1566 in the 10/374,780 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: Functional homolog of the protein sequence given in SEQ ID NO 50239
  misc_feature: Useful for making plants with modulated flowering time
  misc_feature: The sequence is a functional homolog of SEQ ID NO 36 in US patent 7193132
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 186 in the 10/412,699 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 126 in the 10/412,699 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 1563 in the 10/374,780 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 1564 in the 10/374,780 US patent application
  misc_feature: The sequence is a functional homolog of SEQ ID NO 1565 in the 10/374,780 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: Functional homolog of the protein sequence given in SEQ ID NO 50240
  misc_feature: Useful for making plants with modulated drought sensitivity
  misc_feature: The sequence is a functional homolog of SEQ ID NO 2178 in the 10/374,780 US patent application
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 1692 in the 11/479,226 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: Functional homolog of the protein sequence given in SEQ ID NO 50241
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 2262 in the 10/374,780 US patent application
  misc_feature: The sequence is a functional homolog of SEQ ID NO 774 in the 10/225,066 US patent application
  misc_feature: The sequence is a functional homolog of SEQ ID NO 454 in the 10/374,780 US patent application
  misc_feature: The sequence is a functional homolog of SEQ ID NO 568 in the 11/435,388 US patent application
  misc_feature: The sequence is a functional homolog of SEQ ID NO 90 in the 10/225,068 US patent application
MGRSPSCEKAHTNKGAWTKEEDDRLVAYIKAHGEGCWRSLTEAAGLLRCGKSCRLRWINYLRPDLKRGNFTEEEDELIIKLHSLLGNKWSLIAGRLPGRTDNEIYNYWITHIRRKLLIRGIDQESHRSINE

SEQ ID NO: 36967 - DNA, 698 bp, Panicum virgatum
  misc_feature: Ceres CLONE 1987810
  misc_feature: Encodes the peptide sequence at SEQ ID NO. 36968
cccaccgcccggtccgagacgcaccaacgccaccatatcccttcccttccgcgaccccttctcgccgtcgccgccggctccgtccagatctagacatgcctcgctatgatgatcgttatgggaacacacgcttgtatgttggcagactgtcctcccgcactcgtacccgtgacctggaatatcttttcagcaaatatggaagaatacgagaagtggagttgaagcgcgactatgcatttattgaattcagcgatcctcgtgatgctgatgatgcacaatacaacctagatggcagggaagttgatggcagccgcattatcgttgagtttgctaaaggggttcctcgtggttctggcggctcacgcgagtacatgggaagagggcctccgccagggacaggtcgctgttttaactgtggaattgatggtcactgggcaagggattgcaaggctggtgactggaagaacaaatgctaccgttgtggagaaaggggccacatagaaagaaattgccagaacagtccaaggaatctgaggcgcgagagaagttattcacggtcaccatctccacgccgtggacgggggcgcagccggagctacagcagaagccggagctatagccgttctagatccccatctggatctcccaggggtggacgccgagaccgtgatgagaggagatcaaggagtcttagctac

SEQ ID NO: 36968 - protein, 200 aa, Panicum virgatum
  misc_feature: Ceres CLONE 1987810
  misc_feature (13)..(76): Pfam Name: RRM_1 Pfam Description: RNA recognition motif. (a.k.a. RRM, RBD, or RNP domain)
  misc_feature (102)..(119): Pfam Name: zf-CCHC Pfam Description: Zinc knuckle
  misc_feature (124)..(141): Pfam Name: zf-CCHC Pfam Description: Zinc knuckle
  misc_feature: SWISSPROT Homolog: EC 5.2.1.8 Peptidylprolyl isomerase
MPRYDDRYGNTRLYVGRLSSRTRTRDLEYLFSKYGRIREVELKRDYAFIEFSDPRDADDAQYNLDGREVDGSRIIVEFAKGVPRGSGGSREYMGRGPPPGTGRCFNCGIDGHWARDCKAGDWKNKCYRCGERGHIERNCQNSPRNLRRERSYSRSPSPRRGRGRSRSYSRSRSYSRSRSPSGSPRGGRRDRDERRSRSLS

SEQ ID NO: 36969 - DNA, 645 bp, Panicum virgatum
  misc_feature: Ceres CLONE 1987853
  misc_feature: Encodes the peptide sequence at SEQ ID NO. 36970
gtcccgacaccaaaaccgagctctcgcggtctctgtcccctccccttcgcgtggggctagggtttcgtccgcttcgcgcgcagtcaagatgccccgctacgatgatcggtatggtgggaacacaaggctgtacgtgggtcgtatctcctcttgtacaaggacagaggaccttgaagacattttcagcagatatgggagagtgcgttatgtggatatgaagcatgagttcgcatttgttgagtttagcgatccccaggatgctgatgatgcaaggtacaatcttgatggtcgggatattgatggaagccgcataattgtcgagtttgctaaaggggttccgcgtggcccaggaggatcccgtgaatatatgggcaggggaccacctccaggttctggccgctgctttaactgtggtattgatgggcattgggctcgtgactgcaaagctggtgactggaaaaacaggtgctaccgctgcggagataggggccacatagaaagagactgtcggaatagccctaagaatctcaggcgtggaagaagttactcaaggtccccatcccctcgtcgtggaaggggccgtgataggagttacagcaggagccgcagtaggagctacagccgctcccgatctccaaggaggga

SEQ ID NO: 36970 - protein, 185 aa, Panicum virgatum
  misc_feature: Ceres CLONE 1987853
  misc_feature (14)..(77): Pfam Name: RRM_1 Pfam Description: RNA recognition motif. (a.k.a. RRM, RBD, or RNP domain)
  misc_feature (103)..(120): Pfam Name: zf-CCHC Pfam Description: Zinc knuckle
  misc_feature (125)..(142): Pfam Name: zf-CCHC Pfam Description: Zinc knuckle
  misc_feature: SWISSPROT Homolog: EC 5.2.1.8 Peptidylprolyl isomerase
MPRYDDRYGGNTRLYVGRISSCTRTEDLEDIFSRYGRVRYVDMKHEFAFVEFSDPQDADDARYNLDGRDIDGSRIIVEFAKGVPRGPGGSREYMGRGPPPGSGRCFNCGIDGHWARDCKAGDWKNRCYRCGDRGHIERDCRNSPKNLRRGRSYSRSPSPRRGRGRDRSYSRSRSRSYSRSRSPRR

SEQ ID NO: 36971 - DNA, 700 bp, Panicum virgatum
  misc_feature: Ceres CLONE 1987854
  misc_feature: Encodes the peptide sequence at SEQ ID NO. 36972
  misc_feature (591)..(591): n is a, c, t, g, unknown, or other
tacgactctcataagatttgatgaggtttactctgtttacttcaaatgcaacaagaagctcatcagggaatacccaaatctgttcaattacaccaaggacatataccaaattcctggcattagcagcacggttaacatggagcacatacgaaagagctactatggaggctactcacccataaatccatatgggattatccctgcgggcccaaacatcgactataatgctctacatgacagagagaagtttagcgcctagaagattttcttggttgacttctgtatatgctatgcttattgttgtaataatattgaggatctattcttgtgcttttggtcattgctaatctgcatgtggcagatgtgtctaacagatggttggtcagatctggtttaaatctcttctgtgctaccacatgtcttgttttctttgccaccttcgattttatgcatatgaaagttgcagaaatttcttacttgatacatcgttttctttgtatcccataaatgaaactgtatatagagttggtacatgtttatactaagttacatctgtcttgctttttttgatcagacacatgattattgtangtacttatacattcctcttggtggttctcgaagaaagctactgagtagtgtggcatgatctggaaatggaaactgtttcatggccatggttaacttgggttatttttcg

SEQ ID NO: 36972 - protein, 85 aa, Panicum virgatum
  misc_feature: Ceres CLONE 1987854
  misc_feature: SWISSPROT Homolog: EC 2.5.1.18 Glutathione transferase
TTLIRFDEVYSVYFKCNKKLIREYPNLFNYTKDIYQIPGISSTVNMEHIRKSYYGGYSPINPYGIIPAGPNIDYNALHDREKFSA

SEQ ID NO: 36973 - DNA, 655 bp, Panicum virgatum
  misc_feature: Ceres CLONE 1987864
  misc_feature: Encodes the peptide sequence at SEQ ID NO. 36974
aaatcttaaaccttgcaattttctcatagatgaacatgaccgtgctgtgcttggggattttggaatcccgtccctgctgttcggactttcgcagcctcgtcctgaccttatccaaaggcttgggactccaaattacatggctccagaacaatggcaaccaaacatcagaggtccgattagctatgagactgattcatggggttttgcctgcagcatccttgagatgttgagtggcattcagccatggcgtggaaaatcaccagatgagatttatcagttggttgtcctcaagaaagaaaaaccaatattcccatacagtctgcctccaggcgttgaatctgtgctttctggatgctttgagtatgactttagaaaccgtccctcgatgaaagatattttgcatgcgtttgagagtgctaaagatgctgatcatgacaacgctgtctgggacaattctgaaaatgtaacagtggagaggccaaccatggcaaatcacaccaattggttgctcttcaaggacaagctgcaagtgggagataaggtccgctcaagaaagcttaaaagctcatgtagtcctgaaactatggaaatccctgatggaaccatagttggcatggaggatgatggggaacgtgatggtttcattcttgtacga

SEQ ID NO: 36974 - protein, 217 aa, Panicum virgatum
  misc_feature: Ceres CLONE 1987864
  misc_feature: SWISSPROT Homolog: EC 2.7.11.1 Non-specific serine/threonine protein kinase
NLKPCNFLIDEHDRAVLGDFGIPSLLFGLSQPRPDLIQRLGTPNYMAPEQWQPNIRGPISYETDSWGFACSILEMLSGIQPWRGKSPDEIYQLVVLKKEKPIFPYSLPPGVESVLSGCFEYDFRNRPSMKDILHAFESAKDADHDNAVWDNSENVTVERPTMANHTNWLLFKDKLQVGDKVRSRKLKSSCSPETMEIPDGTIVGMEDDGERDGFILV

SEQ ID NO: 36975 - DNA, 713 bp, Panicum virgatum
  misc_feature: Ceres CLONE 1987894
  misc_feature: Encodes the peptide sequence at SEQ ID NO. 36976
acagagagggtatgctcttgcctgcctgcctgcccgggtggccatcacttctattctattcttcagtggagatggagtcaattcctgccaagattcggagcaaatccgccccggatcttgctttctccacgcgctgggtttttctttcttagtcgtcacagcccctttcctcccttcactttccatcatatctcctggaatcctttcatgtgcctgtatatatacagcaactcaaccacacccttcgaaaggcaaacaaagcctctcatgccaagcacgcatacctccctgctttttttagtctcctctgcaactcttccgctctgcagctgctcgtagagcatcctcctcctcctcctcctcctagtcaggtgcaagaacacgagcaggagaacatctgctctcttgtttcttccatggcggtggccacagagaccccgttccatgtcctggccgtggatgacagcctcctggacaggaagctcatcgagaggctcctcaagacctcttccttccaagtcaccactgtcgattccgggagcaaggcgctggagttcctggggatccacggcgaggacagcagcccaccagtttcggatgcagaccagctggaggttgcggtgaatctgatcatcacagactactgcatgcctggaatgacgggatatgatctgctcaagaagatcagggatcaacatctctgagagatatcc

SEQ ID NO: 36976 - protein, 95 aa, Panicum virgatum
  misc_feature: Ceres CLONE 1987894
  misc_feature: SWISSPROT Homolog: EC 3.1.4.17 3',5'-cyclic-nucleotide phosphodiesterase
  misc_feature: Functional homolog of the protein sequence given in SEQ ID NO 51179
  misc_feature: Useful for making plants with modulated low light sensitivity
  misc_feature: Useful for making plants with modulated nitrogen use efficiency
  misc_feature: Functional homolog of the protein sequence given in SEQ ID NO 51180
  misc_feature: Useful for making plants with altered carotene content
  misc_feature: Useful for making plants with altered lignin content
  misc_feature: Useful for making plants with altered terpenoid content
  misc_feature: The sequence is a functional homolog of SEQ ID NO 932 in the 10/666,642 US patent application
MAVATETPFHVLAVDDSLLDRKLIERLLKTSSFQVTTVDSGSKALEFLGIHGEDSSPPVSDADQLEVAVNLIITDYCMPGMTGYDLLKKIRDQHL

SEQ ID NO: 36977 - DNA, 1220 bp, Panicum virgatum
  misc_feature: Ceres CLONE 1987896
  misc_feature: Encodes the peptide sequence at SEQ ID NO. 36978
  misc_feature (306)..(306): n is a, c, t, g, unknown, or other
actccacaggaccacctccagctccaggctccaagccgccgcagcagcagccagcggcaccaccaccccacccgccggggccgcccataccatttgcaaagcccgctgcgactgcggcgccaatggccgaccgcgtctacccggccgccaagcccaacccgcccccggcggccgcggccgccaacggcggcgcgccggcgtcgttcccagcgcccaaatcgcagacgtaccagcggcccatctaccggccgcaggcccccgcgaagcgccggcggtcctgccggtgcagcctctgctgctgcttcntgctgggcgctggtggcggtgatggtgcgggggcgcggcggggcggcggcggggggcgccttctacctcctgtaccgcccgcagcgcccgtcctttaccgtctcctccgtgcgcctggcgtcgctgaacctcacctcctccgccaccgcgccggtgctcaccgactccatcacgctgaccgtcaccgcccgcaaccccaacaagaagatcgcctacctctacggcgacttcaccctctcggcggccacgtccgccaacgcgctcccgctgggcagcgcgacggtgcccgggttcgcgcacgcggccggtaacaccacggtgctgaccgccaccatcgcctccagcgcggcggcggtggacccgagcgcgagcggcgacgtgaagaagtcgggcgggttcggcgtggtcctggacgcggacacgagcgcgggcgcccgcgtgggcggcctgaggacgaagaagatcggcatccaggtgcactgcgagggcatcaaggtgaccccgccgcccccgcccccgcccccgcccccgccggcgcccaggaaggccaagggcgggaagaacggcaccgtcgcgctcgcgccggccccggccccgtccgacgccgacacgacgacggcgacggcgacggtgagcacggcggcgcacccgtgcaaggtcagggtccgcgtcaagatctggaagtggactttctaggtgcggaggcgcgttacgattaggggctgggctggaagattttccagtaaagttttttttcgctttgatatagagtactactacgcactataatttatttacatgattattatgttggagcagacgagtaggaagccattacccatccatgcggtgtaaattccccattttcctttccttttctccctcttgatggaaacaatttttcttggtgtcag

SEQ ID NO: 36978 - protein, 224 aa, Panicum virgatum
  misc_feature: Ceres CLONE 1987896
  misc_feature (15)..(154): Pfam Name: Hin1 Pfam Description: Harpin-induced protein 1 (Hin1)
MVRGRGGAAAGGAFYLLYRPQRPSFTVSSVRLASLNLTSSATAPVLTDSITLTVTARNPNKKIAYLYGDFTLSAATSANALPLGSATVPGFAHAAGNTTVLTATIASSAAAVDPSASGDVKKSGGFGVVLDADTSAGARVGGLRTKKIGIQVHCEGIKVTPPPPPPPPPPPAPRKAKGGKNGTVALAPAPAPSDADTTTATATVSTAAHPCKVRVRVKIWKWTF

SEQ ID NO: 36979 - DNA, 692 bp, Panicum virgatum
  misc_feature: Ceres CLONE 1987903
  misc_feature: Encodes the peptide sequence at SEQ ID NO. 36980
ccctctcctagctcattgtgtcgtcgtcgtcgtcttcccggcttgggcgttcaagctggcagctctcgtttgctgcgctgtagcccatcgcttgaggccgggtggcatggcgaggcggacgagcggccccaagaagaagctgaggaggggcctctggtcgccggaggaggatgagaagctgatgaaccacattgccaagtatggccatggccgctggagttccgtccccaagctagcaggccttgagaggtgtgggaagagctgcaggctgaggtggatcaactacctcaggccggacctcaagaggggtgcattctcgcaggaagaggaggacctcatcatccatctccactccatgctgggcaacaagtggtctcggattgcagcgcagctgccggggcggacggacaacgaggtcaagaacttctggaactcgtacatcaagaagaagctctgccagcgcggcatcgacccggccacccacaagccgctggccgaggccagcagcggccgcgggggcgccgccgcagctgccagccgcgcgcgaacggcggtgttcagcgacgccgagctcatcctgtcgtcgtcggcggagggtaagcacatgcccgcgccgccagtgacggcggcggagagctacgtgtacagccgcagcatcagcgccgacggcggcgcgagcgacggctccctgc

SEQ ID NO: 36980 - protein, 195 aa, Panicum virgatum
  misc_feature: Ceres CLONE 1987903
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1002 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 824 in the 10/412,699 US patent application
  misc_feature: The sequence is a functional homolog of SEQ ID NO 296 in the 11/479,226 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 1073 in the 10/374,780 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 569 in the 10/374,780 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 126 in the 10/412,699 US patent application
  misc_feature: Functional homolog of the protein sequence given in SEQ ID NO 50831
  misc_feature: Useful for making plants with modulated nitrogen use efficiency
  misc_feature: Functional homolog of the protein sequence given in SEQ ID NO 50733
  misc_feature: Useful for making plants with altered cell wall content and/or composition
MARRTSGPKKKLRRGLWSPEEDEKLMNHIAKYGHGRWSSVPKLAGLERCGKSCRLRWINYLRPDLKRGAFSQEEEDLIIHLHSMLGNKWSRIAAQLPGRTDNEVKNFWNSYIKKKLCQRGIDPATHKPLAEASSGRGGAAAAASRARTAVFSDAELILSSSAEGKHMPAPPVTAAESYVYSRSISADGGASDGSL

SEQ ID NO: 36981 - DNA, 569 bp, Panicum virgatum
  misc_feature: Ceres CLONE 1987915
  misc_feature: Encodes the peptide sequence at SEQ ID NO. 36982
aactagagttcatctcatccctctcgttctcggtagctgccatcaccatccatcaccccaagtccccaagcaagagcaagaagctcgctccgctcgagtgctcgccgcctgtgctatggccgctgccatcgtcaccgctccgtccagagcacttctgatggtctccctcgctctcctggccgcggttggcacggccgccgcgctgtcgaccaagtactacgacaagcggtgcccggggctgcagccggccgtccggtccgcggtggcgcgcgccgtggcggccgacccgagcgcgggcgccgccgtgctccgcctcttcttccacgactgcttcgtcaacggctgcgacgcctccgtgctcctcgacgacggcgccgcgccgggcgagaagggcgccgcacccaacgccaactccctgcgcgggtacgaggtggtcgacgccgccaaggccgcggccgaggccgcctgcccgggcgccacctcctgcgcggacgtgctcgcgctcgccacccgcgacgccgtggcgttcctggggggcccctcgtgggccgtgcgcctcggccgcctgg

SEQ ID NO: 36982 - protein, 151 aa, Panicum virgatum
  misc_feature: Ceres CLONE 1987915
  misc_feature (46)..(151): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50996
  misc_feature: Useful for making plants with altered carbohydrate content
  misc_feature: Functional homolog of the protein sequence given in SEQ ID NO 50229
  misc_feature: Useful for making plants with altered cell wall content and/or composition
MAAAIVTAPSRALLMVSLALLAAVGTAAALSTKYYDKRCPGLQPAVRSAVARAVAADPSAGAAVLRLFFHDCFVNGCDASVLLDDGAAPGEKGAAPNANSLRGYEVVDAAKAAAEAACPGATSCADVLALATRDAVAFLGGPSWAVRLGRL

SEQ ID NO: 36983 - DNA, 657 bp, Panicum virgatum
  misc_feature: Ceres CLONE 1987919
  misc_feature: Encodes the peptide sequence at SEQ ID NO. 36984
tccagccggagcgccgcgccaccatgctccggcgtctcctccgccgcctctccaccaccgctgagggcgccgtcacagcctccccctcctcatccccatcgcaatcccagtcggtgccagatggcttgtaccgccgcatcatggatgttggacgcccaaacgccccgctgtcccccgtcctggagcagtgggctcgagagggccacaccatcaagaagcacaccgtccaggccatcgtcaagaagctcgtcggcctccgccgcttcgccaacgcactcgagctgtcgttctggatgacggaccggaggcacctccacctgacggccggtgacgtcgcgtaccggctgcagctgatcagcaaggtgcacggccttgagaaagcggtcgagtactttggcatggtgccgaagcagctgaggaagcagcagtgctatggctccctccttaaatgctatgtggaggcgaaggacgtcgagaaggctgaacagctcttcaccaagatggaggagatggggatgaagaactcttatgcatacaattgcatgatgaatctattcttgcagactgggaagctcgaaagggtgcacgccatgttccaggacatggaagagaaaggcgtcaagcctgatattttcagtgtggagaatctagtagctg

SEQ ID NO: 36984 - protein, 211 aa, Panicum virgatum
  misc_feature: Ceres CLONE 1987919
  misc_feature (169)..(203): Pfam Name: PPR Pfam Description: PPR repeat
MLRRLLRRLSTTAEGAVTASPSSSPSQSQSVPDGLYRRIMDVGRPNAPLSPVLEQWAREGHTIKKHTVQAIVKKLVGLRRFANALELSFWMTDRRHLHLTAGDVAYRLQLISKVHGLEKAVEYFGMVPKQLRKQQCYGSLLKCYVEAKDVEKAEQLFTKMEEMGMKNSYAYNCMMNLFLQTGKLERVHAMFQDMEEKGVKPDIFSVENLVA

SEQ ID NO: 36985 - DNA, 619 bp, Panicum virgatum
  misc_feature: Ceres CLONE 1987921
  misc_feature: Encodes the peptide sequence at SEQ ID NO. 36986
ctcgccattctctcctctctaaagctttgcctcggcccccctcgcgcttcccgagctctcgtcgtccagagaggcggagggaggggctcgaggacccagcgggcggcggcaaatgacggaggcggcggcggcggggttcaaggcggtgaggcgggcggggctcgcggcggcgctgctgctgctcgtcctcgtcgtggtcgtcgccggcggacccggcgaccgggcgctccacgggttccggcaccggagcgcggcggcgggcggctcgaggcggtggctgcgggactcgtcatggccggcggcggcgacgccgagggccgacggtgacgacgacgggccagcgatggccgttcgcggcgcggtggaggacccggaagcggtggtcgacgacgtgcacatgtccatcaggaacagcacggcccggcggaatctcgggtacctgtcgtgtgggacgggcaaccccatcgacgactgctggcgctgcgacccggactggcacaagaaccgccagcgcctggctgactgcggcatcggcttcggccgcaacgccatcggtggccgcgacggcaagatctacgtcgtcactgacccgagcgacgacgacgccgtcaacccgcgc

SEQ ID NO: 36986 - protein, 168 aa, Panicum virgatum
  misc_feature: Ceres CLONE 1987921
  misc_feature: SWISSPROT Homolog: EC 4.2.2.2 Pectate lyase
MTEAAAAGFKAVRRAGLAAALLLLVLVVVVAGGPGDRALHGFRHRSAAAGGSRRWLRDSSWPAAATPRADGDDDGPAMAVRGAVEDPEAVVDDVHMSIRNSTARRNLGYLSCGTGNPIDDCWRCDPDWHKNRQRLADCGIGFGRNAIGGRDGKIYVVTDPSDDDAVNP

SEQ ID NO: 36987 - DNA, 656 bp, Panicum virgatum
  misc_feature: Ceres CLONE 1987934
  misc_feature: Encodes the peptide sequence at SEQ ID NO. 36988
accacaagcaccgcaactggtgcatactccgcaaggaatacaacaaagctccaacccaacgatgatgggggaaagagatgaacagacctgccccaatcgcggctaaaccctagcttagcggcgggcgcggatgcccctcgcactccttctctcccgcatttcccagccggccaaaatgcccagcacccgctccgccgcctccgccaggctggtccgcgcctcccgcgccgacgtcaacccagttgtacaagaagtgaaacgtgaatccagtgtttcttttgatgtttccaagcctgaatcaactacttctgttaagaggaaaagggtgaagcgagagcttgaagtgaatggggagcctcctaagaagcaggttggtattgtccctgacattgaggattttcgatatgacaggaccaaagcggttacatcatcgattaaggcaaccctgtcttcggtcaaggtggagggaaagctcagagtttcttcagttataaaagctaaagctccagaaaactgggaggcagttcttgggggtattaaaaacatgaggttatctggccaagcccctgtagatacgaaaggctgtgaaaaagctggatctctccttccgcccaaggaaagaagatttgcagttctgatatcaactatgatgtcta

SEQ ID NO: 36988 - protein, 160 aa, Panicum virgatum
  misc_feature: Ceres CLONE 1987934
  misc_feature: SWISSPROT Homolog: EC 4.2.99.18 DNA-(apurinic or apyrimidinic site) lyase
MPSTRSAASARLVRASRADVNPVVQEVKRESSVSFDVSKPESTTSVKRKRVKRELEVNGEPPKKQVGIVPDIEDFRYDRTKAVTSSIKATLSSVKVEGKLRVSSVIKAKAPENWEAVLGGIKNMRLSGQAPVDTKGCEKAGSLLPPKERRFAVLISTMMS

SEQ ID NO: 36989 - DNA, 688 bp, Panicum virgatum
  misc_feature: Ceres CLONE 1987935
  misc_feature: Encodes the peptide sequence at SEQ ID NO. 36990
atcctctccactcacaactccatgcctccatttccccctttcttcctataaagcgtctcggtcccgggccgagaaacccgccataaaccgccgccgccgccgcctcctcgccgcaatgcagatgcggcgcctcgccgcgctcctcgtcgcggccctcctcgccgcgccgcccgccgtcgcggcgtggcgcccgtggcctccgctgcgcaacggcacggcggtggaggggctcggcgcgtccaagaagttcgaggggtcgtccgagttcgtgaagctgcagtaccacatgggccccgtcctggcggcgtccatcacggtgcacccgatctggtacggcccctggccggcgccgcagaagcgcaccatccgcgccttcctccgctccctcgcgccgccgccggcggaggagtcccggatcccgcgcccctccgtggcggcgtggtggcgcaccgtgcggctgtacacggaccagaccggcgccaacgtgtcggcggcggtgtccctgggcgccgagaagtcggacgcgcgcatgtcccgcggcgcgcgcctgtcgcggatggacatccaggccgtggtccgcgacgccgtggccgcgcgcacccggcctctccccgtcgacgccggcggcgtctacctcgtgctcacctcgccggaggtgatggtggaggacttctgcgggcaggtctgc

SEQ ID NO: 36990 - protein, 188 aa, Panicum virgatum
  misc_feature: Ceres CLONE 1987935
  misc_feature (52)..(188): Pfam Name: Phi_1 Pfam Description: Phosphate-induced protein 1 conserved region
  misc_feature: Functional homolog of the protein sequence given in SEQ ID NO 51465
  misc_feature: Useful for biocontainment applications
MRRLAALLVAALLAAPPAVAAWRPWPPLRNGTAVEGLGASKKFEGSSEFVKLQYHMGPVLAASITVHPIWYGPWPAPQKRTIRAFLRSLAPPPAEESRIPRPSVAAWWRTVRLYTDQTGANVSAAVSLGAEKSDARMSRGARLSRMDIQAVVRDAVAARTRPLPVDAGGVYLVLTSPEVMVEDFCGQV

SEQ ID NO: 36991 - DNA, 1299 bp, Panicum virgatum
  misc_feature: Ceres CLONE 1987943
  misc_feature: Encodes the peptide sequence at SEQ ID NO. 36992
cgcgtctaagaaccctaacagtagagagaagctaggagctagcgctgtgcgcgacactgagctgagagaaggcaccgccggccggaccatcatgccgaaggaggatgtgagcatcgaggaggatgtgagcatcgaggcggcggccgccaagaaggcgccgtactgggacccgccgccggcgccggtgctggacacgagcgagctgcagaagtggtcgctgtaccgcgcgctcatcgccgagttcgtggccaccctcatcttcctctacgtgagcatcgccaccgtcatcgggtacaaggcccagtccaaaaacctgcagacgtgcaccggcgtcgggttcctcggcgtctcctggtccttcggcgccaccatcttcatcctcgtctactgcaccggcggcgtctcaggcgggcacatcaacccggccgtgacgttcgggctgttcgtggggcggaagctgtcgctggtgcgcaccgtgctgtacatcgtggcgcagtgcctgggcgccatctgcggcgcgggcatggtgaagggcatcgtggggggcgatctctacgacaccttgggcggcggcgcgaacgcggtcggcagcgggttctccgtcggggcggccctcggcgccgagatcgccggcacgttcgtcctcgtgtacaccgtcttctccgccaccgaccccaagcgcaccgcgcgcgactccttcatcccggtgctggtgccgctgccgatcgggttcgcggtgttcgtggtgcacctggcgaccatccccatcaccggcacgggcatcaacccggcccggagcctcggcgccgccgtcatgtacaacaaggcatggagttaccactggatcttctggatcgggccggcgatcggggcgacggtggcggcgctgtaccacaagctcgtgctgcgcggggaggccgtcaaggcgctcggctccttcaggagcaccagcgccacggtgtgagccagcatgcccagcggcgaatgaagcttttgaaactggcggctcacgttgccgttgggcaagcttcgggcatacctgcacctttccctccccatacccataagttaattatccaatcactaccctatccataacctgcccactttaatttgtctatacccattggataacggggaaatatatcatggatatgggcaaggccatatagcataggatatgaataacaataaagcctgatccgttacgtacagcactaaagcagcgagcctgcagagcaattgttgcttgatgcttatgatacaataatctgagataataaataatatttaaaagtg

SEQ ID NO: 36992 - protein, 290 aa, Panicum virgatum
  misc_feature: Ceres CLONE 1987943
  misc_feature (37)..(268): Pfam Name: MIP Pfam Description: Major intrinsic protein
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
  misc_feature: Functional homolog of the protein sequence given in SEQ ID NO 50195
  misc_feature: Useful for making plants with modulated water use efficiency
MPKEDVSIEEDVSIEAAAAKKAPYWDPPPAPVLDTSELQKWSLYRALIAEFVATLIFLYVSIATVIGYKAQSKNLQTCTGVGFLGVSWSFGATIFILVYCTGGVSGGHINPAVTFGLFVGRKLSLVRTVLYIVAQCLGAICGAGMVKGIVGGDLYDTLGGGANAVGSGFSVGAALGAEIAGTFVLVYTVFSATDPKRTARDSFIPVLVPLPIGFAVFVVHLATIPITGTGINPARSLGAAVMYNKAWSYHWIFWIGPAIGATVAALYHKLVLRGEAVKALGSFRSTSATV

SEQ ID NO: 36993 - DNA, 682 bp, Panicum virgatum
  misc_feature: Ceres CLONE 1987951
  misc_feature: Encodes the peptide sequence at SEQ ID NO. 36994
acgctctactgccgatcggagcccagtttcttgtcaccggccagcgaccatgggcgccgccgcagctctcctcgagcaaaaccagcgcgccgccgtgctggccatcggcacagccaacccggcgaactgcatcctccaagacgagttccccgactggtacttccgggtcaccaggagcgagcaccacccaatgctcaaggccaagatgaagagaatatgtgagaaatcaggcatccggaagcgtcatttccacacagaggagatgatcggcagccacccggagctcctggaccgtgcccttccgtccctcagcgcacggctgcgcatcaccgcgaacgccctgccggagctcgccgccgccgcggcggagaaggcgatcgcggagtggggccgtccggccaccgacatcacgcacctcgtcttcagcacaaactccagcgccggcctgccgggcccggacgtccgcctggcggcgctcctcggcctccaccccaccgtgcagcgcaccacgctctacctccacggctgctccgccggcgccgccgcgttgtccctcgccaaggacctcgccgagaacgacgaccgggcgcgggtgctggtggtctgcgccgaagccgtcgtcatcggcttcggcgcccccgacgaggctaaccccgagggcctagtcgtcaactccctgttc

SEQ ID NO: 36994 - protein, 210 aa, Panicum virgatum
  misc_feature: Ceres CLONE 1987951
  misc_feature (3)..(210): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature: The sequence is a functional homolog of SEQ ID NO 2 in US patent 7202397
MGAAAALLEQNQRAAVLAIGTANPANCILQDEFPDWYFRVTRSEHHPMLKAKMKRICEKSGIRKRHFHTEEMIGSHPELLDRALPSLSARLRITANALPELAAAAAEKAIAEWGRPATDITHLVFSTNSSAGLPGPDVRLAALLGLHPTVQRTTLYLHGCSAGAAALSLAKDLAENDDRARVLVVCAEAVVIGFGAPDEANPEGLVVNSL

SEQ ID NO: 36995 - DNA, 538 bp, Panicum virgatum
  misc_feature: Ceres CLONE 1987958
  misc_feature: Encodes the peptide sequence at SEQ ID NO. 36996
actcccactcccctcactcactcccacgcgcacgcaaaccaccgcgctccacgccccacccccgcaaaatgcgccgccccctcttcgccgacgggctccccctcctcctcctccacctcctcctcgccctcgcggccgccacaacgacggcggcggccgtggcgaaggctcccgccgcgccgccgccgaacgtgacggcggagatggccaagggcgggtgcaaggcgttcgcggacctgatcgcggcgtcccccgacgcggcgtccacgtaccagtcggccgtggagggcggcatgacggtgttctgcccctccgacgacgccgtcaaggcgttcctgcccaagtacaggaacctcaccgccgacggcaaggccgagctgctgctgttccacgccgtgccggtgcactactcggtggggagcctcaagtccaacaacgggcccatgaacacgctcgccaccgacggcgccgcccacaactacaacttcacgctgcagaaccagggcgacgtcgtcaccatcaagaccgcggcgtccgc

SEQ ID NO: 36996 - protein, 156 aa, Panicum virgatum
  misc_feature: Ceres CLONE 1987958
  misc_feature (50)..(152): Pfam Name: Fasciclin Pfam Description: Fasciclin domain
  misc_feature: Functional homolog of the protein sequence given in SEQ ID NO 51534
  misc_feature: Useful for making plants with altered cell wall content and/or composition
MRRPLFADGLPLLLLHLLLALAAATTTAAAVAKAPAAPPPNVTAEMAKGGCKAFADLIAASPDAASTYQSAVEGGMTVFCPSDDAVKAFLPKYRNLTADGKAELLLFHAVPVHYSVGSLKSNNGPMNTLATDGAAHNYNFTLQNQGDVVTIKTAAS

SEQ ID NO: 36997 - DNA, 631 bp, Panicum virgatum
  misc_feature: Ceres CLONE 1987971
  misc_feature: Encodes the peptide sequence at SEQ ID NO. 36998
acatcacacacacaaaacagaacaaagcagctgagcaagtagtacttgtgatctcagcatcgacatggctgccgccaccatggccctttcctcccgcgctctggccggcaagccggcaacccgcgacgtgttcggcgagggccgcatcacgatgcgcaagaccgggggcaagcccaagcaggttgccgcatccggcagcccgtggtatggacctgaccgcgtcctctacctcggcccgctctctggtgagcccccgagctaccttaccggcgagttcccgggtgactacgggtgggacacggccggcctgtctgccgatccggagaccttcgccaagaaccgtgagctggaggtgatccactgccggtgggccatgctcggtgctcttggctgcgtgttccccgagctgctcgcccgcaacggcgtcaagttcggcgaggccgtgtggttcaaggcgggctcccagatcttcagcgagggcgggctggattaccttggcaacccgagcctgatccacgcgcagagcatcctggccatctgggcatgccaggtcttgctcatgcgcgccgtcgagggctaccgcgtcgcgggcggcccgctcggagaggtcgtcgacccgctctacccgggc

SEQ ID NO: 36998 - protein, 188 aa, Panicum virgatum
  misc_feature: Ceres CLONE 1987971
  misc_feature (62)..(187): Pfam Name: Chloroa_b-bind Pfam Description: Chlorophyll A-B binding protein
MAAATMALSSRALAGKPATRDVFGEGRITMRKTGGKPKQVAASGSPWYGPDRVLYLGPLSGEPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVLLMRAVEGYRVAGGPLGEVVDPLYP

SEQ ID NO: 36999 - DNA, 1726 bp, Panicum virgatum
  misc_feature: Ceres CLONE 1987976
  misc_feature: Encodes the peptide sequence at SEQ ID NO. 37000
aaacagcctccgcccaccaccccgtctgctaaagctcaccccctccgccccccaacgcgcccgacctcacccaaatccccccacctccctcccacccttgctccgcggcgttctatggcatacacctcctccctccacctccccaagcacctgctcctgcccaacccccgccggaccaggcacaggtcctcctcctccgtctccttcgtccccgccgccgcggccagggccaacggcgtggacgggcgcgcgcccgagaagaagccgccgccgcccaaaggcaaggcgcgcatcaacggcgtgaacggcaagaagggggcgaacgggcacgtcaacggcaacaagggggtgaacgggcacgtcaacggccatgccgaccggatccacctctcggtgagcacgggcggcggcggcgcgggggcacaggacggctccgggctccgcgtggcgttccagggcgcgcccggcgcgtacagcgagttcgcggccaagacggcgctgcccgggtgcgacacggtcccgtgccggaccttcgcagacgcgctggcggccgtggagcggggcgccgccgaccgcgccatcctccccgtggagtccaccatggagggcaccgagctgcggaactacgacctgctgctgcggcacggcctggtggtggcgcaggagatcaacctcttcgtgcactactgcctcctcgccatgccgggggtgcgcgccgccgaggtgcgccgcgtcatcagccacccgatggcgctcgcgcactgcggccgcgcgctggcgcgcctcggggtggaccgcgaacccgtcgaggacaccgccggcgccgtcgagatgctgcgctccaaccggatgctcgacaccgccgccatcgccagcccgcgcgccgccgacctgtacggcctcgacgtgctcgcgcacggcctccaggacgagtcctggaacgtcacgcgcttcctgctcctctccaggccgccgtcgcccgtcgcgctgcacgtcgacgccgacgccaagaccagcatggtcgtcgcgcaccggggcggctccatgatggtcctgctcaaggtgctctccgccttctcctcccgcaacatcaacctcaccaagctggaggtcatcaacaacgacggcgacgccgccggggccggcgcccgcccgccggtcatgatcctggacacgagcgcccggggcgcgcccacgctgcgcgccttcccgcacgtcctgtacgtcgactgcgcgggcgccgcgcacgacccgcgcgtccgcgaggccatccaggagatcgagaagttcgccgtgttcgtgcgcgtgctcggctgctacgccgccgactccaccgtctacgacctgcaatgagggaggggaggaggaggacatgatcgccgtggtgcggatcgggactgctggaatctatagctagttgactggcggcaatctcgctgttaaaattgggccaagctatcggatctaccagcactcagtaactagctccagcgagattagttgtttcgcttgctgctgctgctgcgtaatttttatacatacagatgcaataagaatcttcctattgctgctcgattatattagatgtgtgagtgtttgtgcatagattcaggcttgatgatgatgatgctagctcaagggtgtttgtactaagaagtcctgttggtcatgaccggatcgtttgtaatcttcttgtactaaaatttcggcgcaagctttcagtttt

SEQ ID NO: 37000 - protein, 412 aa, Panicum virgatum
  misc_feature: Ceres CLONE 1987976
  misc_feature (111)..(288): Pfam Name: PDT Pfam Description: Prephenate dehydratase
  misc_feature: SWISSPROT Homolog: EC 4.2.1.51 Prephenate dehydratase
MAYTSSLHLPKHLLLPNPRRTRHRSSSSVSFVPAAAARANGVDGRAPEKKPPPPKGKARINGVNGKKGANGHVNGNKGVNGHVNGHADRIHLSVSTGGGGAGAQDGSGLRVAFQGAPGAYSEFAAKTALPGCDTVPCRTFADALAAVERGAADRAILPVESTMEGTELRNYDLLLRHGLVVAQEINLFVHYCLLAMPGVRAAEVRRVISHPMALAHCGRALARLGVDREPVEDTAGAVEMLRSNRMLDTAAIASPRAADLYGLDVLAHGLQDESWNVTRFLLLSRPPSPVALHVDADAKTSMVVAHRGGSMMVLLKVLSAFSSRNINLTKLEVINNDGDAAGAGARPPVMILDTSARGAPTLRAFPHVLYVDCAGAAHDPRVREAIQEIEKFAVFVRVLGCYAADSTVYDLQ

SEQ ID NO: 37001 - DNA, 733 bp, Panicum virgatum
  misc_feature: Ceres CLONE 1987980
  misc_feature: Encodes the peptide sequence at SEQ ID NO. 37002
aaaccattcccctccccctttctaggagagagagaataaaagataagctcagctcagctagcaagcaagaggtggagatgcggagcccacgaggaggagggcgcgcccaggagcacgtcgacctgatcccgggcatccccgacgacgtcgccgtcgactgcctggcgcgcgtgccccacgcgtcccaccgcgcgctgcgccgtgtctgccgcggctggcggagcgccgccgccgcgccggccttcgccgcggcgcgcgccgccgcgggcgccaacgaggacctcgtctacatgctgcagttcgggaacccctccgccgccgctgacgccgacgacggcgggcccaaggacggcggtgcgccgcccagcgcgcccgcctacggcgtcgcggtctacaacgtgaccacgggcgagtggcgccgggagcgcggcgcgccccccgtgctgcccgtgttcgcgcagtgcgccgcggtgggcacccgcgtcgcggtgctcgggggctgggacccgcgcaccttcgagcccgtcgccgacgtgcacgtcctcgacgccgccaacggcgcgtggcgccgcgccgcgccgatgcgctcggcgcggtccttcttcgcctgcgccgaggccggcgggaagatctacgtcgccggcgggcacgacaagcacaagaacgcgctcaagacggccgaagcctacgacgccggcgccgacgcctgggatccgctcccggacttgtcgga

SEQ ID NO: 37002 - protein, 218 aa, Panicum virgatum
  misc_feature: Ceres CLONE 1987980
  misc_feature (172)..(218): Pfam Name: Kelch_1 Pfam Description: Kelch motif
  misc_feature (15)..(62): Pfam Name: F-box Pfam Description: F-box domain
MRSPRGGGRAQEHVDLIPGIPDDVAVDCLARVPHASHRALRRVCRGWRSAAAAPAFAAARAAAGANEDLVYMLQFGNPSAAADADDGGPKDGGAPPSAPAYGVAVYNVTTGEWRRERGAPPVLPVFAQCAAVGTRVAVLGGWDPRTFEPVADVHVLDAANGAWRRAAPMRSARSFFACAEAGGKIYVAGGHDKHKNALKTAEAYDAGADAWDPLPDLS

SEQ ID NO: 37003 - DNA, 172 bp, Panicum virgatum
  misc_feature: Ceres CLONE 1987983
  misc_feature: Encodes the peptide sequence at SEQ ID NO. 37004
tgctgggagatcaactgccgctcgcatggcagtcgggctgaaggccatatgcctgctgacgggaccaatggaggaggagatgatgctttctacaccgtctgcgaggagactggccctaggaagcacatccggagtgctatatttgtagaccttgagccctctgcgagttatg

SEQ ID NO: 37004 - protein, 57 aa, Panicum virgatum
  misc_feature: Ceres CLONE 1987983
  misc_feature: Functional homolog of the protein sequence given in SEQ ID NO 50141
  misc_feature: Useful for making plants with altered cell wall content and/or composition
CWEINCRSHGSRAEGHMPADGTNGGGDDAFYTVCEETGPRKHIRSAIFVDLEPSASY

SEQ ID NO: 37005 - DNA, 743 bp, Panicum virgatum
  misc_feature: Ceres CLONE 1987986
  misc_feature: Encodes the peptide sequence at SEQ ID NO. 37006
accaatatcggatgcttggcttgccaatccggctctgcctgatgacattctgaaggaagctgttcctggaaacataaggagggctgagcatttccttgctgtattgcgccggcttgtgagattccttgatggacggctggaaacagaaaacgttgagaatgaaatgcccgttgcctttgttgcgtcaatccactcccaggctggaatcgaccagaaaatgctcaggttttgttatgaccggctacactccctaatgatgacactagagataaccgatacagatgagtttatgcacattcagaccatctgtgactttgccacattgattggaacttacacacgaggcttttccataataatagaaccatatgacgaaagaatgcctgacattcgtgatcctgtgattcagctgagctgtcatgatgcttcactcgcaataagacctgtttttgatcgttttgaaacagttgtgatcacttctggaactctcagcccaattgatctttatcctcgtctcttgaattttaatcctgtgataagcagaagtttcacaatgtccttaacaagggattgtatttgtcccatggtcttgactcgaggcagtgatcaactacctgtgagtacaaagtttgatatgcgtagtgatcctggtgtggtgagggatttatgccgcctcttgctggaaatggcttctgctgttccagatggcatagtttgcttttttgtcagttacttctatatgg

SEQ ID NO: 37006 - protein, 247 aa, Panicum virgatum
  misc_feature: Ceres CLONE 1987986
  misc_feature: The sequence is a functional homolog of SEQ ID NO. 2 in the 7,202,396 US patent
  misc_feature: Functional homolog of the protein sequence given in SEQ ID NO 51535
  misc_feature: Useful for making plants with modulated heat sensitivity
PISDAWLANPALPDDILKEAVPGNIRRAEHFLAVLRRLVRFLDGRLETENVENEMPVAFVASIHSQAGIDQKMLRFCYDRLHSLMMTLEITDTDEFMHIQTICDFATLIGTYTRGFSIIIEPYDERMPDIRDPVIQLSCHDASLAIRPVFDRFETVVITSGTLSPIDLYPRLLNFNPVISRSFTMSLTRDCICPMVLTRGSDQLPVSTKFDMRSDPGVVRDLCRLLLEMASAVPDGIVCFFVSYFYM

SEQ ID NO: 37007 - DNA, 557 bp, Panicum virgatum
  misc_feature: Ceres CLONE 1987994
  misc_feature: Encodes the peptide sequence at SEQ ID NO. 37008
gagcgcgcctgtcacgcacccattgggcgcacgcagggcggggtttttagctggcggcgggcggagcgggatcggagacgacgggatcgccggccatggagtcagcaacggcggccgtccgcggcgccggcgcgtcgctcgcgcgggcccgggccgcgttcgtctgcgggggcggcgcgcgggtgccgcggcgcgtggtgggggctgttggcctcgcggcgcgcggacgccggcggagggcgctcgtcaccgtggcctcgctccacgagccgctcccgtcgcgcgcgcacgagggtcacgtaccggcggcgccgcaagctgatgaggaggaggtccatgggattggctctgctgcgcctgagacctcgtctcctccagttgtttcagggaagacagtgcgtgtcagattcgtgctggatgagcagtgcgcgctggaccagagcgtctacctcgctcgcgacgacccggcgctcggcctctgggatccggcgaacgcgatgcctctggagttggcggaaagccacggctggatcttagagatggatttacctgccaac

SEQ ID NO: 37008 - protein, 153 aa, Panicum virgatum
  misc_feature: Ceres CLONE 1987994
  misc_feature: SWISSPROT Homolog: EC 3.2.1.1 Alpha-amylase
MESATAAVRGAGASLARARAAFVCGGGARVPRRVVGAVGLAARGRRRRALVTVASLHEPLPSRAHEGHVPAAPQADEEEVHGIGSAAPETSSPPVVSGKTVRVRFVLDEQCALDQSVYLARDDPALGLWDPANAMPLELAESHGWILEMDLPA

SEQ ID NO: 37009 - DNA, 571 bp, Panicum virgatum
  misc_feature: Ceres CLONE 1987998
  misc_feature: Encodes the peptide sequence at SEQ ID NO. 37010
ccctctcctctccttcccttcccttccacccggcccgatctctcgccagctttgcggggaaacagagccgccagcaggcaaacccctctctccgcctcgctcctcctcctcctcctcaaaaccctaaccctcgtccccgatggcgtcgccgccgccgcccgccggagccgccgcgcccggatcgccgccgccggcgcaagtggtgggcaacgcgttcgtgaatcagtactacaacatcctgcaccagtcgccggagctcgtccaccgcttctaccaggacgccagccgcctcggccggcccgccggcgcctccgccgacggcatggacaccgtcaccaccatggacgcgattagcgacaagatcgtgtccatgggcatcacgcgcgcggagatcaaggcggtggacgcgcaggagtcgctctgcggcggcgtcaccgtgctcgtcatgggccatctcacggggaggaccggcgtcggccgcgagttcgtgcagtccttcttcctcgcgccgcaggagaagggcttcttcgtgctaaacgacatactgcgctacgtcggtggcggggaaggg

SEQ ID NO: 37010 - protein, 143 aa, Panicum virgatum
  misc_feature: Ceres CLONE 1987998
  misc_feature (22)..(138): Pfam Name: NTF2 Pfam Description: Nuclear transport factor 2 (NTF2) domain
  misc_feature: Functional homolog of the protein sequence given in SEQ ID NO 51536
  misc_feature: Useful for making plants with modulated nitrogen use efficiency
MASPPPPAGAAAPGSPPPAQVVGNAFVNQYYNILHQSPELVHRFYQDASRLGRPAGASADGMDTVTTMDAISDKIVSMGITRAEIKAVDAQESLCGGVTVLVMGHLTGRTGVGREFVQSFFLAPQEKGFFVLNDILRYVGGGE

SEQ ID NO: 37011 - DNA, 1152 bp, Panicum virgatum
  misc_feature: Ceres CLONE 1988001
  misc_feature: Encodes the peptide sequence at SEQ ID NO. 37012
cagcccaggaggatttggagcctcatgtcacaacaagggatgatcggcacacctatgcttctgcaggtgaagatgataatgaaacccccctggtcaagaggcccaggatgggcacatctgagttcggacaccaactgcagcctggaccattgcaacccactggttccgcccaagctatcggtgatgctctcatcttgaaagaacccaaacctgagccacaaatcaatgtagcacaagtcaaagcttgtcgagatgctcgagctacctccgatgccatagacttcaacgttggctcttcaggtgctggtgcaagaggcagagtagtcaaccaagctcaaagtcttgatagcagcctacaagcggtcccaatgggcaacaacagggtagtgtctacagttcaaaatactcaggatgcatcttctgtggaggttgatgtggcttcttccaccaatggtgaggtgaagatgtcattgaaatgcaacttggatctttcaaaattcagcatcagtatggaggatgttttcaaaatggtggaggagaagtgccttcactcttacaaggtgctgcctcctgatttttctattggcaagctgatgagtgaggtgtgccaatctgttgcacagattgggtactaggcatgcygawgttcatagcaacaktggcggcttgcataaagatgctgttgctcctattgtgcagccaattgcttgtaaagctgctgtgggtaccaatgataactgtactggaaggtcatcagtgctagaatcctcagaaccttgtttgcagaattctattgttgcttgggatcctgagttaacaaattgtaaacgaaggacaacccatgatgttactgatatatccaaaggggaagaacggataaggataaccgtactaaatgaatttggcagcgagacctgtcctccatccttcttgtacataccaagaaatcttgtcttcaaaaatgcttatgtgaacatctcgattgctcggattggcgatgaagactgctgtgctcattgttctggcaactgtttgtcagcgtcacttccatgtgcttgtgcaagagcaactgggggtgattatgtgtatacacctgagggcctgcttaagacagcattcattgatgaatggacctccgttaatcttttccca

SEQ ID NO: 37012 - protein, 210 aa, Panicum virgatum
  misc_feature: Ceres CLONE 1988001
  misc_feature: SWISSPROT Homolog: EC 2.1.1.43 Histone-lysine N-methyltransferase
AQEDLEPHVTTRDDRHTYASAGEDDNETPLVKRPRMGTSEFGHQLQPGPLQPTGSAQAIGDALILKEPKPEPQINVAQVKACRDARATSDAIDFNVGSSGAGARGRVVNQAQSLDSSLQAVPMGNNRVVSTVQNTQDASSVEVDVASSTNGEVKMSLKCNLDLSKFSISMEDVFKMVEEKCLHSYKVLPPDFSIGKLMSEVCQSVAQIGY

SEQ ID NO: 37013 - DNA, 586 bp, Panicum virgatum
  misc_feature: Ceres CLONE 1988001-R
  misc_feature: Encodes the peptide sequence at SEQ ID NO. 37014
cttggaattgatggaacgttttatgggaacgttgggcgattcattaaccacagatgctatgatgcaaatttagttcagatcccagttgaagttgagacacctgatcatcattattaccatctggcatttttcacaaccaagaaagtggaggcatttgaggagttaacatgggattatggcattgattttgatgatgtggatggcccctgtaaagcattccgaggcatgtgcggaagcagatactgtcgtgatccgcggagtacaaggaggatggatagagcagctgggcgaaactaggggggagcctggactaccaactttggcttggagactgtattagatggggactgactgatgatatgattgatattttggatgcaagcctgaggctgaggggttgagcaacattagctacctgtttatgtttattggcatgtagatgtactccgtagtagtagtgtgaagaaagaacccctccaattaacttgtgccatgcgtatgcattttacctggcatgatattccatgttgggaccatgatcttctgagctactaataacaatagtaactggagtatttatctctgc

SEQ ID NO: 37014 - protein, 98 aa, Panicum virgatum
  misc_feature: Ceres CLONE 1988001-R
  misc_feature: SWISSPROT Homolog: EC 2.1.1.43 Histone-lysine N-methyltransferase
LGIDGTFYGNVGRFINHRCYDANLVQIPVEVETPDHHYYHLAFFTTKKVEAFEELTWDYGIDFDDVDGPCKAFRGMCGSRYCRDPRSTRRMDRAAGRN

SEQ ID NO: 37015 - DNA, 1184 bp, Panicum virgatum
  misc_feature: Ceres CLONE 1988021
  misc_feature: Encodes the peptide sequence at SEQ ID NO. 37016
tgcctccaaaacccaccccgctccaattcacacccaatcgccattccaagcagctcacagctagctagctcccattccgatccatcaagagctgaaggcgccaagcagcagcagcagcagcagcagccatgtcggaggtgtcggtgatgaacccgggcgaggaggagccgcgcctggtgttgccgccggggttccgcttccaccccaccgatgcggaggtcgtcgtcgactacctcacgcccaaggcgctcgacggcagcttctcctgcgtcgtcatctccgacgtcgacctcaacaagaccgagccgtgggatctcccgggcaaggcgaagatgggggagaaggagtggtacttcttctgccacaaggaccgcaagtacccgacggggatgcgcaccaaccgggccaccgccagcgggtactggaaggcgacggggaaggacaaggagatctaccgcggccgcggcgtcctcgtcggcatgaagaagacgctcgtcttccacacggggcgcgccccgcgcggggagaagacgccatgggtgatgcacgagtaccgcctcgagggcaagctgccgcctaacctcccccgatccgccaaggacgaatgggctgtctgccgcgtgttcaacaaagacttggcggccaagcagcctggccaaatggcgccggccgccggcccggagccgaccatccccttcgacttggacgacatctttggtgtgccgccgctcgaggactcggagtacgccgtcgacgacctcctcctcgacttcaattccagctccggcgacgccgcgggcatgggcggcggtggcggctaccaagtcatcaaggcggagcagcaggcgctccaggtgccggcggcgagcaacccgcgcggggccgcggagcaggcgatacgtgcgcactgcaagccggaggcggcgccgtacctggaggtggacgacctactgctggacgagggattcatggactactccaacatgtggaactgctagctaggcgtcgccggcggcctagccatatacagtagtagttcgatttggtcaccggccggccggccggtcgattaattattacagtagttgacttattacagctgaggtttgggttcgtgtatgtatgtatcagccgatcgatggatcgagtctggtagctgatcgatgtggtgtttaggggtgggg

SEQ ID NO: 37016 - protein, 289 aa, Panicum virgatum
  misc_feature: Ceres CLONE 1988021
  misc_feature (18)..(145): Pfam Name: NAM Pfam Description: No apical meristem (NAM) protein
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: Functional homolog of the protein sequence given in SEQ ID NO 50639
  misc_feature: Useful for making plants with altered terpenoid content
  misc_feature: Functional homolog of the protein sequence given in SEQ ID NO 51052
  misc_feature: Useful for making plants with altered lignin content
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: Functional homolog of the protein sequence given in SEQ ID NO 50327
  misc_feature: Useful for making plants with modulated light quality sensitivity
  misc_feature: The sequence is a functional homolog of SEQ ID NO 476 in the 10/666,642 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Functional homolog of the protein sequence given in SEQ ID NO 51291
  misc_feature: Useful for making plants with altered cell wall content and/or composition
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: Functional homolog of the protein sequence given in SEQ ID NO 50322
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Functional homolog of the protein sequence given in SEQ ID NO 50908
  misc_feature: Useful for making plants with modulated biomass
  misc_feature: Functional homolog of the protein sequence given in SEQ ID NO 50325
  misc_feature: Useful for making plants with modulated water use efficiency
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Functional homolog of the protein sequence given in SEQ ID NO 50326
  misc_feature: Useful for making plants with modulated light quality response
  misc_feature: Functional homolog of the protein sequence given in SEQ ID NO 50642
  misc_feature: Useful for biocontainment applications
  misc_feature: The sequence is a functional homolog of SEQ ID NO 1729 in the 11/479,226 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 891 in the 10/374,780 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: Functional homolog of the protein sequence given in SEQ ID NO 50845
  misc_feature: Useful for making plants with altered alkaloid content
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 612 in the 11/435,388 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 854 in the 11/435,388 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 1452 in the 10/666,642 US patent application
  misc_feature: The sequence is a functional homolog of SEQ ID NO 158 in the 10/225,066 US patent application
  misc_feature: The sequence is a functional homolog of SEQ ID NO 226 in the 10/666,642 US patent application
  misc_feature: The sequence is a functional homolog of SEQ ID NO 242 in the 10/714,887 US patent application
  misc_feature: The sequence is a functional homolog of SEQ ID NO 242 in the 11/435,388 US patent application
  misc_feature: The sequence is a functional homolog of SEQ ID NO 280 in the 10/374,780 US patent application
  misc_feature: The sequence is a functional homolog of SEQ ID NO 68 in the 10/225,068 US patent application
MSEVSVMNPGEEEPRLVLPPGFRFHPTDAEVVVDYLTPKALDGSFSCVVISDVDLNKTEPWDLPGKAKMGEKEWYFFCHKDRKYPTGMRTNRATASGYWKATGKDKEIYRGRGVLVGMKKTLVFHTGRAPRGEKTPWVMHEYRLEGKLPPNLPRSAKDEWAVCRVFNKDLAAKQPGQMAPAAGPEPTIPFDLDDIFGVPPLEDSEYAVDDLLLDFNSSSGDAAGMGGGGGYQVIKAEQQALQVPAASNPRGAAEQAIRAHCKPEAAPYLEVDDLLLDEGFMDYSNMWNC

SEQ ID NO: 37017 - DNA, 769 bp, Panicum virgatum
  misc_feature: Ceres CLONE 1988039
  misc_feature: Encodes the peptide sequence at SEQ ID NO. 37018
  misc_feature (630)..(630): n is a, c, t, g, unknown, or other
  misc_feature (641)..(641): n is a, c, t, g, unknown, or other
agcaactcgaatcaccaaaccgaggagaccaaacaggcggggttgagcaacctcccggatctccagccagcctcctccgcgtcgccgccgccgcagcgatggccaccccggacctgctcttcaacctgcggaacctcttctacctgggcgcctaccaggcggccatcaacaacagcgacgtcccgggcctcgacgccgacgccgccgccgagcgcgacgccatcgtcttccgcttctacatcgccctcggctcctaccagctggtgatcagcgagatcgactcctccgccgcgacgtcgctgcaggccgtcaagctgctcgcgctgtacctcaccggggacaaggaaggtgcaatctccagtctcaaggaatggttgagcgattcagcaattgggagcaatcctgttcttcgattgattgctggaattatatttatgcatgagcaggactataatgaggccctcaagcacacacactctggaggaactctggatttgcatgcattgaatgtgcagatcttcattaagatgcatcgttcagactatgctgagaagcaattgaagatcatgcaacaaattgatgaagaccatacactgacacaacttgcaaacgcatggttggacattgctngtggtggctcntagatccgtgaagcttacctcatattccaagactttgctgaaaagtacccaatgacagggatggttctgaatgggaaagcagtttgctgtatgcacatgggaaagctttgaggaggctgaaactctat

SEQ ID NO: 37018 - protein, 181 aa, Panicum virgatum
  misc_feature: Ceres CLONE 1988039
  misc_feature (3)..(181): Pfam Name: Coatomer_E Pfam Description: Coatomer epsilon subunit
  misc_feature (178)..(178): Xaa is any aa, unknown, or other
MATPDLLFNLRNLFYLGAYQAAINNSDVPGLDADAAAERDAIVFRFYIALGSYQLVISEIDSSAATSLQAVKLLALYLTGDKEGAISSLKEWLSDSAIGSNPVLRLIAGIIFMHEQDYNEALKHTHSGGTLDLHALNVQIFIKMHRSDYAEKQLKIMQQIDEDHTLTQLANAWLDIAXGGS

SEQ ID NO: 37019 - DNA, 771 bp, Panicum virgatum
  misc_feature: Ceres CLONE 1988040
  misc_feature: Encodes the peptide sequence at SEQ ID NO. 37020
agtgcggcaccgacctctttacacctcattcccacctccgccacctccgccgttgccaccccagcacgctctcgccgtcgccggggccctatatctcgcgcccctcgcctctcccaccctttctccatccgcccgctcgcctccctcctacgcttcgtgccgccgccgccgccacctcctttttcccgtttcagattgcagatcattcaacataaatggctgacggagaggacattcagccccttgtctgtgacaatggaaccggaatggtcaaggctggctttgctggagatgatgctccacgtgctgttttcccaagtatagttggtcgtccacgccacactggtgtcatggttgggatgggacagaaggatgcctatgttggtgacgaggcccaatccaagaggggtatcctgactttgaagtaccccattgagcatggaattgtaagcaactgggatgacatggaaaagatctggcaccacaccttctacaatgagctccgtgtagcaccagaagagcacccagttcttcttactgaggctcctcttaaccctaaagccaacagggaaaagatgacacagatcatgtttgagaccttcagtgttccagccatgtatgttgctatttcagccgtcctttcactatatgctagtgggcgaaccactggtatcgtcctggattctggagatggtgtcagtcacacagtgccaatctatgaaaggtatgctctgccgcatgccattctacgtctcgatcttgctggtaagg

SEQ ID NO: 37020 - protein, 185 aa, Panicum virgatum
  misc_feature: Ceres CLONE 1988040
  misc_feature (4)..(185): Pfam Name: Actin Pfam Description: Actin
  misc_feature: SWISSPROT Homolog: EC 2.7.10.2 Non-specific protein-tyrosine kinase
  misc_feature: Functional homolog of the protein sequence given in SEQ ID NO 50712
  misc_feature: Useful for making plants with modulated biomass
  misc_feature: Functional homolog of the protein sequence given in SEQ ID NO 50711
  misc_feature: Useful for making plants with modulated flowering time
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFSVPAMYVAISAVLSLYASGRTTGIVLDSGDGVSHTVPIYERYALPHAILRLDLAGK

SEQ ID NO: 37021 - DNA, 1976 bp, Panicum virgatum
  misc_feature: Ceres CLONE 1988055
  misc_feature: Encodes the peptide sequence at SEQ ID NO. 37022
agccgcatctcacccctcccctccccgcccagcggaactcaggcagcagcaacatactcaatcaaagtcttgatttttgtcgcttcctcgaccccccccccccccccccctcttcctcttcgtggaatcgcaagataacaaaatccacaacaagtcaaaacatcagggaatgctgaaagatgtgctttcatagaagagatttctgctgcgacatcaaggagctcgctgctccacaaaggctgctagcctgctcaactcttgatgtgagcgaccatcttagctgcatcaactctacaccattcagactccgacacgaccaaggcataagagttctgttcaccgtcatggaccatgacatgggggaggagggctaaatcattgcagtccatctgttcggcggtcaaaatatagccctgtgatttatacttttgaagacatggagggtagaggaaagatattgatggagcggtatgagttggggagattgctgggcaaaggtacatttggcagggtgcactatgcaagaaaccttgagtccaacaggagtgttgctattaagatgatggacaaggacaaagtgctcaaggtcgggctttcagagcatataaggcgtgagatcacaacaatgaggttggtggcacataagaacattgttgagctccatgaggtcatggcaacacgaaacaagatctactttgtcatggagtatgtgaaaggtggcgagctctttgacaagattgagaagagtggcaagctcacggagtctgctgcacacaagtacttcaagcagcttattagtgcggtggattactgccacagccgaggtgtctaccaccgggacctgaagcctgagaacctgctgctggatgaggatgagaacctgaaggtctctgattttggactctgtgcactttcggagtcaaaaaggcaagatggattgctccatacctcctgtggaacaccagcttatgtagctccagaggtgatcagcaagacaggctatgatggtgcaaaatcagacatctggtcttgtggtgttgttctatttgtccttgttgctggttatctccctttccaaggcccaaacttgatggagatgtatcggaagatacaacacggtgatttcaggtgccccagttggttttcgcacaaactcaagaagctgttgtacaagattctggaccccaacccaaacacaagaatttcaatccaaaaaataaaagagtctacctggttccgaaaaggccctgaggggacccgcacagttaaggagaaaattccctgtgagaatgccaccacaaatgctgctccaacactttctgtgaggcgtggaaagcatgcttatgaagatgtgaagctgatgcctgtgacaaacttaaatgccttcgaaattatctctttctcctcggggtttgatctttctggcttatttattcaaaaggaacatagaaaggaggcacgatttacttcagataagccagcctcagcaatcatctcgaagattgaagatgttgcaaagatgctgaatctcagggtaaggaagaaggataatggtgttatcaagattcaagggaggaaggagggaaggaatggtgtccttcagtttgacacagagatctttgagatcacaccgttccatcatcttgttgagatgaaacaaacaagcggtgattcacttgagtatcagaaattattcgaacaggacatccggccagcgctgaaggatatagtctgggcctggcatggagatgatcatcagcaattgcaggagtagctttggatgtctcagtttttgttccgaaaatttgttttcttcagctcagagtgattccgttttatatgtgtgtgtgtgttcttttttagaagctacattccttttttttatcagaagagaacctaatgagtggtggtgacctgaaccattaggttgtattccattgaacaataactgtggaaaagctgagttcttgagtttg

SEQ ID NO: 37022 - protein, 445 aa, Panicum virgatum
  misc_feature: Ceres CLONE 1988055
  misc_feature (12)..(267): Pfam Name: Pkinase Pfam Description: Protein kinase domain
  misc_feature (310)..(369): Pfam Name: NAF Pfam Description: NAF domain
  misc_feature: SWISSPROT Homolog: EC 2.7.11.1 Non-specific serine/threonine protein kinase
  misc_feature: Functional homolog of the protein sequence given in SEQ ID NO 50317
  misc_feature: Useful for making plants with modulated biomass
MEGRGKILMERYELGRLLGKGTFGRVHYARNLESNRSVAIKMMDKDKVLKVGLSEHIRREITTMRLVAHKNIVELHEVMATRNKIYFVMEYVKGGELFDKIEKSGKLTESAAHKYFKQLISAVDYCHSRGVYHRDLKPENLLLDEDENLKVSDFGLCALSESKRQDGLLHTSCGTPAYVAPEVISKTGYDGAKSDIWSCGVVLFVLVAGYLPFQGPNLMEMYRKIQHGDFRCPSWFSHKLKKLLYKILDPNPNTRISIQKIKESTWFRKGPEGTRTVKEKIPCENATTNAAPTLSVRRGKHAYEDVKLMPVTNLNAFEIISFSSGFDLSGLFIQKEHRKEARFTSDKPASAIISKIEDVAKMLNLRVRKKDNGVIKIQGRKEGRNGVLQFDTEIFEITPFHHLVEMKQTSGDSLEYQKLFEQDIRPALKDIVWAWHGDDHQQLQE

SEQ ID NO: 37023 - DNA, 1176 bp, Panicum virgatum
  misc_feature: Ceres CLONE 1988056
  misc_feature: Encodes the peptide sequence at SEQ ID NO. 37024
aaaccctaagcccaccactcccccctcctcagccgcagccgccgcctccaccacaacccagagctgcagcaccccctcagctcccccacccccgcatggccaccgacgccgttgcggcggcgatggctgcgtcctccctctgcgacgacctggagcccgccaccgtccgcaccggcatccgcgacgtcctggccgcgggcgccgcgcgggccggggagcgcgtcgtggtcgggggctgggtccggactggcagggagcagggtaagggcaccttcgcctttctcgagctcagtgacggctcctgtgcttccacgctccaggtgattgtcgacgccgccgtgcacccgctcgcgcgcctcaccgccacgggcacctccgtgctcgtcgagggcgagatcaaggaaccacccgaggggaccaagcagaacgtcgagctcaaggtcagccgcgtcctcgaggttggcgaggtcgacgccgccgcctacccgctgcccaagggcaaggtcaagctcacgctcgagaagctcagggatgtcgttcacctccgttcgcgcactaacacgattggagcagttgctagaattaggcatcagttagcctttgcaacacacaggttcttccacgagaatgcatttctctatgtacatacaccaataataactacaagtgactgtgagggtgctggtgagatgttccaagtaacaactttgtttagccaggctgaaaaaactgaaaaggaattgaaagagaaccctgcaccttctgaatctgaaatcgaggcagctaaagttattgtcaaggagaaaggagatgccgttgcacagcttaaagctgcaaaagccagcaaacaagacatatcagctgctgttgatgggctccatagggcaaaagaacatgtttcaaagctggaggagaggtctaagttaaagcctggtattccacgcagggatgatgggtcaatagcttttgaaaatgacttcttcaagcgtcaagcttttctgactgtgtctggacagcttcaggtcgagacatacgcatgtgctcttagtagcgtgtatacctttggaccaacattccgggcagaaaactcacatacatcacgacatttggcagagttttggatggttgaaccagaaatcgcatttgcaaacttgcaggatgatatgaactgtgcgg

SEQ ID NO: 37024 - protein, 360 aa, Panicum virgatum
  misc_feature: Ceres CLONE 1988056
  misc_feature (43)..(122): Pfam Name: tRNA_anti Pfam Description: OB-fold nucleic acid binding domain
  misc_feature: SWISSPROT Homolog: EC 6.1.1.22 Asparagine--tRNA ligase
  misc_feature: Functional homolog of the protein sequence given in SEQ ID NO 50673
  misc_feature: Useful for making plants with modulated biomass
MATDAVAAAMAASSLCDDLEPATVRTGIRDVLAAGAARAGERVVVGGWVRTGREQGKGTFAFLELSDGSCASTLQVIVDAAVHPLARLTATGTSVLVEGEIKEPPEGTKQNVELKVSRVLEVGEVDAAAYPLPKGKVKLTLEKLRDVVHLRSRTNTIGAVARIRHQLAFATHRFFHENAFLYVHTPIITTSDCEGAGEMFQVTTLFSQAEKTEKELKENPAPSESEIEAAKVIVKEKGDAVAQLKAAKASKQDISAAVDGLHRAKEHVSKLEERSKLKPGIPRRDDGSIAFENDFFKRQAFLTVSGQLQVETYACALSSVYTFGPTFRAENSHTSRHLAEFWMVEPEIAFANLQDDMNCA

SEQ ID NO: 37025 - DNA, 649 bp, Panicum virgatum
  misc_feature: Ceres CLONE 1988084
  misc_feature: Encodes the peptide sequence at SEQ ID NO. 37026
atctcatcctgaagcccctcctcgatccctttgaaaccaatccagcctcatttcccccgttgtccgtcgtcatggcgaagatcaagatcgggatcaacgggttcggcaggatcggcaggctcgttgccagggtggccctgcagagtgacgatatcgagctcgtcgccgtcaacgaccccttcatcaccaccgactacatgacatacatgttcaagtatgacacggtccacggaccgtggaagcaccatgatgtcaaggtcaaggactccaagacccttctttttggtgagaaggaggttgccgtctttggcagcaggaaccctgaggagatcccatggggtgaggctggcgctgagtacgttgttgagtctactggtgttttcactgacaaggacaaggctgctgctcacttgaagggtggtgctaagaaggttgtcatttctgctcccagcaaggacgcccccatgtttgttgttggtgtcaacgaaaaggaatacaagtctgacattgacattgtctccaatgctagctgcaccacaaactgccttgctccccttgctaaggtcatcaatgacaagtttggcattgttgagggtctcatgaccaccgttcatgctatcactgctacccagaagactgttgatgggcc

SEQ ID NO: 37026 - protein, 192 aa, Panicum virgatum
  misc_feature: Ceres CLONE 1988084
  misc_feature (4)..(154): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIGRLVARVALQSDDIELVAVNDPFITTDYMTYMFKYDTVHGPWKHHDVKVKDSKTLLFGEKEVAVFGSRNPEEIPWGEAGAEYVVESTGVFTDKDKAAAHLKGGAKKVVISAPSKDAPMFVVGVNEKEYKSDIDIVSNASCTTNCLAPLAKVINDKFGIVEGLMTTVHAITATQKTVDG

SEQ ID NO: 37027 - DNA, 1159 bp, Panicum virgatum
  misc_feature: Ceres CLONE 1988087
  misc_feature: Encodes the peptide sequence at SEQ ID NO. 37028
aacgccgatcgcgcgccgccgcaccgctccccctccccctccccacgcgccgccgccgctcccacccgtccaacccgccgcacaccccgcgcccaccaccgcttacccgctcttcggcactggccgtgctcggcgtccggtcccgacactggcggcatggctgccccgcgcgccgccgccgcgtcggcgaagcaggtgacgaggcggaacttcgcggaggccgtgcgggagctgcgctcccacctggagtcctgcgactacgttgccgtggcggcgcagaagacgggcgcccccaccgggtggcgccgcgcgctgccggtggacaccgcggagacggcgtacctcaaggcgaagctcgccgcggagtccttccagccgctccagatcgccgtctgtcccttcctgctgcgcaactcctctccctctgccctcgtcgcttacccgtacaattttcacatatttcctagagatgaacatcagttaggaatgccttcatacagtttctcctgtcaatcatcttatttatcaactatggctaatgatggctttgatttcaatatgtgcatttatgatggtatatcttatctatcaagggttcaagaatcctttgcaaggcaaaagatatttactcctcatcttcgtccactattgccatcacaaagcacatcagttgctgattcagttttcaaaagtagaataaagtcaaggataatgcactggagaaaaggatatgcagaaccaaacaaaaaggatgatggttcattgcttagttcccttagtagattgattttgggtggtgaaacatatggttccaggcccagtattagtattgatgtctgcagtgatcaccaagttcaactggtcttggaggcagtaaaccatatctctgatgaccttgtacctcttgttgttccggacaaagctggagctgctagggatgtgtgtgtgatatttactagttcgaaagaggataagaatcttttcctgatggatattatccagcactcacaagaggaaaaattccgtggatttcgagaagttactgatctactatcatcttcacaaaagccaattgtatcgtacaattgcttgaatgatatgacaatgatgcactccaaatttgttgcgcctcttccgccaaacatgcatgaatttatgt

SEQ ID NO: 37028 - protein, 334 aa, Panicum virgatum
  misc_feature: Ceres CLONE 1988087
  misc_feature (12)..(334): Pfam Name: CAF1 Pfam Description: CAF1 family ribonuclease
  misc_feature: SWISSPROT Homolog: EC 3.1.13.4 Poly(A)-specific ribonuclease
MAAPRAAAASAKQVTRRNFAEAVRELRSHLESCDYVAVAAQKTGAPTGWRRALPVDTAETAYLKAKLAAESFQPLQIAVCPFLLRNSSPSALVAYPYNFHIFPRDEHQLGMPSYSFSCQSSYLSTMANDGFDFNMCIYDGISYLSRVQESFARQKIFTPHLRPLLPSQSTSVADSVFKSRIKSRIMHWRKGYAEPNKKDDGSLLSSLSRLILGGETYGSRPSISIDVCSDHQVQLVLEAVNHISDDLVPLVVPDKAGAARDVCVIFTSSKEDKNLFLMDIIQHSQEEKFRGFREVTDLLSSSQKPIVSYNCLNDMTMMHSKFVAPLPPNMHEFM

SEQ ID NO: 37029 - DNA, 742 bp, Panicum virgatum
  misc_feature: Ceres CLONE 1988087-R
attttgaggtcaagttattggataagacatgctcagctttaatattccgcaattctggtactgcaatgcagttactaaaagaaataaactcagaaagcccatcattaaatgatttcttctcagaaggtctgaaagctgcgggttttgaagtgtacagaaaggtttgcaggttaggactttggcattcagatttagctgaggccctggagggtgtttcgtctgaagtagctgcttcaacactttctgagtgcaattcctctcagatatactggaatagttcgttgatgctagatctggaggagtatttggagtgctaaaacattgtctagcccctttgttatttcaagtctctcagattgatgagagcacccctcaagaaatctgctacaacagacaagtgaaattaaatgcgaacggggaaagcttgattatttgaggaacaaatctttgcctgggcacttaatatttgatctagggaaatttcatgtgtgccatatcagttataccagacagcatctcaactgttggtctagctttgaactgcaagcctcaatagaatttccaatattctggagcacatttcctgtacatcctttacattctatctaatttccaatttgaattgatcattgtttagcttcgttgatggcacgctgacttggatgacatcaatacagcgtaaggggacttcgttctaaacggataatatgccatagataagtaaagcggaagtctgaacgct

SEQ ID NO: 37030 - DNA, 639 bp, Panicum virgatum
  misc_feature: Ceres CLONE 1988109
  misc_feature: Encodes the peptide sequence at SEQ ID NO. 37031
actctagtctagtagtccgtgaaagaacgaaagcccagccaaccgacccccggcggattgccgactggattcctctcgtcccccaccaaacctcagcagcggagcggccgccgccgtcgagactgggggcatggcgacggcctcctccttcgctgctgtattcttcagcagcgccttcgccgcctgcctcgctgagccaaagtacgccttcagctgcaaaggaagacaccgtcactgccagcgccacttgcgtctgcagccataagtggaggaatgttggccacaatcttgtgcatcgccagggaggaaggtgtggctgcgctctggaagggcatcatccctggccttcaccgtcagttcctctacggcggcctccgcatcggcttgtatgagcctgtgaaagctttctttgtggggggtactgctgtgactgatgtcagtttactaagcaaaattcttgctgctcttaccactggtgtcatagcaattgttgtggcaaatccaactgatcttgtcaaagttagattgcaagctgatggaaaggctaacactgtcaagagaaactattctggagcccttaatgcatatgctacaataatcagacaggaaggcatcggagctttgtggactggccttggt

SEQ ID NO: 37031 - protein, 121 aa, Panicum virgatum
  misc_feature: Ceres CLONE 1988109
  misc_feature (56)..(121): Pfam Name: Mito_carr Pfam Description: Mitochondrial carrier protein
MLATILCIAREEGVAALWKGIIPGLHRQFLYGGLRIGLYEPVKAFFVGGTAVTDVSLLSKILAALTTGVIAIVVANPTDLVKVRLQADGKANTVKRNYSGALNAYATIIRQEGIGALWTGL

SEQ ID NO: 37032 - DNA, 679 bp, Panicum virgatum
  misc_feature: Ceres CLONE 1988121
  misc_feature: Encodes the peptide sequence at SEQ ID NO. 37033
atgatgatattcctggaagtgcaccgcacacccacgttgcagctctagacagagtccgtttctttcttgccgtagccgccgcgccgccccccagcgctccaactcctcctcctcgcgcggcccccctcctccacgtacctccagctccgtctccggcggcggcccccgcggcgaggatgaacgtgaagggcggcggccggatcccggcgcccccgccgggggccagcgcgctggtcaaggtcgccgtgctcggcggcgccgccgtgtacgccgccgtgaacagcctctacaacgtcgagggcgggcaccgcgccatcgtcttcaaccgcattcaggggatcaaggacaaggtataccctgaagggactcactttatgattccatggtttggacgaccaatcatttatgatgtacgcgctcgcccgaatcttgttgagagtacttctggaagcagggatcttcagatggtgaaaattggtcttcgtgtcctcacaaggccaatgccagagaggctaccccatatctacaggactctgggggagaacttcaacgagcgagttctgccttctatcatacatgaaacactgaaagctgttgttgcccaatacaatgctagccaactgatcacacagagagagactgtcagtagggagattaggaagatactgactgagagggg

SEQ ID NO: 37033 - protein, 167 aa, Panicum virgatum
  misc_feature: Ceres CLONE 1988121
  misc_feature: Functional homolog of the protein sequence given in SEQ ID NO 51073
  misc_feature: Useful for making plants with modulated biomass
MNVKGGGRIPAPPPGASALVKVAVLGGAAVYAAVNSLYNVEGGHRAIVFNRIQGIKDKVYPEGTHFMIPWFGRPIIYDVRARPNLVESTSGSRDLQMVKIGLRVLTRPMPERLPHIYRTLGENFNERVLPSIIHETLKAVVAQYNASQLITQRETVSREIRKILTER

SEQ ID NO: 37034 - DNA, 678 bp, Panicum virgatum
  misc_feature: Ceres CLONE 1988129
  misc_feature: Encodes the peptide sequence at SEQ ID NO. 37035
accatcgcaacaaggcacaagccgcgcacctctgttccttcgaccccaatccgtcgcctcgcagaggagggaagccgccccgccccgccgcgtctcgccgccctccccgttaacaccagcacgagcatcccccgagagcagctgcggctccctcgcctccgggccggtccttccaagaagcctgctgctggtctcatctcggcgccgccgccggccgcattcttgaacaaacttttaagaaggaacaattgtggatgctctaatggagtcaaaaggtggcaagaagtctagtagtagcaatttgatgtacgaagctccccttggttataaaattgaggacgttcgcccagccggaggaatcaagaagttccagtctgctgcttactccaactgcgcccgcaagccatcctgatatcccttcacatgcaattcgccgtagagtaggattttccttccatttttctctcttgtttgataattctcccttggctggctgcattctctgcttctgagattccaacttgttttctcccatttctccctccctctcccatcctcccttccttgcaacacgtcatctaatggcgatgccttcagctgattcctggggctcttctcctgcctcccctatggggtttgagggctatgagaagcgccttgagataacgttctctgatg

SEQ ID NO: 37035 - protein, 49 aa, Panicum virgatum
  misc_feature: Ceres CLONE 1988129
  misc_feature (1)..(49): Pfam Name: AdoMetDC_leader Pfam Description: S-adenosyl-l-methionine decarboxylase leader peptide
MESKGGKKSSSSNLMYEAPLGYKIEDVRPAGGIKKFQSAAYSNCARKPS

SEQ ID NO: 37036 - DNA, 1899 bp, Panicum virgatum
  misc_feature: Ceres CLONE 1988140
  misc_feature: Encodes the peptide sequence at SEQ ID NO. 37037
aattcgaatctccgcaccgccccgccctcgcaatgtgggcctcctccgtcgaggaggcgggcgcgctgctggcgcggagcgactccggcggcggccgccgccgccgctccgcctcgcccgtgcggtccgcgtcgccgaggcccgggaccctcaggcgccagtcctcgtcgttccgcgaggacgtcggccgggccgcctccgagacgtacctcgtctcgcgcctcaccttcacgctcctccagtgcctcgggataggttaccaatggatgtcacaactccttgcactcacaatctatgcaattttacttatgccaggattcatacaagttggatattactatttcttttcaagccaagttcgtagaagtatagtctatggcgaccaacctagaaacaggttggatctatacatacccgaagacaatagtaggccctgcccagtagtggcctttgtaactggtggcgcatggattataggttacaaggcctggggtgctcttcttggacgacgattggcagagagaggaataatagttgcttgcattgactacagaaattttccccaaggtacaataggtgacatggttagtgatgcttctcaggggatttcttttgtgtgtaacaacatcgccggttttggaggagatcctaatcagatctacttgatgggtcagtcagcaggtgcacatattgcagcatgtgcactcatggagcaagcagtaaaagaatctggggggcatcctgtttcttggagtgtaacccaaataaaagcgtattttggtttatctggaggatacaacatccatagtttggttgaccatttccatgggcgtggtctttatcgctcattattcctcagcataatggaaggagaggaatcattgtcacgttattcccctgaaattgttgccaagacgtcaagtgctgagactataggtcttctgccacttattgttcttatgcatgggactgaagattattcaataccatcatctgctagtcaaacttttgttgacgtcctccaacaagctggtgctcaagcaaagttactattgtacgaagggaagacacatacagatatcttcttacaggaccctcttaggggtggaagggatccattggttgaagatgtattgtctatcattcatgctgatgatgcaattgcacagcaaaaggttgctttagcaccaactccaaggcgcttggtttttgagtggcaattaaagttggcccgccaaattagtccattctagtaggtttggatccatatattatgttaaagccagatgtgtgcggaatatctagtatgaagaacggccaagcttacatctgttggttttgtgccttcacgaggaaaaggccctccggggcattgatttgtattggatcaagaaaagaactctcctcatccttccttgcatcttggaacaggggaagctctgtgtgaaacttgtagctggtaccaatacgagaggaagaagctacatgattggaaaccacatgctcctctctttagcaaagttgtacaaaatgctgtatattgtattatattgcacaaaggcttgtaacattgtttctgtaacgtcgtgtaatacacatggacattaaatactagaatattccttaataggaaaggttgctactgctcgggcgagctgttcgattggactgaggcaaggaaagtcctttcctcgtccaggtacctttgccctgtactgtagagctctgtggaataagaaaagctaaagaggaatgcaagacgaagaagcttcctgatcgaaaacctcatcattttctatttttctttgtttatttttccactgtacatggttgtgtttatatctctaaagggcctgtaataagtattgttatgtaatattctaatttgtgcaaaacagc

SEQ ID NO: 37037 - protein, 406 aa, Panicum virgatum
  misc_feature: Ceres CLONE 1988140
  misc_feature (138)..(352): Pfam Name: Abhydrolase_3 Pfam Description: alpha/beta hydrolase fold
  misc_feature: SWISSPROT Homolog: EC 3.1.1.1 Carboxylesterase
MWASSVEEAGALLARSDSGGGRRRRSASPVRSASPRPGTLRRQSSSFREDVGRAASETYLVSRLTFTLLQCLGIGYQWMSQLLALTIYAILLMPGFIQVGYYYFFSSQVRRSIVYGDQPRNRLDLYIPEDNSRPCPVVAFVTGGAWIIGYKAWGALLGRRLAERGIIVACIDYRNFPQGTIGDMVSDASQGISFVCNNIAGFGGDPNQIYLMGQSAGAHIAACALMEQAVKESGGHPVSWSVTQIKAYFGLSGGYNIHSLVDHFHGRGLYRSLFLSIMEGEESLSRYSPEIVAKTSSAETIGLLPLIVLMHGTEDYSIPSSASQTFVDVLQQAGAQAKLLLYEGKTHTDIFLQDPLRGGRDPLVEDVLSIIHADDAIAQQKVALAPTPRRLVFEWQLKLARQISPF

SEQ ID NO: 37038 - DNA, 1230 bp, Panicum virgatum
  misc_feature: Ceres CLONE 1988145
  misc_feature: Encodes the peptide sequence at SEQ ID NO. 37039
actcagcccctaccgcgcctgtccgccacgcccactctgacagccatggcccaccactgcctcgcgctcctcctcaccctcctcgccgcggccgtcggcgccggcgcggccacgccgaggcagctgttcctcgtcagccagccgcccgtgacgttgagcaaccaccacggccagctgctcaccggcaactactccgtgaacctgctctggtacggccgcttcaccccggcgcagcgcgccgtcgtggccgacttcctcctctccctctcggcgccctccggggccacggcctccgcggccgcgccctccgtggcggcgtggtgggccaccacggcgcggtaccacccgggcgcggcgcgcctcacgctcggccgccaggtgctcgacccctcgctctccctcgggcgccggctctcggaggcctcgctggccgccctcgccgcgcgcctctccccgcaccgcggctccgtcgccgccgtggtcacggcgcccgacgtcctcgtcgacggattctgcctctcccgctgcggcctccacgcgtcggccacctcgtccaccgccgccgccgcgccagcggcagcccacggcgccggcgctccgcccgccgcacgcgggcgcggccggttcgcgtacgcgtgggtggggaactcggcggaccagtgccccggggagtgcgcgtggccgttccaccagccgtcgtacggcccgcaggcgccgccgctggtggcaccgaacgcggacgttgggatggacggcgtggtgatcaacctcgcgacgctgctggccggcgccgtgaccaacccgtacggcggcgggttcttccagggcccctccgaggcgccgctggaggccgtgacggcgtgcacgggcgtgttcggcgcgggcgcctacccggggtaccccggccagctgccggtggacgccgccacgggcgccagctacaacgccgtcggcgtcgcggggcgccggttcctcctcccggccatgtgggaccccaagacctcgcagtgctccaccctcgtgtagcggacgacactaggatcggaggtagagatcggacggaacgggtgttggcttggtgtaaatgatggcgatcgaagtcgaagggtgtggagctcagatggtagactcggtggcggcctttgtggtttctcgtgatctcgtcctgtcattgttctcgttcttgtgaatagcttccaacttgaaatgaaaccccccaaaaaaaagtgg

SEQ ID NO: 37039 - protein, 326 aa, Panicum virgatum
  misc_feature: Ceres CLONE 1988145
  misc_feature (37)..(326): Pfam Name: Phi_1 Pfam Description: Phosphate-induced protein 1 conserved region
MAHHCLALLLTLLAAAVGAGAATPRQLFLVSQPPVTLSNHHGQLLTGNYSVNLLWYGRFTPAQRAVVADFLLSLSAPSGATASAAAPSVAAWWATTARYHPGAARLTLGRQVLDPSLSLGRRLSEASLAALAARLSPHRGSVAAVVTAPDVLVDGFCLSRCGLHASATSSTAAAAPAAAHGAGAPPAARGRGRFAYAWVGNSADQCPGECAWPFHQPSYGPQAPPLVAPNADVGMDGVVINLATLLAGAVTNPYGGGFFQGPSEAPLEAVTACTGVFGAGAYPGYPGQLPVDAATGASYNAVGVAGRRFLLPAMWDPKTSQCSTLV

SEQ ID NO: 37040 - DNA, 745 bp, Panicum virgatum
  misc_feature: Ceres CLONE 1988164
  misc_feature: Encodes the peptide sequence at SEQ ID NO. 37041
actccaacgaactcctctgctctactcaggctcgtcggaagtcgaaagcgacaaccacgacgatgcgtccgctccgccgcctcgccgtcctcctcgtcctcgtcctcctccccgcggtcgcttgggccctggatcctccccgcttcccggggccccaaccccgcgcgcggcagggagccaatggggtggggggctacgagtacgagacccggtacttccggcagcggctggaccatttcagctttcccggggtcggggacgaggacgaggcggcggcgttcttccagcagcggtacctggtgggccgcgggggtgggtgggccggccccggcgggcctatcttcttctactgcggcaacgagggcgacatcgcctggttcgccgccaactccggcctcgtctgggaggccgccccgcgcttcgccgccctcgtcgtcttcgccgagcatcgttactacggggagtccatgccgttcgggagcaaagccaaggcgtacaacaattccaagtcactggcgtacctcacggccgagcaggcgattgctgacttcgcagtgctgctcgctgacctcaagaggaacctatccgcagagggcagccccgtggtgctctttgggggctcatacggtggaatgctagctgcttggatgagactcaaatatccacatgttgctgtcggggcactcgcatcatcagctcccatcctggagtttggagacatcgtcccttctaccatattctatga

SEQ ID NO: 37041 - protein, 227 aa, Panicum virgatum
  misc_feature: Ceres CLONE 1988164
MRPLRRLAVLLVLVLLPAVAWALDPPRFPGPQPRARQGANGVGGYEYETRYFRQRLDHFSFPGVGDEDEAAAFFQQRYLVGRGGGWAGPGGPIFFYCGNEGDIAWFAANSGLVWEAAPRFAALVVFAEHRYYGESMPFGSKAKAYNNSKSLAYLTAEQAIADFAVLLADLKRNLSAEGSPVVLFGGSYGGMLAAWMRLKYPHVAVGALASSAPILEFGDIVPSTIFY

SEQ ID NO: 37042 - DNA, 549 bp, Panicum virgatum
  misc_feature: Ceres CLONE 1988166
  misc_feature: Encodes the peptide sequence at SEQ ID NO. 37043
acatgaccggcggcttctgttcgcgttcggcgccatttcctacccgctccgctccgccccgccaataaatcctaccccccccccccaaccccccccgtgggcgaaattcctcgacggatcgatcttgatttctcgccgccgtccgcgcatctctgccaccgccgccaccacctgcctgtttgggaggttgccaggccgcgcgcccatggccgtcaccgtgtgcgtcaccggcgccggcggcttcatcgggtcttggatcgtcaagctcctcctcgaccgcgggtacgccgtccggggcacctcccgccgcgcagatgatcccaagaacgcgcacctctgggcgctcgacggcgcggcggagcgcctcacgatgctgcaggtggacctgctcgaccgggtcagcctctgcgccgccttcgacggctgcgacggcgtcatccacaccgcctcgccgatgcacgacaaccccgaggagatcatcgagccaattatcgccgggacacggaacgtcgtggaggccgcggtcgacgccggcgagcggcgcctggt

SEQ ID NO: 37043 - protein, 114 aa, Panicum virgatum
  misc_feature: Ceres CLONE 1988166
  misc_feature: SWISSPROT Homolog: EC 1.1.1.219 Dihydrokaempferol 4-reductase
  misc_feature: Functional homolog of the protein sequence given in SEQ ID NO 51017
  misc_feature: Useful for making plants with altered carbohydrate content
  misc_feature: Functional homolog of the protein sequence given in SEQ ID NO 51420
  misc_feature: Useful for making plants with altered lignin content
  misc_feature: Functional homolog of the protein sequence given in SEQ ID NO 51537
  misc_feature: Useful for making plants with altered cell wall content and/or composition
MAVTVCVTGAGGFIGSWIVKLLLDRGYAVRGTSRRADDPKNAHLWALDGAAERLTMLQVDLLDRVSLCAAFDGCDGVIHTASPMHDNPEEIIEPIIAGTRNVVEAAVDAGERRL

SEQ ID NO: 37044 - DNA, 697 bp, Panicum virgatum
  misc_feature: Ceres CLONE 1988187
  misc_feature: Encodes the peptide sequence at SEQ ID NO. 37045
aaatcgagctttagctatttctgataggcgtgcagctgacctagccgatgaatcaagtgtgattgaagcttccgtaaatgctgcagtatctattcttagcaaaggatcaagctcagctcacctgtctgctgcattaaatgctgcgcaagctgctgcagctgctgctagggaaagttcaaatctcccacccgagttggatgagtttggcagagatatcaacctccagaaacgtatggatcttaaacggagggaagagaacaggagtcgaagaaaaaccaagtcagagtcaaagagaatggcatctgcagtgaagaatgatggcattgagaagattgaaggagagctaagcactgatgaaagtgacagtgagagcactgcttatgtttccagccgggatgagttgcttaagactgctgaccttgtgttcagtgatgcttcagaggaatactcgagccttcaaattgtcaaggacaagtttgaaggctggagaactcagtacccttctgcgtaccgggatgctcatgtagctctgagtgtaccatctgtgttcaccccttatgtgagactggagctcctgaagtgggatcccctccatgaagcaactgatttcttcgacatggattggcacaaggttctgtttgactatggtgcgcaagatgatgagagtgcctccagttctaatgatacagatgtggtt

SEQ ID NO: 37045 - protein, 231 aa, Panicum virgatum
  misc_feature: Ceres CLONE 1988187
  misc_feature (1)..(231): Pfam Name: GCFC Pfam Description: GC-rich sequence DNA-binding factor-like protein
NRALAISDRRAADLADESSVIEASVNAAVSILSKGSSSAHLSAALNAAQAAAAAARESSNLPPELDEFGRDINLQKRMDLKRREENRSRRKTKSESKRMASAVKNDGIEKIEGELSTDESDSESTAYVSSRDELLKTADLVFSDASEEYSSLQIVKDKFEGWRTQYPSAYRDAHVALSVPSVFTPYVRLELLKWDPLHEATDFFDMDWHKVLFDYGAQDDESASSSNDTDV

SEQ ID NO: 37046 - DNA, 470 bp, Panicum virgatum
  misc_feature: Ceres CLONE 1988196
  misc_feature: Encodes the peptide sequence at SEQ ID NO. 37047
ggccactccaacgtctggaactcgcaccccaagaactacgggcccggctcccgcgtctgccgggtctgtgctaacccccatggattgatcaggaagtatgggctcatgtgctgcaggcagtgcttccgcagcaacgccaaggacattggcttcatcaagtaccgctaaaggcattgccttgctggcgtcgagaacttcacctgggttgaaaagaaatggatccttcaatagaaggctcagcttatgtgcattagattttcgttcagacttgagactgctagtaaactacttgttaaagttttgatgggtactatatgcctgttaaactaattataattaagtgattggagtattttgtcatgtttaatatctggtgtactcaacctgcttgtattggtgccctccaaggctcccatgttattgtactgccagttctattccttgcttaatatatgagcttggcactgatg

SEQ ID NO: 37047 - protein, 55 aa, Panicum virgatum
  misc_feature: Ceres CLONE 1988196
  misc_feature (2)..(55): Pfam Name: Ribosomal_S14 Pfam Description: Ribosomal protein S14p/S29e
  misc_feature: Functional homolog of the protein sequence given in SEQ ID NO 50136
  misc_feature: Useful for making plants with modulated nitrogen use efficiency
GHSNVWNSHPKNYGPGSRVCRVCANPHGLIRKYGLMCCRQCFRSNAKDIGFIKYR

SEQ ID NO: 37048 - DNA, 534 bp, Panicum virgatum
  misc_feature: Ceres CLONE 1988197
  misc_feature: Encodes the peptide sequence at SEQ ID NO. 37049
ctgcactcctcacaccacctgctcctcgtcctttccgttgccaactgactcctccacacctctccttcctcccctgttctcctcacactcggtcggctctgctctgctagtctcgagtccaacacgcgcgcgcgcgcgcgccatggacacggagtggctgcgcgggaaatgcatcggcaggggcgcgttcggcgcggtgcacctggccgtcgacagggccacggggcgcgccttcgcggtgaagtcggtggacgcggcgaccgcgccggccgcggcggcggcgctggcgtgcctggagggcgagataaggatcctgaggcggctggcctcgccgtacgtcgtggcgtacctcggggacggcggggcgggggccacgagggacctgcgcatggagctggtgcccggcggcaccgccgcggaggccgccgccaggcggggcgggctcggcgagcgcggcgcgcggggcgtgctcaggagggtggccgccgcgctgcggtacctgcactgagaggccggcgtggtgcactgggacgt

SEQ ID NO: 37049 - protein, 121 aa, Panicum virgatum
  misc_feature: Ceres CLONE 1988197
  misc_feature: SWISSPROT Homolog: EC 2.7.11.25 Mitogen-activated protein kinase kinase kinase
MDTEWLRGKCIGRGAFGAVHLAVDRATGRAFAVKSVDAATAPAAAAALACLEGEIRILRRLASPYVVAYLGDGGAGATRDLRMELVPGGTAAEAAARRGGLGERGARGVLRRVAAALRYLH

SEQ ID NO: 37050 - DNA, 1576 bp, Panicum virgatum
  misc_feature: Ceres CLONE 1988201
  misc_feature: Encodes the peptide sequence at SEQ ID NO. 37051
acactacccgcccgccattctagctccgcagcggcggcacggcgccccggaaccgggagccgggagcaacaaaacacgcgagctaaaaacgggcaccgcgcgcgcgatccccggcacccgcgctcgccggccttacattgccgcccgggccctcggcattgggggaggtttcggtgttgcgccgtcgttcccgcgtgttgcgttgattcctcgaaccaacgcgcggcgcggggtcccggccatggcgcagctgccgcccaagatccccgccatggcgccggcatggcccgagttcgggggcgggcaccaccaccacgcccaccaccatcaacagcgcagcccctccgtgggcacgttcctcgccgcgcccatgccgccgcagcagccgacgtgggtcgaggagttcctcgacttcacggccgccaagcgcggcgcgcaccgccgcaccgtcagcgactccgtcgccttcctcgagcccggccccgacgacggcaatgccggcgacggggcgcacgacttcgaccgcctcgacgacgaccagctcctgtccatgttctcagacgacctgccgccgccgccgccgccgccacagcagcagcaggccgctcccgcgcccgcgcccgtggcgagctcgtcgtcgccgtccgaccacaacagcatcaatgacgagaagacggacaggggcgagaccgaggaggcgcagagcaagtgccacggggacgcccccgccgccgccgcagttgatcccaagcgcgtcaagaggatcctggcgaaccggcagtcggcgcagcggtcgcgcgtgcgcaagctgcagtacatctcggagctggagcgcagcgtcacgttgcttcagacggaggtgtcggcgttgtccccgcgcgttgccttcctcgaccaccagcgctcgctgctgacgctggggaacagccacctcaagcagcggatcgccgcgctcgcgcaggacaagatcttcaaagatgctcatcaggaggcgctgaagaaggagatcgagaggctgaggcaaatctacctccagcagagcctgaagaacgccgagtcgtccccgacgcccgacgcggccccgatccgcagcgacaaggacctgatcgccagcgaggggaccgcggcgcccgcgccctgcccgccctcgtgatgaggccggagaccatccatgtccgtccggtccggtcgctgtagtggggggaggtggcctccgcctgtcgtccatgacaacgagaggtgtcgctggctgctaggattggtggtggcgctgcttgggtttgtgcattccttgggggggtgtaatcgtgatgtaaatgagagactcgattgatttggttttgttcattctcgcatcctctgctgctggctgcctgctgctccgtcttccacctccctgagttgtaatttttgtttgggcatttgggcgaaggttgttgtaggtaagagaccaaatgtaattcagattggttggggtcgatttgtgtgtttggggtggttttgtatctgatctgatctgatctgatcattcgaaaaagatgtatgttttcggaacaaatcagtcttgtccaccttc

SEQ ID NO: 37051 - protein, 303 aa, Panicum virgatum
  misc_feature: Ceres CLONE 1988201
  misc_feature (166)..(220): Pfam Name: bZIP_2 Pfam Description: Basic region leucine zipper
  misc_feature: The sequence is a functional homolog of SEQ ID NO 1363 in the 10/374,780 US patent application
  misc_feature: The sequence is a functional homolog of SEQ ID NO 1364 in the 10/374,780 US patent application
  misc_feature: The sequence is a functional homolog of SEQ ID NO 1483 in the 10/412,699 US patent application
  misc_feature: The sequence is a functional homolog of SEQ ID NO 1362 in the 10/374,780 US patent application
  misc_feature: The sequence is a functional homolog of SEQ ID NO 1482 in the 10/412,699 US patent application
  misc_feature: Functional homolog of the protein sequence given in SEQ ID NO 51538
  misc_feature: Useful for making plants with altered carotene content
MAQLPPKIPAMAPAWPEFGGGHHHHAHHHQQRSPSVGTFLAAPMPPQQPTWVEEFLDFTAAKRGAHRRTVSDSVAFLEPGPDDGNAGDGAHDFDRLDDDQLLSMFSDDLPPPPPPPQQQQAAPAPAPVASSSSPSDHNSINDEKTDRGETEEAQSKCHGDAPAAAAVDPKRVKRILANRQSAQRSRVRKLQYISELERSVTLLQTEVSALSPRVAFLDHQRSLLTLGNSHLKQRIAALAQDKIFKDAHQEALKKEIERLRQIYLQQSLKNAESSPTPDAAPIRSDKDLIASEGTAAPAPCPPS

SEQ ID NO: 37052 - DNA, 740 bp, Panicum virgatum
  misc_feature: Ceres CLONE 1988205
  misc_feature: Encodes the peptide sequence at SEQ ID NO. 37053
gcgaccccaggtcagacgggatcacccgctgagtttaagcatataaagaagaggagaagaaggaggagccggagccacccaagctggaggaaaagaaggagccgcctgtgctcgccgttgtactgaaggtacatatgcactgcgaagcctgcgctgaggggctcaggaagaggatcctcaagatgaaaggggtgcaatctgcagagccagacctgaaggcatcggaggtgacagtgaagggtgtgttcgaggaggccaagctggccgagtacgtgtacaagcgcaccggtaagcatgctgccatcatcaagtctgagcctgtggctccgccggagagcgcagggggtgacagcaaggccaaggaggagaagaaggcagaaggtggcagcgaggagaagaaggacgacggcaaggaggagaagaaggacggcaaagaagatggcggcgagcagaagaaggaggaggagaagaaggagaaggagggtggtgatgctgccgccggcgacgaggaggagaaggcggacaaggagaaggaggcagctgccattgctgcggccaacctgtacatgcactacccgcggttcgcattccccggcgggtactaccagccgccgccgccgctaccgccgcccgggtatgtttaccagccagcctacccgccagcagcctacccaccgccaccggtgtatgcgcagcaccaccaagcaatggctccgcagatcttcagtgatgagaacccg

SEQ ID NO: 37053 - protein, 201 aa, Panicum virgatum
  misc_feature: Ceres CLONE 1988205
  misc_feature (1)..(57): Pfam Name: HMA Pfam Description: Heavy-metal-associated domain
MHCEACAEGLRKRILKMKGVQSAEPDLKASEVTVKGVFEEAKLAEYVYKRTGKHAAIIKSEPVAPPESAGGDSKAKEEKKAEGGSEEKKDDGKEEKKDGKEDGGEQKKEEEKKEKEGGDAAAGDEEEKADKEKEAAAIAAANLYMHYPRFAFPGGYYQPPPPLPPPGYVYQPAYPPAAYPPPPVYAQHHQAMAPQIFSDEN

SEQ ID NO: 37054 - DNA, 759 bp, Panicum virgatum
  misc_feature: Ceres CLONE 1988214
  misc_feature: Encodes the peptide sequence at SEQ ID NO. 37055
gaaatgcttgcccacgaacacaaacagcagcaaccaccgcggcgaggccgatctgaatcaagcgagtcgcccccgtttcatcacccccagaaaaaggcgagaaatccccaacggaaggagcagcagcgccagcagcagcagcgcaaattctttcctcctcatctttgccgcgcttgcccacccggatcgaaacccctagggtttcgcatccgcctcccaccgcgtactacttcctctccccgtctccctccgccgcgcgcgcgcgcggggagccaccaaaccctaggacggcaaatccggtgcgatcgcccacggtggaggcctcgtcggcggccgagaggagccgctcagggctcgggtcagggttccggtacctcgccggcgccgcctccgggtggttggaccggtggatggtcatgggagccagcggctccaagctggagaaggccctcggcgaccagttcccggaaggcgagcgctacttcggcctcgagaacttcggcaacacctgctactgcaacagtgtcctccaggcactttatttttgcattccattcagggagcagttactggaatattacgcaaataacaaaaatccaggagacgcagaggaaaatcttttgacttgtttggctgacctttttatgcagataagccaagcaaagaaaaaaactggtgttattgctccaaaacgttttgttcagagagtgaagaaacagaatgagttgtttcgtagctacctgcaccaggacgcacatg

SEQ ID NO: 37055 - protein, 116 aa, Panicum virgatum
  misc_feature: Ceres CLONE 1988214
  misc_feature: SWISSPROT Homolog: EC 3.1.2.15 Ubiquitin thiolesterase
MVMGASGSKLEKALGDQFPEGERYFGLENFGNTCYCNSVLQALYFCIPFREQLLEYYANNKNPGDAEENLLTCLADLFMQISQAKKKTGVIAPKRFVQRVKKQNELFRSYLHQDAH

SEQ ID NO: 37056 - DNA, 1227 bp, Panicum virgatum
  misc_feature: Ceres CLONE 1988215
  misc_feature: Encodes the peptide sequence at SEQ ID NO. 37057
atggtagtggcgccaccacttgtacgccgcctatagtatccggccgcctcgccgctcgcctctcttccatccccagccacctcgcggcaccgaactgggcgggggcgaccagtggccggccggccccagcgcggagctgctgcgcgcgcgtgcggacctaaacgcgccctttccgctggagtaaaggctcgccacctgccctgctgccgctatctgctctgctctgcttgctccagaagcaagtctaagagcgaggcagcgacggtcgggttcggcgcggctcggctgagcaagcgcgggtgatccggccggcggcgccatgagcagcagggagcagcagccgccgcggcggttcatcgccatccccttctcctccggctgccgctcccactccagcgtcgacgtcgtcgatacctcgcgccacgccggcaagaagccccacccgcaagggattgagttcgggatggtgccaggcggtgcgtcggcgaggccggcagcgacggcgggcaagggggagtcgctggtggcgcggctcctccgcgggttcaagaacctgtcccaaatcttcgcggtgtacgacgaggacgaggaggaggaggagcgggagatggtgatcgggctccccactgacgtgaagcacgtcgcgcacatcggctgggacggcagcaccagcaccaccaccagcctccgctcctggaaccgcgccgcgccgcctccgccgccggcatcctcctcctcctcgtccgcgtccacctccgccgccgcgccgccccagcagcagcagcaccagccgccggagcagtacccgctgcccctcccggcgctcgacatgcggcagttcgagctcgccatggccgcccaggccgccggcaccagcggcccccaccggcatcacagctagcgtcggagttggtacacccttggctcgtcagtcgtcacaggccgtcgtccgtttctgccgtccacctccgtccccatgtggagcagggtgggggcggccgcgagcgcccgggtggcccgtggccgggcggtctggcctcctcggctcttcctcccgcccgttccccgccctggtcgtcggagttggtgccgctgcttcgtttgcttgtgctttggccattggcccattgctgcggtgcgctgtgctgctgtacgtagcccatttttcttcccccggggatttcttgttggcttgctacttgttccttaccgccattacgaaatctt

SEQ ID NO: 37057 - protein, 193 aa, Panicum virgatum
  misc_feature: Ceres CLONE 1988215
  misc_feature (98)..(152): Pfam Name: PBD Pfam Description: P21-Rho-binding domain
MSSREQQPPRRFIAIPFSSGCRSHSSVDVVDTSRHAGKKPHPQGIEFGMVPGGASARPAATAGKGESLVARLLRGFKNLSQIFAVYDEDEEEEEREMVIGLPTDVKHVAHIGWDGSTSTTTSLRSWNRAAPPPPPASSSSSSASTSAAAPPQQQQHQPPEQYPLPLPALDMRQFELAMAAQAAGTSGPHRHHS

SEQ ID NO: 37058 - DNA, 701 bp, Panicum virgatum
  misc_feature: Ceres CLONE 1988216
  misc_feature: Encodes the peptide sequence at SEQ ID NO. 37059
gaattcttggatttccagaagtcccgaatcgtcgaatcccctcctcatctccccgtccagccgtcgtcctctcctcccttatcgatccggtcgctgaattcttcttcttcctccttggtccttctaccctgcggagcagagcaggcgccgagttcgttcgttgcaccgggctagaggatacacagaggcatcatcagctagctgtagctctggaggacctcataccaatggtgatggtgagcgtggcgagcccgagcccgatggtgcggtcggaggaggacctgggcccggcgtggctgcgcccgctgctgggcacgagcttcttcgtgccgtgccggatgcacccggagctgagcaagaacgagtgcaacctcttctgcctcgactgcaccggcgacgcgctctgcgcctactgcctcccggcgcaccgggaccaccacgtcgtccagatacggcggtcgtcgtaccacaacgtgatccgggtgtcggaggtggggaagctgatcgacatctcgcacgtgcagacgtacgtgatcaacagcgccaagatcgtgttcctcaacggccggccgcaggccaggcccggcaagggcgtcaccaacacctgcgagatctgctgccggagcctcccggactcgttccgcttctgctccctcggctgcaagctgggagggatgccgtgggacccaagcctgacgttt

SEQ ID NO: 37059 - protein, 157 aa, Panicum virgatum
  misc_feature: Ceres CLONE 1988216
  misc_feature (36)..(147): Pfam Name: PLATZ Pfam Description: PLATZ transcription factor
  misc_feature: The sequence is a functional homolog of SEQ ID NO 668 in the 10/666,642 US patent application
  misc_feature: The sequence is a functional homolog of SEQ ID NO 664 in the 10/666,642 US patent application
MVMVSVASPSPMVRSEEDLGPAWLRPLLGTSFFVPCRMHPELSKNECNLFCLDCTGDALCAYCLPAHRDHHVVQIRRSSYHNVIRVSEVGKLIDISHVQTYVINSAKIVFLNGRPQARPGKGVTNTCEICCRSLPDSFRFCSLGCKLGGMPWDPSLT

SEQ ID NO: 37060 - DNA, 692 bp, Panicum virgatum
  misc_feature: Ceres CLONE 1988219
  misc_feature: Encodes the peptide sequence at SEQ ID NO. 37061
ccatccaccaccagccagccgccttcgtctgcacatctccgacctccgtcgtcgcacttctcctcccgcgcgcctcagccatggctggttccgcctacaacggcaagtacgccgaggagctgatcaagaacgctgcctacatcggcacccctggcaagggtatccttgctgctgatgagtctactggcaccatcggcaagcgtctttccagcatcaatgttgagaacgttgaggagaaccgccgcgccctccgtgagctcctcttctgcacccccggtgccctccagtacctcagcggtgtgatcctcttcgaggagaccctgtaccagaagaccaaggatggcaagccgttcgtcgatgtcctcaaggagggtggtgtcctccccggcatcaaggttgacaagggtaccatcgagctggctggcaccgacaaggagaccaccacccagggccacgatgaccttggcaagcgctgcgccaagtactacgaggctggtgcccgctttgccaagtggcgtgccgtcctcaagattggccccaactagccatcgcagctggccattgacctgaacgcccagggtctggctcgctacgccatcatctgccaggagaacggtctggtgcccattgttgagcctgagatccttgttgatggacctcatgacattgagcgctgtgcctatgtcaccgag

SEQ ID NO: 37061 - protein, 154 aa, Panicum virgatum
  misc_feature: Ceres CLONE 1988219
  misc_feature (13)..(154): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Functional homolog of the protein sequence given in SEQ ID NO 50216
  misc_feature: Useful for making plants with modulated phosphate use efficiency
  misc_feature: Functional homolog of the protein sequence given in SEQ ID NO 50217
  misc_feature: Useful for making plants with modulated biomass
MAGSAYNGKYAEELIKNAAYIGTPGKGILAADESTGTIGKRLSSINVENVEENRRALRELLFCTPGALQYLSGVILFEETLYQKTKDGKPFVDVLKEGGVLPGIKVDKGTIELAGTDKETTTQGHDDLGKRCAKYYEAGARFAKWRAVLKIGPN

SEQ ID NO: 37062 - DNA, 637 bp, Panicum virgatum
  misc_feature: Ceres CLONE 1988222
  misc_feature: Encodes the peptide sequence at SEQ ID NO. 37063
acaaaatatcgatcatggatagcctgtccctgcagtactactgcagctgcctgctattgcttgctctcctctactccctgacaaaatgttactacactgcatccgcccgctccagctgccttcgtggcctacgtctccccccgagcccctggcagctccctgtcatcggcagcctccaccacctgggcggcgagctcccacaccgctcgctgcgccgcctctcacgccgctacggccctgtcatgctcctcaggttcggcgaggtcccggtcgtcgtcgtctcctccggcgaggctgccagggaggtcatgaggacgcacgacgttgcgttcgccacgaggccccagctcgcggcgatcaggaccctcaccaaggaaggtcaggccatcgcgttcgccccgtacggcgagcactggcgtgagctccgcaagatctgcgccatggagctgctcagcgccggccgcgtccggtcgttccggcctgtccgtgaggaggaggtggcgcggctcgtcggagccttctcgtcggcatcaggtaacgatgagcttgtgaacctcagcgagatgattgcggcgtatgtcgccgacaccgcggttcatgcgatcatggggagacgactcgacgaccgcggcgcctt

SEQ ID NO: 37063 - protein, 207 aa, Panicum virgatum
  misc_feature: Ceres CLONE 1988222
  misc_feature: SWISSPROT Homolog: EC 1.14.13.68 4-hydroxyphenylacetaldehyde oxime monooxygenase
MDSLSLQYYCSCLLLLALLYSLTKCYYTASARSSCLRGLRLPPSPWQLPVIGSLHHLGGELPHRSLRRLSRRYGPVMLLRFGEVPVVVVSSGEAAREVMRTHDVAFATRPQLAAIRTLTKEGQAIAFAPYGEHWRELRKICAMELLSAGRVRSFRPVREEEVARLVGAFSSASGNDELVNLSEMIAAYVADTAVHAIMGRRLDDRGA

SEQ ID NO: 37064 - DNA, 1188 bp, Panicum virgatum
  misc_feature: Ceres CLONE 1988228
  misc_feature: Encodes the peptide sequence at SEQ ID NO. 37065
atagttccaactccagcccacttccgcctccgccgcttccctcctcttcctcctccgcgccggcgctacaccttcccccactctctctgtctcgcccgcgcctccgcggccgccgcgatggcctcgtcgtcggcgacgagggaggtgctcatgctggaggccccgccaccgtcggaccccgcgctggcgccgtggcgctcgccgccggacgcggaggccgtcgacgcgctgccctacatcgacggcgactacggcgacccggcggtgaagcgggaggtcgaccgcctcgtcgaggaggagatgcggcgcgggcagcgcaagcccgccgacttcctccgggacctgcccccagtccccaccgtcggatttgagaatcatcctatgcttgctaaagagtatgaacgagttagggctggcaaacctcctttcatgttagatatgtctcgctatggtttggagccgcctccaatgaacaagaggaatgatgttgctgcctggaggcaggctctacggaatgcacagagccagttgcagcatcaaattacaaggatagagaatcttgagcttatgctgaaatatggtgttgaggtttggaagctgcagaaccgacaaatggaatcagttctgtctaggatgcaaaagacggctgtagaatacaatgaaaagatagagactgtcaatcgtgagaggaagttccaccagcaacacactggaggccagcttcatgccctgacaatggaatggcaggagctgtgtcaaaaaaacatagctattcaggctgcttgtgttgacctgcagaaccagattgatcagcttaaacttgaagcaaaagaattgggaatgcccatggaagacaacactggaatcaattcacaaccatcatgagctcatgatttgagatacatatgtggcaaggaagaagctatggcacttcaatgagattagccattgtgcttacgtgacttacagttatcgattccaccaggctgtttgacgttgaaaacatgtttgtggacagtgcctagcgattcatcacttgaaggggatctgacgatctgtgctgctgaaaattcctcagaggaagagtctaattttttgtatctgttgtccagtggagtgccctaacctgtggtctgagtaacacagtgtctatttcgattgcaaaagtttgtcgactttttgtggctt

SEQ ID NO: 37065 - protein, 255 aa, Panicum virgatum
  misc_feature: Ceres CLONE 1988228
  misc_feature (13)..(253): Pfam Name: BCAS2 Pfam Description: Breast carcinoma amplified sequence 2 (BCAS2)
MASSSATREVLMLEAPPPSDPALAPWRSPPDAEAVDALPYIDGDYGDPAVKREVDRLVEEEMRRGQRKPADFLRDLPPVPTVGFENHPMLAKEYERVRAGKPPFMLDMSRYGLEPPPMNKRNDVAAWRQALRNAQSQLQHQITRIENLELMLKYGVEVWKLQNRQMESVLSRMQKTAVEYNEKIETVNRERKFHQQHTGGQLHALTMEWQELCQKNIAIQAACVDLQNQIDQLKLEAKELGMPMEDNTGINSQPS

SEQ ID NO: 37066 - DNA, 1463 bp, Panicum virgatum
  misc_feature: Ceres CLONE 1988245
  misc_feature: Encodes the peptide sequence at SEQ ID NO. 37067
aactcgctatgctgcgtattcagcatcttgatgtatgcatccacttcgattcttctgagtgagctagatttttcatattcctgaaagtcaagcagccttgcgcagtctgcaacaatggcaggccaatcctctgcggatcgaactgccgggcttaaactgactgacgcgctcgctgcacgcattcaggacatcgatgacgcgaagctggaggaggtcctgaggggggcagccatggcgaacgacacggtgatcctgacgacgctgaacgccgcgtggtcggagcccggctcggtgctggacgtcttcctggagagcttccgggccggcgagagcaccagggagctgctggaccacctcgtcatcgtgtccctggactcggcggcgcacgagcgctgcggccaagtgcaccggcactgcttcgcgctcgtcgccggcggcgtcaacttctccgggcagaagaacttcatgaccgacggctacctcaagatgatgtggagcaggatcaacttcctcgggcaagtccttgagaaaggcttcagcttcatcttcacggtatctgccaagatcagttaatttctggagcgactttctgaatgtgtatcgattctgaaactctgaacatttcaggacacggacatcgtgtggttcaggaacccgctgccgcacttctacctggacggggacttccagatcgcctgcgaccacttcaccggggaccctgacgatctgagcaacgcgcccaacggcgggttcgcgtacgtgcgttccaactcggagacgatagagttctacaggttctggtacgcggcgagggagaagcaccccggattgcacgaccaggacgtgctcaactccatcaaaaacgactccttcgtcgccgagctgggcgtcaagatcaagttcctcagcactgagctcttcggtggcctgtgcgagccgagccggaacatgagcagggtctgtacaatgcacgccaactgctgcatcggactgagccgtaagatcagcgacctcaacgcgatgctccgggactggaggaggttcatggcgctgccgcaggacgataagcactcagtttcatcatggactgtaccacgcaattgcaggtaaaggcaaccaaggcatattaaaatagggaatgcacattgtgtgtttctgatcaagaggaagctgtctttccagtgttcagacttcagaaactggggcgatagagaaaagaggaaactatctttctgcttgacaagtgattaattcagactccggaaagatgggtaatgtaaacaaaaatatgggaagtttataagttcatttttgttgattgtattgtaggtactgacgttaaccacagtgaattattcgcacattttttactccatgtaagcaactgaatggagctgctaatcgatgtctttgcacatgcttgtattacaatttttaactgaaataaacgaatcttaatctgc

SEQ ID NO: 37067 - protein, 152 aa, Panicum virgatum
  misc_feature: Ceres CLONE 1988245
  misc_feature: Functional homolog of the protein sequence given in SEQ ID NO 51053
  misc_feature: Useful for making plants with modulated biomass
  misc_feature: Functional homolog of the protein sequence given in SEQ ID NO 51539
  misc_feature: Useful for making plants with altered carbohydrate content
MAGQSSADRTAGLKLTDALAARIQDIDDAKLEEVLRGAAMANDTVILTTLNAAWSEPGSVLDVFLESFRAGESTRELLDHLVIVSLDSAAHERCGQVHRHCFALVAGGVNFSGQKNFMTDGYLKMMWSRINFLGQVLEKGFSFIFTVSAKIS

SEQ ID NO: 37068 - DNA, 652 bp, Panicum virgatum
  misc_feature: Ceres CLONE 1988250
  misc_feature: Encodes the peptide sequence at SEQ ID NO. 37069
acacgcacaccacccaccggacctgagcacaccagcaaggacagcaaggaggagcagccatggcctcgtcggtggccgccgcggcgagcacattcctgggcacccgcctggcggacccggcgccgcagaacgggcgcatcgtggcccggttcgggttcggcaagaagccggcggccccgaagaaggcggccaagacgtcgaccatctccgaccggccgctgtggttccccggcgcggtggcgcccgactacctcgacgggtcgctggtcggcgactacgggttcgacccgttcgggctcggcaagccggtggagtatctgcagttcgacctggactcgctggaccagaacctggccaagaacgaggccggcggcatcatcggcacccggttcgagtcctcggaggtcaagtccaccccgctccagccctacagcgaggtcttcggcctccagcggttccgcgagtgcgagctcatccacggccgctgggccatgctcgccaccctcggcgccctctccgtcgagtggctcaccggcgtcacctggcaggacgccggcaaggtacatgcgcatttgcttagtaatcccatgccggccgcatactaatataatactagtatgatgtgcaagaattattgatgaacgctgatgat

SEQ ID NO: 37069 - protein, 181 aa, Panicum virgatum
  misc_feature: Ceres CLONE 1988250
  misc_feature (60)..(181): Pfam Name: Chloroa_b-bind Pfam Description: Chlorophyll A-B binding protein
  misc_feature: Functional homolog of the protein sequence given in SEQ ID NO 50114
  misc_feature: Useful for making plants with modulated water use efficiency
  misc_feature: Functional homolog of the protein sequence given in SEQ ID NO 50115
  misc_feature: Useful for making plants with modulated biomass
  misc_feature: Useful for making plants with modulated drought sensitivity
  misc_feature: Useful for making plants with modulated phosphate use efficiency
MASSVAAAASTFLGTRLADPAPQNGRIVARFGFGKKPAAPKKAAKTSTISDRPLWFPGAVAPDYLDGSLVGDYGFDPFGLGKPVEYLQFDLDSLDQNLAKNEAGGIIGTRFESSEVKSTPLQPYSEVFGLQRFRECELIHGRWAMLATLGALSVEWLTGVTWQDAGKVHAHLLSNPMPAAY

SEQ ID NO: 37070 - DNA, 720 bp, Panicum virgatum
  misc_feature: Ceres CLONE 1988256
  misc_feature: Encodes the peptide sequence at SEQ ID NO. 37071
agctcctcctcgaaaagcagcacttctctccagtccacacccgcttggattggattgcattgcattgcggcgattccgcctgtagctattactagctagccaccagagagagagatacatattacacacacctctctctctctatatacaatctcctccattgcattgctttgctccaaataaattaatgttacacgcagcagaccactagccactagcagaaaggaaatgaggcatcgtcaggaagagatgcacctcatcagctgcagcagcttgatgctcgtgctcgtgctggccgcaggcggcggcggtgtatctgctgctgctgctgctgctgccaacaccacgacgaccacgacgagatcatcgaccaagccccaggcggccgccctcatcgtgttcggcgactccatcgtcgaccccggcaacaacaacggcatcaacaccatcatcaaggccgacttccctccctacggccacgacttcctcaaccaccgacccaccggacgcttctgcaacggcaggataccaacggacttcatagcgtcccggctgggcctcaaggacctcctcccgccctacctctcccctgagccgctggacaagcacgacctcctcaccggcgtcagcttcgcctccggcggcaccggcttcgacccgctcacgcccaagctcgcctccgtcatctcgatgcccgaccagctggccatgttccacgag

SEQ ID NO: 37071 - protein, 163 aa, Panicum virgatum
  misc_feature: Ceres CLONE 1988256
  misc_feature: SWISSPROT Homolog: EC 3.2.1.51 Alpha-L-fucosidase
MRHRQEEMHLISCSSLMLVLVLAAGGGGVSAAAAAAANTTTTTTRSSTKPQAAALIVFGDSIVDPGNNNGINTIIKADFPPYGHDFLNHRPTGRFCNGRIPTDFIASRLGLKDLLPPYLSPEPLDKHDLLTGVSFASGGTGFDPLTPKLASVISMPDQLAMFH

SEQ ID NO: 37072 - DNA, 633 bp, Panicum virgatum
  misc_feature: Ceres CLONE 1988258
  misc_feature: Encodes the peptide sequence at SEQ ID NO. 37073
acatgctttaagtcccactccccaccgccccagatctccgcccccctcccactccggcacccccccccccccccccacattccccggcgcgccacctctgcccgcggccgccgctgccgtccggagcgagatcggcgtgggtgcacgggcgcggctcctgtatctgtcggtgggagaccccgcgtgtcggtgggagcgggtggggaccaaacgaaggatggcgccgggcggcagatccgtcgcgtgctgcgccgccgtgctgctcgcggccgcgctgctcctctccgcgccgactgctacagaggcttatgattccttggatccgaacggcaacatcactataaaatgggatattatgcagtggactcctgatggatatgtcgctgttgtcacaatgttcaactatcaacaattccggcacattggggcacctgggtggcagcttgggtggacatgggcaaagaaagaggtcatatggtcaatggttggggcacagactactgagcagggtgactgctcgaaattcaaaggcaacactccccactgctgcaagaaagatcccacgctcgtcgatttacttccgggcactccgtacaacatgcaaattggcaattgctgcaaagcaggagttat

SEQ ID NO: 37073 - protein, 138 aa, Panicum virgatum
  misc_feature: Ceres CLONE 1988258
  misc_feature (54)..(138): Pfam Name: Phytochel_synth Pfam Description: Phytochelatin synthetase-like conserved region
  misc_feature: Functional homolog of the protein sequence given in SEQ ID NO 51355
  misc_feature: Useful for making plants with altered carbohydrate content
  misc_feature: The sequence is a functional homolog of SEQ ID NO 4 in US patent 7109001
  misc_feature: Functional homolog of the protein sequence given in SEQ ID NO 51356
  misc_feature: Useful for making plants with altered cell wall content and/or composition
  misc_feature: Functional homolog of the protein sequence given in SEQ ID NO 50602
  misc_feature: Useful for making plants with altered lignin content
MAPGGRSVACCAAVLLAAALLLSAPTATEAYDSLDPNGNITIKWDIMQWTPDGYVAVVTMFNYQQFRHIGAPGWQLGWTWAKKEVIWSMVGAQTTEQGDCSKFKGNTPHCCKKDPTLVDLLPGTPYNMQIGNCCKAGV

SEQ ID NO: 37074 - DNA, 717 bp, Panicum virgatum
  misc_feature: Ceres CLONE 1988271
  misc_feature: Encodes the peptide sequence at SEQ ID NO. 37075
aaaaaaaaacacatcaaaacgccataaaaatcttccgaaaacaaaaccgcttcccctcctatcaaaccaccaccgccactccaatctcctcttctccctatgattttgtataaataagcgaggcaggcgatccctggcccggaggggaggcggaggcagcagcaactactaccaccagtagtaatgtaatcccctcttctcccgcttggcctcttctcccgcagtgccgtctgcagcggcctccaaagcatcgcatccaacgaccaacccgcttccaacaggcaaggtagggatggggggagtgcatcggccaaaggaggaggagaacgggaggaagccggcgccggtggtcctcctcaggctgttcggcgtggatgtcgtcgccgacgaggagccggatgacaacgacatcgggctcaggaagagttcgagcatgcccaacctcgccaacccgctcctgccgcacggggaggccggcgagcgcaaggggtacgcctccgatgatctcgagctggtctccaggcaccagaagcgccgccgccgcaaggcccaggagaggaagaaagggattccgtggaccgaggaggagcacaggaagttcctggacggcctgaggcagctgggcaagggggactggaggggcatctccaagagcttcgtgatcaccaggacggcgacgcaggtggccagccacgcccagaagtactttcctccgcc

SEQ ID NO: 37075 - protein, 141 aa, Panicum virgatum
  misc_feature: Ceres CLONE 1988271
  misc_feature (92)..(139): Pfam Name: Myb_DNA-binding Pfam Description: Myb-like DNA-binding domain
  misc_feature: The sequence is a functional homolog of SEQ ID NO 1002 in the 10/225,066 US patent application
  misc_feature: The sequence is a functional homolog of SEQ ID NO 308 in the 10/374,780 US patent application
  misc_feature: The sequence is a functional homolog of SEQ ID NO 317 in the 11/479,226 US patent application
MGGVHRPKEEENGRKPAPVVLLRLFGVDVVADEEPDDNDIGLRKSSSMPNLANPLLPHGEAGERKGYASDDLELVSRHQKRRRRKAQERKKGIPWTEEEHRKFLDGLRQLGKGDWRGISKSFVITRTATQVASHAQKYFPP

SEQ ID NO: 37076 - DNA, 1294 bp, Panicum virgatum
  misc_feature: Ceres CLONE 1988323
  misc_feature: Encodes the peptide sequence at SEQ ID NO. 37077
gagaaagttcaggggttctctctggatgatggactgtgggcaactacaggaaactttagagctaacacaacccaaactcccgaccgaacaattactggtagtgaaagaaaaatctcccaaaggtaatatgggcgcctccgattcgccttactctccttcctctacttcttcctcttcttcctcttcttcaaacgttgaagatggaacttccatgggaattgaaatacgctcaaatgagggggaattacggcaagaacaacttcaagaagcctcggaacctgaggcggctcaaggttctgcaccacaaaattcctcactcgactatgactcacgttcgaacactttggaatccggtacagcggaaacctcgtcctcctcttcttcttactcttcttctttttctcttcctcatgttgaggaggctccttctgaaacgaacaatgaatctgaagttggaactgattttggcattgaccatgaagagcaacgtcaaagagacctcaaacacgaaaatgaacaaactcacgaaaacgagcaatctcttgaacaagcacaagaaaatgttgaggaaagcgagagtcgaagagaaaacctcgagaatcaagacaaccaacttgataatcaaaacaataatgtggaaggaacccaagaacttgacgaagaagatcttgcttttctgattaaacaaggagaaatgacaaaaaagctcagtctgagcaacagatcaattaaaaaactacccaaagaagtgttagcgctaacagatttggtggttttggacgtttcagcaaacaggttaaaaaaagtaacaaaaaagattggcgagctgcgcaatctcaagaggctctctctgaatcacaatgtcatctcctcgttaccccacaaactctggggtataacgcagttgacggctctcttccttaacaacaacaaactgaaaactcttcctccctacgtccggcatcttactaatcttaaaacacttgacgtcagttcgaacaaaatcagtgcaatccctcttgaaataggacaaatgagttctttgcaggagctcagggttagacaaaataggttagaatatcttccaaccacgctggtaaatctagtgaacctcaaagagttagcattggacggaaatccccttgtctttcctccaaagacagtggcaaagaagggcatttccgccatctttgggtttttaggcgaggcggacacgccaagtgaagcgcttcaacagctggttgctcccatgcaagaccttctctctcagcagctggacactcaagaagataag

SEQ ID NO: 37077 - protein, 360 aa, Panicum virgatum
  misc_feature: Ceres CLONE 1988323
  misc_feature: SWISSPROT Homolog: EC 3.1.13.4 Poly(A)-specific ribonuclease
MGIEIRSNEGELRQEQLQEASEPEAAQGSAPQNSSLDYDSRSNTLESGTAETSSSSSSYSSSFSLPHVEEAPSETNNESEVGTDFGIDHEEQRQRDLKHENEQTHENEQSLEQAQENVEESESRRENLENQDNQLDNQNNNVEGTQELDEEDLAFLIKQGEMTKKLSLSNRSIKKLPKEVLALTDLVVLDVSANRLKKVTKKIGELRNLKRLSLNHNVISSLPHKLWGITQLTALFLNNNKLKTLPPYVRHLTNLKTLDVSSNKISAIPLEIGQMSSLQELRVRQNRLEYLPTTLVNLVNLKELALDGNPLVFPPKTVAKKGISAIFGFLGEADTPSEALQQLVAPMQDLLSQQLDTQED

SEQ ID NO: 37078 - DNA, 1255 bp, Panicum virgatum
  misc_feature: Ceres CLONE 1988354
  misc_feature: Encodes the peptide sequence at SEQ ID NO. 37079
ctttctgtccagcatcgccggtgtagcctatagctttagtacagggcgtatcacaaaatggccgctgagacactgacactccgtgcgaccctgaagggccaccagggctgggtgacttccatcgcctgcccccaggacccaagctccgacatcatcctttcgtcctcgcgcgacaagacggtgatcgtctggcagctggagcgcaccgagacgcagtacggcttcgccaagcgctcgctgcacggacactctcacttcgttgaggatgtggtgctgtcctcggacggccagttcgcgctgtcgggctcatgggacggcaccctgcggctgtgggacctgaccagcggcaacaccacccgccgcttcatcggacacaccaaggatgtgctaagcgtggcgttctccgtggacaaccgtcagatcgtgtccggctcccgcgacaagagcatcaagctgtggaacaccctgggcgagtgcaaatacaccatcgcggagccggagggccacaccgagtgggtgtccaccgtgcgcttctcccccaccaacacaaaccccattatcgtgtccggaggctgggacaagatggttaaggtgtggaacctgacgaactgcaagctcaagaacaacctgatcggccacaccggctacatcaacaccgtcaccgtctcgcccgatggatcgctgtgcgcgtccggcggcaaggacggcgttgcgatgctgtgggaccttgcggagggcaagcggctatactccctggacgccggcgacctcatctactcgctggtgttctcgcctaaccgctactggctgtgcgccgccacggccaccggcatcaagatctgggacctggagagcaagagcgtcgtcgacgaccttcgtccggacttcgacggcaagaccttcggcaagaaggcgacggtgccctactgcgtgtcgctggcgtggtcctcggacggctccacgctgtacgccggatacaccgacggcgtcatccgcgtgtacgtggtcagccacatgtgagcagcagctatcagcagcacagcagcaggttgagctggtcggatgtaacgagcgtcgcttggcaggtctccagctacgagtcggtccgatttcaacccttgctctggtgaaacacatatccacaagtgctgtgcttgacacagtctgatgtggttcatgtagtggaacacacgttgctgtggcctgtgcacgcagtgctgtgcacacacggccgttgtaatcctccgtaatcggc

SEQ ID NO: 37079 - protein, 320 aa, Panicum virgatum
  misc_feature: Ceres CLONE 1988354
  misc_feature (97)..(135): Pfam Name: WD40 Pfam Description: WD domain, G-beta repeat
  misc_feature (55)..(93): Pfam Name: WD40 Pfam Description: WD domain, G-beta repeat
  misc_feature (185)..(223): Pfam Name: WD40 Pfam Description: WD domain, G-beta repeat
  misc_feature (141)..(181): Pfam Name: WD40 Pfam Description: WD domain, G-beta repeat
  misc_feature (6)..(46): Pfam Name: WD40 Pfam Description: WD domain, G-beta repeat
  misc_feature: SWISSPROT Homolog: EC 2.7.11.7 [Myosin heavy-chain] kinase
MAAETLTLRATLKGHQGWVTSIACPQDPSSDIILSSSRDKTVIVWQLERTETQYGFAKRSLHGHSHFVEDVVLSSDGQFALSGSWDGTLRLWDLTSGNTTRRFIGHTKDVLSVAFSVDNRQIVSGSRDKSIKLWNTLGECKYTIAEPEGHTEWVSTVRFSPTNTNPIIVSGGWDKMVKVWNLTNCKLKNNLIGHTGYINTVTVSPDGSLCASGGKDGVAMLWDLAEGKRLYSLDAGDLIYSLVFSPNRYWLCAATATGIKIWDLESKSVVDDLRPDFDGKTFGKKATVPYCVSLAWSSDGSTLYAGYTDGVIRVYVVSHM

SEQ ID NO: 37080 - DNA, 1876 bp, Panicum virgatum
  misc_feature: Ceres CLONE 1988367
  misc_feature: Encodes the peptide sequence at SEQ ID NO. 37081
ctcagttttgcatacatctccaatcttctattctgtggagctcatgtctgttaagatggtttcgcaagcagctcaatccttggaaggagattatgccctcaagggcatggtatgtgagctgggtgacctgcttagttcccaaggaaggaaagaaaaagaagcctgggccaaactccacaggatcctaccagaaatggtttgttctctgagcgttccccttaatccaaacaccaccacagaccatatactaagagagctgaaaccaatgttgtccttgaatctccgacacttcgaagctgatgaattatttcagaaaattatggtgactttcgacaatcaaatcagggcagaaaattcagatgcttcacagaccatttctctgttaaaaaatctcatcctgttggttgctgataagctggatatgcttccaattcgtgactccaaacatgtaagcatgattgtaaggagcactttttgtcaagatgaggtggatcgcatggtaaaagcctccaaggagctttctgttccaaatgctccctatgctgttatctccatagtcggagctcagagcagcgggaaaagctatttgcttaatcaactcttcgggacagacttccccgagatgaacgctctgacagggtggtcaagaactacccaaggaataatgatatcaaggtgcattaatccttcgatgttaatcctagacgtggaaggtttcgatggaatcgaaaggcagaagatgcaggatgcagcatttgagaataaagcggccctgtttacgttggctacatctgaccttatgatggttaatattgttgaaaccgatattaatcgtgaagatggaggtggtgccaagctatttaggacaatatttcaggaaagagttgaactacctccagggttgacacaaataatcgttgttgttcgtcgctatggtggacagatgccattggatattttggaatcccaagttaaaaaacgcatggaagagttatggcaaaatgtgcacaacagaagtgaaaatgtggaattcagggagtacattgaggtaaaagttgttgcattgccggacaaggaatcagataagttccaagagaaggttaaagaattaagaaaacttctcgccagctgcacttctgaattaagcgctaaagttccggcttctagcttctcccacagttcgaagttattatgggagcaaataaaacaaaacagaagacttgatattccatctcataaggtgattgtggctacagtgttttgtagcagaatagttgaagaggctcttaagtctttttattatcagaagaaatatgaagctttacaaggcgaagaatcaccacgtggtttcaaagaagcatcggacacacttttggacagcgttatatccacgtatgaccaagaggcaaagatgtacgatgatggtgtaagggacagggagcgcgaaaggctatcgcaggaaataaagaagatccttacggtgcatgccaagaaactaattataaagatgcgagagaagaaatcagagcagttccaacatgaatttgcaatgaatatgaacagcatggaggaaaatgttgaaccttcattctatgataactggatagaatcatgtgcaaaagagttcatgaactcttgtgaagaattgaaggaatttgatgcagactttttccacgacaagtgcaaagacctccaatctgagttgcacatatatattcgctctaaactactaaggttaacggaggaacgtgcgaggaaggaacttgaactggcccagcaaaggaatgacaaaaacgttcaagatctgtgtaagaagttagaagaaacaatgatagatagacaacatatggatgagatcatgaagcttgaaaaggag

SEQ ID NO: 37081 - protein, 518 aa, Panicum virgatum
  misc_feature: Ceres CLONE 1988367
  misc_feature (80)..(518): Pfam Name: RHD3 Pfam Description: Root hair defective 3 GTP-binding protein (RHD3)
MVTFDNQIRAENSDASQTISLLKNLILLVADKLDMLPIRDSKHVSMIVRSTFCQDEVDRMVKASKELSVPNAPYAVISIVGAQSSGKSYLLNQLFGTDFPEMNALTGWSRTTQGIMISRCINPSMLILDVEGFDGIERQKMQDAAFENKAALFTLATSDLMMVNIVETDINREDGGGAKLFRTIFQERVELPPGLTQIIVVVRRYGGQMPLDILESQVKKRMEELWQNVHNRSENVEFREYIEVKVVALPDKESDKFQEKVKELRKLLASCTSELSAKVPASSFSHSSKLLWEQIKQNRRLDIPSHKVIVATVFCSRIVEEALKSFYYQKKYEALQGEESPRGFKEASDTLLDSVISTYDQEAKMYDDGVRDRERERLSQEIKKILTVHAKKLIIKMREKKSEQFQHEFAMNMNSMEENVEPSFYDNWIESCAKEFMNSCEELKEFDADFFHDKCKDLQSELHIYIRSKLLRLTEERARKELELAQQRNDKNVQDLCKKLEETMIDRQHMDEIMKLEK

SEQ ID NO: 37082 - DNA, 620 bp, Panicum virgatum
  misc_feature: Ceres CLONE 1988370
  misc_feature: Encodes the peptide sequence at SEQ ID NO. 37083
acggacccgtgtgtgagcgcaccccttccctgcccccctctcgtgctcccatggaggccaccccgatctccgtcaagccgccgtcgccgtcgccggcggcggcacccccggcggctatggatcccagggacttgccaacgcacgccacggcggcgaccgaggtggagccgagcagcatgaaccagctcgcagtcacagtcactccggaccccaagcggcagaagctggaggaaaccgcggatgggaatgggtgcaagcattgcgcctgtaagaagtccagatgcttgaagctttattgcccatgttttgctggaggtggttattgttctgaaaagtgtggatgccaaccatgtttcaacaaagatgcatatgcagaaacagttcagactacgcgcaaggtgctgctttcaagacagaagcgtatgtcactgaaaattaataggagatctgaggcaaatgctgaagcaatggaagatgctcaccattcatcttcttcaactccaccaaagcgaggttgcaactgcaagaaatcaagttgcctaaagaaatactgtgattgctatcaggacgggactggttgctccttgttttgccgctgtgacgattgccagaatcctttt

SEQ ID NO: 37083 - protein, 189 aa, Panicum virgatum
  misc_feature: Ceres CLONE 1988370
  misc_feature (151)..(188): Pfam Name: CXC Pfam Description: Tesmin/TSO1-like CXC domain
  misc_feature (66)..(107): Pfam Name: CXC Pfam Description: Tesmin/TSO1-like CXC domain
MEATPISVKPPSPSPAAAPPAAMDPRDLPTHATAATEVEPSSMNQLAVTVTPDPKRQKLEETADGNGCKHCACKKSRCLKLYCPCFAGGGYCSEKCGCQPCFNKDAYAETVQTTRKVLLSRQKRMSLKINRRSEANAEAMEDAHHSSSSTPPKRGCNCKKSSCLKKYCDCYQDGTGCSLFCRCDDCQNP

SEQ ID NO: 37084 - DNA, 1253 bp, Panicum virgatum
  misc_feature: Ceres CLONE 1988374
  misc_feature: Encodes the peptide sequence at SEQ ID NO. 37085
ggcttccactgacacaaaaaaggcagagagagagagagagagagagagagagatgggcacggctgctggcgagatgccgccgttcagcgccgtgcgcgtgaacaagccccttgccgccgccaaccgcctcatggcggccgtccacctgtccctcgtcgccgcggtcatcgcccaccgcgccccgctgttggtctccgccgccaacgccaccatggtcgcggcggatctgacgctcctgtttctgtgggcgctgtcgcagtcgatgctgtggcggcccgtgtcgcgcgccgccttcccagagcggctgctgctggcggcccggcggcggagcgagctgccgggcgtggacgtgctggtggtgacggcggacccggacaaggagccggcgctgggggtgatgaacactgtggtgtcggccatggcgctggattaccccggcgcgaggctgagcgtgtacctgtcggacgacgccgggtcgccgctgacgctgctggcggcccgcaaggcctacggcttcgccagggcctgggtgcccttctgcaggaagtactcggtgcagtgcccgtggccggacaggtacttggccggcgacgacgacgagcgccgtggtgaggccgccgaggagaggcgaggaatcaagaaactgtacgagacgttcaaggaggacatagaggatgcctgcaggaagcatgccgataggacaagagaaaaacgcaaggatcacgatgcttatgtggagatcatgagtgccggcgacgaggaggaagacgacgacgacgaaagtaggatgccgttgctggtgtacgtgtcccgtgagaagcggagggcgtccccgcaccacttcaaggccggcgctctcaacgccctgctccgggtgtcgagcctcgtgagcaacgcgccctttgtgctggtgctggactgcgacatgtcctgcaacagccgcgcctccgccctggaggccatgtgcttccacctcgaccgccgcggggccccagacaacgacctcgccttcgtgcagttcccgcagatgttccacaacctcagccgcagcgacatctacaccaacgacctcagatacatcttcgcgactcgatggttcggcctggacggcctccggggcccgctcctctccggcaccggcttctacgcccggagagacgccctgtacggggccccgccgcccgccacgcaaggcggtgctgacttgtcgtccggcgagctggcgaggagcttcggccactcggaaccactct

SEQ ID NO: 37085 - protein, 400 aa, Panicum virgatum
  misc_feature: Ceres CLONE 1988374
  misc_feature: SWISSPROT Homolog: EC 2.4.1.12 Cellulose synthase (UDP-forming)
MGTAAGEMPPFSAVRVNKPLAAANRLMAAVHLSLVAAVIAHRAPLLVSAANATMVAADLTLLFLWALSQSMLWRPVSRAAFPERLLLAARRRSELPGVDVLVVTADPDKEPALGVMNTVVSAMALDYPGARLSVYLSDDAGSPLTLLAARKAYGFARAWVPFCRKYSVQCPWPDRYLAGDDDERRGEAAEERRGIKKLYETFKEDIEDACRKHADRTREKRKDHDAYVEIMSAGDEEEDDDDESRMPLLVYVSREKRRASPHHFKAGALNALLRVSSLVSNAPFVLVLDCDMSCNSRASALEAMCFHLDRRGAPDNDLAFVQFPQMFHNLSRSDIYTNDLRYIFATRWFGLDGLRGPLLSGTGFYARRDALYGAPPPATQGGADLSSGELARSFGHSEPL

SEQ ID NO: 37086 - DNA, 745 bp, Panicum virgatum
  misc_feature: Ceres CLONE 1988374-R
  misc_feature: Encodes the peptide sequence at SEQ ID NO. 37087
gccgtctccgtgccccaggccatggccgtcgcctacttcggcttcctcgccctctccgcattcccggtgctctgctacgccaccctgccgcagctctgcttcctccgcggcgtcccgctgttccccgacgcccggtggtccgccgccgcattcgcgtcctcgctgctccagcacctggtggaggtgtctgtggccaaccggaggctggcggtgcgggcctggtggaacgagcagaggttctggatgctcaacgccgtcaccggccagctcttcggctgcgtcagcgccttgcaggacctgctcggcgcggcggctctcgacttcgacctcaccgccaaggctggcgacggcagcctgtaccacaggggcgtcttcgacttcacgggctgctccacgctgctgctcccggccaccacgctctgcgtgctcaacgccgccgcgctcgtcggagggacctggaacatgatgaccagaggcggcggcgcccgcagcgagctgctcccgcagctcttcctcctgagctacgttgcggcgctgagctacccgctgctggaggggatgttcctccgccaggatcccgcaagggttccacggcgaatcactgcactctcagtagccttcgccgccgtcctgctcgccctgtttggatgagagagagctcaagaaccttatcatgttttatttttcttggcaagcatcaagcattgatgtactttgaggctttcatcaaacattggttgctagc

SEQ ID NO: 37087 - protein, 216 aa, Panicum virgatum
  misc_feature: Ceres CLONE 1988374-R
  misc_feature: SWISSPROT Homolog: EC 2.4.1.12 Cellulose synthase (UDP-forming)
AVSVPQAMAVAYFGFLALSAFPVLCYATLPQLCFLRGVPLFPDARWSAAAFASSLLQHLVEVSVANRRLAVRAWWNEQRFWMLNAVTGQLFGCVSALQDLLGAAALDFDLTAKAGDGSLYHRGVFDFTGCSTLLLPATTLCVLNAAALVGGTWNMMTRGGGARSELLPQLFLLSYVAALSYPLLEGMFLRQDPARVPRRITALSVAFAAVLLALFG

SEQ ID NO: 37088 - DNA, 465 bp, Panicum virgatum
  misc_feature: Ceres CLONE 1988382
  misc_feature: Encodes the peptide sequence at SEQ ID NO. 37089
aatcccagcaccgcagacaaaggtgctttcgtactcgcctctctccgcgactgccagcttgccccctcctactccctttccccaccgtcgccgccgtctcactctttcgatggcaccatgagggagtgcatctcgatccacatcggccaggccggtatccaggtcggaaacgcgcgctgggagctctactgcctcgagcatggcattcatgctgatggccagacgccctgcgacaagaccctcggaggaggtgatgatgctttcaacagattctctcgtgagactggggctgggaagcatgtcccccgtgctgcgtttgttgaccttcagccccctgtgattgctgaggtgaggactggcccttaccgccagctcttccaccctgagcagctcatcagcggcaaggaggatgctgccaactactttgcccgtggtcactacacgattggcaaggagattgtcgac

SEQ ID NO: 37089 - protein, 115 aa, Panicum virgatum
  misc_feature: Ceres CLONE 1988382
  misc_feature: Functional homolog of the protein sequence given in SEQ ID NO 50141
  misc_feature: Useful for making plants with altered cell wall content and/or composition
MRECISIHIGQAGIQVGNARWELYCLEHGIHADGQTPCDKTLGGGDDAFNRFSRETGAGKHVPRAAFVDLQPPVIAEVRTGPYRQLFHPEQLISGKEDAANYFARGHYTIGKEIV

SEQ ID NO: 37090 - DNA, 638 bp, Panicum virgatum
  misc_feature: Ceres CLONE 1988384
  misc_feature: Encodes the peptide sequence at SEQ ID NO. 37091
accggccccgctccccagctcctcgccaccccgcggaaccctaaccctaccctagccgccgcagtcgccgccaccgccgccgctccatccggatgtcgggccccgaagcttccccggcggagcaacccgcttcccccggcgcgtcgcccgaggtgtcggccgagcgcgccccgtccccgaccccgtccccggcggattcgcagaggaaggaggagctgctgccagtgggggaaaagatctcggaattgaatgaatcacaatcagagcttttagggagactccgagggcttaaggaggatctggagaattggaggagcaatttagacacccaagtgacgaagtacaaagttgaaatctctgatatcaaaagtgcactcaataatgaaatagaacaacttcgttcagatttccaagagctgaggacaaccctcaagaaacagcaggaagatgtgtcacttagcttaatgaatttggggcttcaagatgctactgaaaatgatgtgagcaatggaagtggagaggagaatacaaatgaggacttgtcagctaacttagggagcttgaaattgaatgatgcttccgaaaatcatgatgaaagcagagacgctaaggatgataagactgaaacccctgctgaa
